United States Patent 7,745,391 (HUMAN THROMBOSPONDIN POLYPEPTIDE) - sequence listing, part 65

SEQ ID NO: 225329 - DNA, 389 bp, Homo sapiens
atggaggttgcagtgagccgagattgcaccactgtactccagcctggacgacagaatgagactctgtcttaaaaaaaaaaaaaaaaaaagtcagtccctgcacacctgaggcctttctcacctctgtggtctgaagctctagttaagattggtttaaactgccccattctgagcactgtggggtgtcattgccttcccaaagacatctctaaatgcctcagctttacatttcccccagcttcttccgactccaagtttcttcttctataagatgcttaatttgtgtccccacgaaattcatatgtggaaatcctaaccctagtaccttagaatgtgattgcctttggagataagacctttcaagaggtaattaaggtaaaatgaagccc

SEQ ID NO: 225330 - DNA, 366 bp, Homo sapiens
agtatcaagtatttatgggtctaaagtagctcactgcatgacctaagtgcatcttcccagcagtgatgttagcatcagctcttctaaattaacatgggtaaggggtgtgtcttagtccattttgtgttgctataaataaatatatgaggctgagaattgtgtaaagaaaagtttacttggctcatggttctgcaggctgtacaagaagcatggggccagcatctgcttctggtgagggcttcaggaagcttctactcatggcagaaggcaaagcgagccagcatcacatggcaagagaggaagcaagagagagggagaaggcaccaggctctttttaacaatcagatctaatgagaactgacagag

SEQ ID NO: 225331 - DNA, 454 bp, Homo sapiens
gcacgagccgaagtgtaggtaggaggtctggttccatgtgagaaccacaagtccagggcaatcacaggggcccctttcctcttgccagtgattggttaggcatggggatctgacacaattctgaccaatgagatgagagggaacgtctgctggatggcttctgggaaagttttaagccattgataaaaatgatacatgagaagaaatagtttcttatttgtgtcttgccattgtcatgaagatatgatgtgtagaaactgtggctgtcatttgtcagaggatgaagttgccgaagacaactgagaaaaagaggaaaagaatctgatccataatggtgccagttgagctgctaaattaatcagtcctggaacattttttattttgacttcttactatgtgagatcataaattccttattgattgaataaattgaaccgaagttttcagttactta

SEQ ID NO: 225332 - DNA, 409 bp, Homo sapiens
gaagccagaaatgcccctcaaaccaggggatttttagatgcccagaaaggagtctagtctgtctgcaggaagcagctgctcaaacaaccatgagtggaaactgggtgatatggtttaactgtgtccccacccaaatctcatcttgaattgtactctcataaatcctatgtgttgtgggagggacccagtgggagataattgaatcataggggtggtttcccccaacctgttctcatggtagtgaatacgtctcctgagatccaatggttttataaggagaaacccctttcacttgttctcttctctgtcttgcctgctgccatgtaagacgtgcctttcaccttccgccatgattgcgaggcctccccagccacgtgaaattgagtccattaaacctctttttctttat

SEQ ID NO: 225333 - DNA, 597 bp, Homo sapiens
gaaaatgaaagcagaaattggagtaataaatctataagtaataaagctccaaaaatttgtaggagagagtagaacctaggcaggggcaagaaaagatttttttctgtggcttttcaaggaagcgtgaccctattgactccttggcttcagacttctagcctccagaactgtgaaataataaatttcagttgttttaagctacccagtctgtggtaatttgttccagcagccctaggaaagtactacaatgctgtattcacgttctgaactctttccagttattttgtgagtatgggtagacaagattcttagaacagtcttgacagtctctgagtttattgcttattggtgggtcctatgaaatataaattacttctcacagtttaaggaatgtcctaagttgatctgcactaatttataggatttagttggagtttaaggaatgtcctaagttgatctgtactaatttccaggaattaatttgcaccttgggctgtgccttaaattctagctggatttatcagccagcttctatttgtaatacaggtgactatggtccttaactcctctcctaatttttgctctgagaagaaaatt

SEQ ID NO: 225334 - DNA, 613 bp, Homo sapiens
cctgctctagactaattgaactctgaagtcttttctttaaccaggttgttgaatgcctttggggaaatttacactcccctagggggattgttggctatagaaatctgtggtcttcaaccgcaagtggtctcttcacaatctgctaattcatgttccagatcagcttttatcttttattcaccaagagcaactgtttgaaacctttattactcttttgatattctcttaattcactttgagcacttaggctcgtaaagaaagcaggtgaccctttatcttgccccaaaacttacagatagtaatttcatatgagctgttctctcctaaccaattttctccttaaggtctgtatagtataaatttttcttatacccagagaccctcaccgtaccagataaatattcactcttagcttctccttgttgcctcattttccataactttataacttgctgcagttttttgtcttcaaaaaacaaaaaaactcaaactttttttgagtgggacttactgtcttcacttctttaacccacatcttgttaactcttcattatcttaacattctgatgtctgtcctcaccatttccttgaaattgttgataaagatcatcag

SEQ ID NO: 225335 - DNA, 475 bp, Homo sapiens
ctagaaggtgtggctcccagctctactatagctgaccagtgctaaggtgaatccactggtcaccactagtctgttaggtgccactcagtgacctgggagtgaagatcaggtctggttcggatacaccaagcattaacgctaccagctgttccctcacattttgtcttcatccccaagggtggatggaaaggaagaaggcagtgatattgtttcagcctctttctcaatctcttggcctgcctcagcccctgcccctgggtcatcccaccactgcctttgggagccagagtcttcaagccagaatgtctccaaataaagctgtggggaccatcctgagtcttccccaggctgaggaaggatagcttgtctgctcagttacctgttgttttctatttccatcaatttctgttgttttctattgctactgtaacagatttccacaaacttcatggcacaaattgaaacaacaaaaaaa

SEQ ID NO: 225336 - DNA, 468 bp, Homo sapiens
cttatgtgctattctggtcagacttcatcttccaagagctgtcaccaggcctccccttagctcaatgacccatctctttccccactttctgtttaatcaggcttatacttgctgcttcttttatgttttattgacttctatgagatcaattaagtgctccttattctactttcccctgcactggattaaaaataagatattgtattgctttactatcggaagttactcttaaccttgcatctttgacttaatgactaattggtatctccttcttgagcaataaaaaagaccttagaatgctgtaggtacattctttctttttttttttttttgagacagagtctccctctgttacccagggtggagtgcagtggggcaatctcggttcactgcaaccaccacctcctgggttcaagcgattatcttgccttagcctcctgagtagttgggatcacaggtgagcgccac

SEQ ID NO: 225337 - DNA, 459 bp, Homo sapiens
tgcactgcagaggctcatgaaagaaaactacatcccccagacgccttgcaggcaacccttccgagaggatttaggtcctgccaatgagatgtgctaaagcaagacatggagggcagaagtcaggcgtgggctgagctcccatgccttttgctatttcttctgacaagctctgacgtggaggtgtgtgctttcttggcatcatacgtggcagcaaccccattgttcagatcccgactcaagggtgtccagagaaagagtgggacatcctttcactatgagattgtggctagtatggcatggctgtggggtggcacttgtacagagtagtcgggtggcttcctgagagtagaaaatgctcagacctggtggggtgcagtcccagtacttcgggaggccaaggcaggtgtatcacttgaggtcagggattcaagaccagcctggcgaacatggtgaaacacc

SEQ ID NO: 225338 - DNA, 559 bp, Homo sapiens
tgtatatatacacacacacgcacacccacaattttagtgtattctgattaactttataaagcattgcttaattacatatttggaagagctgatttagaatgttcaaaggctgccaaatttttggtacataaattaatcactttttttcttcttctcttcttcaaataatggcttactagtagtaatctctctcatagtggaagttcttgtgattctcaacttttttccacatctgataatgtaccaaatgttggccaattccatctcacagaaagtacacgaatgctgaatttcttctaatccttgtggcttaggaaacacatcttaagagttaagctctgaagtccactgattcaaaatgacttatgaattatagtagaagaaaacatacacacataaacacacaaacacaaaaatgtaaatacctaatactttataatgtgtattgttgatgatacaaataatgtttattcaacaaatatatagtggctagtttttttgctcctagagtatctttgaatttttgtatttaattacatatttttgaaataccatctgt

SEQ ID NO: 225339 - DNA, 210 bp, Homo sapiens
atctagatatgatcacattatagttttagtattattttctacttctacacttgcataggtataaaatacctgtcaatatatattatatataaaacagtattgatagtatatttttatatagttttgcaacctactttcctcattcagcataacagtgtgaggatttctctggtcatcacatacttttattaaatattttataagtgctta

SEQ ID NO: 225340 - DNA, 497 bp, Homo sapiens
agcacggtgaataagaacccaacttttgagccagatcactttgcatggaatccccattctatcattctatcatttctgggctgtgggaacctcagacaagttacttaacttcttcaatgctcagattaaaaaaaaaattcacaaaatatctctaataacagtaataataactgaaaatacctacctcagagggttgtcgtagagatcaaatgagataaaaatatgtaaagcatgtagcctagtgcctgactgaaaaaaaaatctctcaatagatgcaactcttatgattcttattaaggacttggctattgccacaaatgaaggtgttatgagccctggcttaagagcaagaagcctgcaaagctaactctcctaatcccaacattcctttccagggaaagtagggtgacaggtggaggctgggaattaacgttttttgagcaccaaatatggacaaggcacaggggttgggtgtttttctagtgagaatacatatg

SEQ ID NO: 225341 - DNA, 225 bp, Homo sapiens
acataaatttcccccagaaagtccaagaaactggttgtatcaggggtgagataagcatgaaggcagttagaactatcccagaaatccagttccattcttaagtaggtatttacgtctgttacactaaaatgattatgaaaaacaaattttctttgatgttttcctcatcctttccatatgcaagctgaatgtttttcctttgcaaactaattactaaattaaact

SEQ ID NO: 225342 - DNA, 417 bp, Homo sapiens
tcacctttaagtccaaagagttccttttcctttgctatctccgtaggcagcactttatgttgtgttttttataatcagaggaaaccgatggcaccataaacttctagaaagtcaactaccaccttggttctgtgtgggaaagtaaaattttatgttttccataaatacaagatgaagacagcatttaaagcctatccctgaattggatagatcattttaaagtgagtttgttgcatttagaaaccatgatccctattggccctacaacaaggcaattttcatatcaggcaggtcctggcatctggggagactggctgtttcctttgttgccagggaaatcatttcaaaatggaaaaaaccctgaatgccagcccccagcaatcttcaaaacaatacacattctttaaaaaaaaaaaa

SEQ ID NO: 225343 - DNA, 508 bp, Homo sapiens
atgggggatttattggctcatggaactgaaggaagggctgaatgcccaattgtgggaagggcagggatacaggccgactttaggaataaccggacccaggacataaatgctaccaggacgttcttttcacccccagtctctgcctctgtttgtgtacatcagccatactccctttcctgcagcctgtctttttccacatggcaggagatgggccactaattcccacagactagcttctagctctgtacatgtcaaacctgtttctcctcctctgtccacgtgtgtgttcaatgctaggcactgtttacatcctcgtatcaccaaatgactttctgccctgcacgttggtgtaataaaatgaggtgagtcagattggcgggcatagaattattcctggaagctgttcctacttttttgttaaagtatcctgtattgtctgatatttttgcttttataatcagaatttaaaatgccatttctattttttaagaaaagacctggccaggca

SEQ ID NO: 225344 - DNA, 241 bp, Homo sapiens
ggctcaaacgattctcctgcctcagcctcctggcatgtgccaccatgcctaatttttgtgtttttagtagagacaaggtttcaccacgttggccaggctggccttgaactcctaacctcaagcattccacctgtctcggcctcccaaagtgctggaattacagatgtgagccactgtgcctggccgtattttatttacatttttgtataattattatgatcatagaaataattctgtagtc

SEQ ID NO: 225345 - DNA, 598 bp, Homo sapiens
acacaaaaattggctgcgcatggtggtatatgcgcctgtaatcccagctactcgggaggctgagacaggagaattgcttgaaccccggaggtggaggctgcggtgagccaaagttgcgccattgcactccaccctgggcaacaagagcaaaactccgtctcaaaaaaaaaaaaaaaaaggagggaaactctgacacgtgctgcaacattgatgaaccttggagacattaaactaagtgtcaaggaagacaaacattgtattgttccactttggtgaggtacctagaatagcagtcacattcatagagacagaaagtagaatggtagtaaccaggagctgaggggagaaaggaaatggagagttactgtttaatggatatagttttgatttagtaagatgaaaaaggtcccaagattggacgttctagagattgtaggggactgtatggttgtagaacaatgggaatgcacttaactgccacagaaatgtacagttaaaaatgattaaagtggggccttgtgcggtggttcacacctcctacactttgggaggccaaggcaggcatgtcacttgaggtcaggagtttgagaccacctcg

SEQ ID NO: 225346 - DNA, 429 bp, Homo sapiens
cctctcctgggcacagaacgggatttcacccccacctccctcaccaccacaggtgtgtaaagccagtgacatcgctgatgcgaaggctctgaaggcagagggcagctcaccccccactccccaccggacaccgggggcgagggccgccacgtgtcaggctgaggatggcgggacagagcccccagtctccctgtgagcagtgtgtggggccaaacaacctgggctgttgttgacgtctattactgtggcatggtctggcctgtccctaccaaacaccagtctcagcgcaccctgacaaaatacaagcactgaggcttaacatgggaacaatctggccgattgttattcttacgattattataaatacccaatcaaaatgatacgcatacatttccaattttcataataaacaaaaataaaattgagcta

SEQ ID NO: 225347 - DNA, 548 bp, Homo sapiens
aaagaaattctgttgttttcagcaacatgggtggaattgaagagcattatgctgagtgaaataagccaggcacggaaagacacataccatatgttctcacttacatgtagaatctgaaagagtccagctcataaaagcagagagtaggatggtggctacagaggctgggaaatggggagatgatggtcaaagggttcaaagcgtcagttccatgggagaaagatgggtgtgtgtttttctgagatctgttgaacagcatggtgagcataaaaatacagcactgtacatttaaaattgctttaagaggtcagacgtggtcactcacaactgtaatcccaacattttgcgaggctgaggcaggatgatcacttgacaccaggctggtcgcgaactcctgacctcaagtgatctgctgccctcagccttagagaataaacaactacataaccaccaagcaagcagctcaagaaacagaataagataagggcggtgagttaccagttccattcagtctgtgttggtcctagtcagtacagtaagacgtgaaa

SEQ ID NO: 225348 - DNA, 547 bp, Homo sapiens
acagaatttatttagtatcacttattcaggctgtgttgtttccgtatttgtctcaaaagttgcctcactacagatatttgtccactacaaagctttcctgagttttctctggcagaattacttccattgtcctttttagtttcagagcactttattatatgaggactccacggctggcatggtatatctcaactgtctgactgtcccactggttttgagatagttctttgaggggacaggcaccttgtctggctcctcatgggtcactgacacagtgcttggcacccacctggactgtgcaactgactgactttgagggtatcagttgtcctttttgcctggaaaaggaagttcatggaggatagaaactcagatgggaaaagggggttaggctattactggggaaagcctagggtgccaagattgtgtgtggatcttatctgaggtcagcgagatctactgctgggttctgacaagagaagggtcatgatttctttttttcttttcttttgtttttgtttttgttttgagactccatttcaaaaaa

SEQ ID NO: 225349 - DNA, 856 bp, Homo sapiens
agtgagatttccgcacgttgtagctgagaggccggctgctgagacgaccccttagggaaaagtggaaaactctgcctccagaatggagatctggctttctcttcccctgctcaacctgagctcagggattctgtgcccctcgctctccggacagtttttacaccagattatcttctaattgctgtgaatgcagccgcatcagcaagtccccatctggggacattatcaatttcaaaccttggtcagtcatgaagccccattgaaggacttcatcctgaaatccacgaacaaagaacgagatcccgcaatgctgtcatctaaaatgcctgaaaatgccagtgctgcgacagatggccctgctcggtaaaaagcctaattatttggtattgtatgctacaaaagagaaatgccataattcccagtgggggctgtggatactggacccccataaccaggtgccagagatcacgtggtgttcaaagtccaaattataagcatagtgccgaggactctgaggatgacttctgcacatcttccgaaaagggatggaacagcagaatgagtgccatcatggcttggatggttggaggtgctttgggcatgaagaccctctaactgtgaagttagaggcttccaatgttagctctgttttaagtatatgcacaaagtcacagtctcatagctgagctattaaaaataaaatcaacaccaagatataaaataaaaaaaaaaaattcgggggatttttgtgcggggggggaaaggggttggaaatggcattggtcaatggggttcggaccggtttttggaaagtggtaattggggtcccaagggggagataattgaaagcagtact

SEQ ID NO: 225350 - DNA, 658 bp, Homo sapiens
caggattatattaagccttgtttatcaacagctcataacaatgtgtgtttctgcatgcttttcccttactctgaaataggttttactttgcttaaattagtaattagtaaatattaatgctttattggtttaataatacatgtattaaaagcagtttattttcacagaaaaagcctaattatttggtattgtatgctacaaaagagaaatgccataattcccagtgggggctgtggatactggacccccataaccaggtgccagagatcacgtggtgttcaaagtccaaattataagcatagtgccgaggactctgaggatgacttctgcacatcttccgaaaagggatggaacagcagaatgagtgccatcatggcttggatggttggaggtgctttgggcatgaagaccctctaactgtgaagttagaggcttccaatgttagctctgttttaagtatatgcacaaagtcacagtctcatagctgagctattaaaaataaaatcaacaccaagatataaaataaaaaaaaaaaattcgggggatttttgtgcggggggggaaaggggttggaaatggcattggtcaatggggttcggaccggtttttggaaagtggtaattggggtcccaagggggagataattgaaagcagtact

SEQ ID NO: 225351 - DNA, 504 bp, Homo sapiens
ggctgtaggtgccaagccaagctgccctcagctcccctcagtttccttctatgctcattgtgcccaaaatctggagggggccagggcggcagggggctggtgtgtcagcactgcccaactttgctctgagatcagagaaggcagggagaagctaggcagtaggaacaggcatttccatgcctgcaagggcaagggggtatcgggggacctgccccaataatcacgtaggttcttttctattttcctaagcgtcggctgacttgagaaataaaaggacagagtacaaaagagagaaattttaaagctgggcatccgggggagacatcacacgttggtaggatctgtgatgccccacaagccacaaaaaccagcaagtttttattagggattttcaaaaggggagggagtgtgcgaataggtgtgggtgacagacatcaagtacttaacagggtaatagaatatcacaaggcaagtggaggcagggtgagatcacattgctaatga

SEQ ID NO: 225352 - DNA, 471 bp, Homo sapiens
gaggccgcccttgtttgagtccacctctccttggctgtgcagcgtccgccagccatgctgacccctgaagccttggctgtgcctcccaagtgcaccgggtttccctgcagacacacgctttggcatgaacatgccttcttaggcatgaacaagaagttcacgtggctgccacacccaagtgccttgcatttcgcctgctccccgcaccccccccaaccatgttgccacacgaggcttattctgaattacaggttggttgtgatatcacctctggtacatggactgttaaaactattgaaagggaggtggatctgaagcacgcctacctgtttcctggcatacttggaacgttgccagaccactggatacttagaaggctaattctacatttatcctcagccatcattctgagcgccttcaaaagatgaatcatctgcaccgactattaaatttaataaccatgcaaatctc

SEQ ID NO: 225353 - DNA, 275 bp, Homo sapiens
tgtgtaggtctatttctggaatctgtattctgctctattgatctgtgtgtctatcctttcaccaatacacactgtcatgaagtcagagaggtaacaggaagccagatcatgtagggccttgtagaccattgaaaggatttaggcttttatcttgagtgaaatgaggagctacaggaaggtgctgggcaaaggaggaacctgactttattgaggcaaggataggaatgtgaggttactgcagtcatccagatatgcaaaaatggtggattggacca

SEQ ID NO: 225354 - DNA, 593 bp, Homo sapiens
gaagccacaaaaaccaatctgcagctaattgaatcagaaatctatgaaaggtacagtgcagactgaagaagatgactgagaggcttcataatgaggaacagcacccaaaatcacgctgcggaacagctctcagagaacagcactgcagtgacagagacggcaccactgcagcaccagcgccggtgcaggactggatgctcatgcacatctcaggcctccagatgcccgcgaccttctccccttcagcctcttccataaccacactactcctttcctccatcggcttctcccctgactgcacagaagcccatttccccaccatgacgaaaaaaaacctttcccagatctaaggcaaagggaaaaacatacaagacagaatgtaaatttgtgctgccaggggctgggaaaggaggggatggggagtgactgatgaatgggtatgggctctccttccggagtgatcaaaaagtgttctggaactagagtggtaaagaaggtacgacctcgtaaatgtactaaatgtcagtaatgataaattgtatgttacatgttaccaccaaaacaacaaaaacatctctggcctccctcagatt

SEQ ID NO: 225355 - DNA, 441 bp, Homo sapiens
gcaataatagccacagtgttgcataagaggtgtagggttgcatggtgattgccatcgaaactgcccagattgtcataaacttcaggagtgcagcagctatgctgtattgttaaaatgttggttagactaaccttataaccctataagaaatcatttgttcctggctgggtgcgctagctcacgcctataatcccagcactttgggaggctgaggcaggtggatcacttgaggtcaagagttcaaaaccagcctggccaacatggtgaaaccccatctctactaaaaattcaaaactagccgggcgtggtggcacatacctgtaatcccagctacttgggaggctgaggtaggagaatcacttgaacccaggtggtggaggttgcagtgagccgagatcatgccatgcattccagcctgggcaagagcgaaactctgtctca

SEQ ID NO: 225356 - DNA, 278 bp, Homo sapiens
gcacgagaaaaaccatatcattatgctcccaaaggagcaaacgttatagtagcagagcttggaggagtgctcatattttgatcaccgtgcatgcattatgaatttaaggtcttttattaagtaagttacagattgaatatggtaaagctacaaaaacatagcacttgtgttcacttaaaactaaccagttgcagttttaaaatcaggtaaatggcgatatattggtgtcattaggaaaaatgaatattagaaataaccttaaaaccaactcgtaaaaa

SEQ ID NO: 225357 - DNA, 514 bp, Homo sapiens
aatgcaaaggtttatcaagtttctccattttttttcaaaataatatattatggagcaaagtgatattttataggcaataataattatagtgttgatcaggttctaaaacattacattaactataatgtcccaaacctccttcttggctaatattctggttccgttcttgccagtagctcctattttctctactcactcattctgaaaacttgaatcatctttgattttcctctctcccctttccaaacatttattgaattgtcaaattatttggattgtatctcctggatatttcttgaatccatcctccattgcctttgtgtactggactcatgatgttgcctgttgtcttcaaagaagcaggcaattcattttgaatgcttttgatcggatccaaatataaaggccaaaacaaattaagtaatttatttaataacactgactccttgccgcatgccaacccccgatctagactctggtgatatagcaatgaacagtagggttaaaaaaaaaa

SEQ ID NO: 225358 - DNA, 837 bp, Homo sapiens
gggcgctggtggcaggtggtacaggcacgtggatccaccgaccacaaggacggattcgattggattctgattgaccggcggaccagctccagagtaattgtctatggctgcccctgcaatgactgattgattgacaatggctgagagaccagcaagtgagtcgctccgagaaagcgaaggagcccactcttgtgcggcgctttgggaagacgcctgttggttttgaccccgaataagaagaggaagctgagagcgggctgactgtggtccagtcctacttcgattcagtgtgaactgacactctgatctgaagacgctcaggcctttgtcatttcagcaccccagatgctattttccattcgaagaatgccgccaccaggtggcggtattttaacatggccatgcaatccgggtatgaggaggagggttggtcccctgggagagctaatgtatgttgctgttgctgtttgtcttattggatccttttttttttttatagagccagaggcttgctctgtcacccaggctagagtgcagtgtcgtaatctagctcactgcagcctccaattcccaagctcaagcgatcctcctgcctcagcctctgagtcactgggattacaggcgtgagctaccgcacccggtctttttgcattactaacctgtgatatgggtttatgggacttcattatttcaaagggaggcagcttggccccggagagcatgcattcctggcttctgcgatggatagacttgtgttctccatctcaggagctccccctcaaggtgggggtaagagatgagggcttccactctggctttgttcgagatgtcttgatg

SEQ ID NO: 225359 - DNA, 443 bp, Homo sapiens
ccaggctggtctcaaactcctgggctcaagtgatcaacctgccttggcctcccaaagtgctaggattacaggcgcgagccattgcacctggcctaagttttttcgtgtttgttctttgttttttgtttttagacggagtcttgctctgtcacccaggctggagtgcagtggtgcgatcttggctcactgtaacctccgcctcccgggtttcacctcgttagccaggatggtctcaatctcctgaccttgtgctccgcccacctcggcctcccaaagtgctgggattacaggcatgagccactgcacccggcctgcacctggcctaagttttgagataatttgttatacagcaacagataacttatacaacacaagttcatgtcatgctcatgacaacccaggggttgtctccagccccatcactatctccattttatgggagc

SEQ ID NO: 225360 - DNA, 753 bp, Homo sapiens
gtaatgtcatttttaatttagagagccttaagctgtccacttttactagtgatagcatcgttgcagttgtctcctgagactttatgtaaacataagtcatgcgtcccgggcagtttgagaagagattgttaaagatgacattgggcatcatgaagatttcccccactttgatctcttttaaattgccagatacagtttatgttactgccatattttagccattcctgaaattaatatatcccaggacttttgaaccaagttaagtacagaaataaaacaaaggttggaaatgaatgccttgtaatgttttcatgtcatttcaagaagaaaaatggaagatgaatcagattctcttgctcctaggtgacttggtaaataaaaagagaagaaagagcaagctcctaagaaatacataacaccaaatagacaaaagctttcttattttcctaggggacactagtgtattggtgatggctttgtacattttaaagataaataagatccaactatctcttatctttgtgttaactttttagtaatattttattgtcactttccttacgatttgtatccttagtgtcattattaagcctgaattttaaatctcatcacttttgtggtatcaagcgtttctttctcaaacaacgagatttctttaaagactcaaacaatgatattcctttaaatattcagactagtgggtataaacaaagttattttccatttttaactaaactttttcttgggagaaat

SEQ ID NO: 225361 - DNA, 1181 bp, Homo sapiens
ctggcggggacaggctagaggagacagcaagtcccagtccccggagcagagagaagtggggccggcccggggcgctggtggtggctgtctggacacgtccttagcgcctgggaaccaggacataaaagcgcctccggagccgccctgcggcggggtccctttcatcccacttaaagtgcttctgcccctagggtttccggagggagagccgagatgggatgggggagcctgggggtcccccttggcaggggtgtctctttctggtttggagggttgttgctgtaaaaataactcctttgatgagcttccttattaaacctttcagacccagtctgttggagccatgaaggaagagggaaagagggctgccattcctgacagcctcccagccagggctggcgataaaggaccgagatagatggagggggcgagtagggaagtcctcttctaaaatgagagatagggatttggtggggtatggaaggaactaaccccttccctctccacctctgattcagcccttaattcttggtctatgataaataaagttcagtagtctcacattccccatctattaccctaggtgtgttttcaaggcagccagcggtagaatccatgtagttcccaccagttgccttcccctcagggatggaaggaagagggtttcttgggctggttgagggcagattgggggtgtctcatcagagggacctccactggttcccactcagagtggaggcctgcagcctacctgaccatctctttagctgtcaccaagaaaataaaccccactgtctctctagcttggcccttgtctttcccttgcccctgccatagcatgttcattaggggattccttcctccccctcatctcacaggggaagggagaggaaagagttgttctcccactggaaggggttctgccttctgaggtgacatccaggaagctgtccccattcccttctcctttagatgctagaaacacattttgattctgatcatggggtgggggagagaggaaaggagggaggggagaagcccagcagaagctgagccaggcagaggggaaagaagctgatatgaggaagggtctgacaggccacagcccttgcagccggagggctttcccacactcaagagaggggccttacagtccctctgacacccctcccccttcccct

SEQ ID NO: 225362 - DNA, 322 bp, Homo sapiens
  misc_feature (2)..(2): n is a, c, g, or t
  misc_feature (52)..(52): n is a, c, g, or t
  misc_feature (102)..(105): n is a, c, g, or t
  misc_feature (110)..(110): n is a, c, g, or t
tnccggggagcgcggattcgcattcccaattttaggtggcagtcgcaacccntactattcggacagatggcacagaaaccgctgcgcctgtgagtgacctcnnnntggangcctctctccctgtggctctttcgtgtgtcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaaggtatagaaatatttttatt

SEQ ID NO: 225363 - DNA, 654 bp, Homo sapiens
  misc_feature (2)..(2): n is a, c, g, or t
  misc_feature (52)..(52): n is a, c, g, or t
  misc_feature (312)..(312): n is a, c, g, or t
  misc_feature (327)..(327): n is a, c, g, or t
  misc_feature (334)..(334): n is a, c, g, or t
  misc_feature (341)..(342): n is a, c, g, or t
  misc_feature (349)..(349): n is a, c, g, or t
  misc_feature (372)..(372): n is a, c, g, or t
  misc_feature (433)..(433): n is a, c, g, or t
  misc_feature (449)..(449): n is a, c, g, or t
  misc_feature (451)..(451): n is a, c, g, or t
  misc_feature (474)..(475): n is a, c, g, or t
  misc_feature (477)..(477): n is a, c, g, or t
  misc_feature (494)..(494): n is a, c, g, or t
  misc_feature (497)..(497): n is a, c, g, or t
  misc_feature (503)..(503): n is a, c, g, or t
  misc_feature (509)..(509): n is a, c, g, or t
  misc_feature (512)..(513): n is a, c, g, or t
  misc_feature (516)..(517): n is a, c, g, or t
  misc_feature (541)..(541): n is a, c, g, or t
  misc_feature (549)..(551): n is a, c, g, or t
  misc_feature (574)..(574): n is a, c, g, or t
  misc_feature (652)..(652): n is a, c, g, or t
tnccggggagcgcggattcgcattcccaattttaggtggcagtcgcaacccntactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccanggatgctgaatggantgtgaantatatgnntgaaaanatttactttattcttgggttcgntaaaggtatcttcactggtaagctcgggggctggcagattgttgtacctcaagtgggacangaattccttttattgngnatgtaaaggtttttgtttttgtnnanggttgtgttttttttgngantgatgntgtgtnaannatnnagttttagggtgttgtttttttgntttaattnnnaatggaaaaaagtgtgtgggganaatttgggaattattatggagaagtggataaaaaaaaatgtggttatgatttggtttaaagtattgaaaagggattgnaa

SEQ ID NO: 225364 - DNA, 497 bp, Homo sapiens
taataaaaacaggattccagcatgttgcccagggtggtctcaaattcctgggcccaagcagtcctcccaccttggcctccctaagtgctgggattacaggtgtgagccaatgcacctggcctaaaaatggcaatgtatttttgaaagtgtttacaacgtgctaaactgtttaaattcatgttaactgtcaataacaaccactatggggtatgtattattaaaatatctatctgactaatgggaaaaatgaaatgtagataggctaagtatcttatccaagatcacaaagcaggtgagtaacaaagccaacatgcaaatccaggtccagcctgacaaccactacaatggagtgcttatcaaaaactgttgctaaactggctgggcgaggtggttcatgcctgtaatcccagcactttgggaggccgaggcaggcagatcacctgaggtcaggagttcaagaccagcctggccaacatggtgaaacccccatctctact

SEQ ID NO: 225365 - DNA, 371 bp, Homo sapiens
ttgaaaaagaacaaagctggagacatcatagttattgttttcaaagatattgcaaagctatagtaattaaaacagtatggctgggtgcagtggctcatgcctataatcctagcactttgggaggctgaggtgggaggataaccttaggtcgggagttcgagaccagtctgaccaacatggagaaatcctgtctctactaaaaatacaaaacccaggcatggtggcacatgcctgtactcccagctactcaagaggctgaggcagaaaaatcactcgaacccaggaggcagaggttgtagtgagccaagatcgtgccattgcactccagcctgggtaacaagagtgaaactccatctcaaaaaacaaacaaa

SEQ ID NO: 225366 - DNA, 697 bp, Homo sapiens
gagactcttgaaacttttacaggaatccttgggcaccagagcaattacttccagtgcttttaaaagttttggagcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaagttttggagctagttagaaagccccaaatttctcttttaatggtaatcatgaaccatccatataaagacactgagagaatggaaatactgatataaatgttcatagtcctttatctataattgtgaatttgcaaaaagatctggaggggaaaatctactgttttatttataagaaaatttacgtaaatgtatacgtagttcacacagcaaaacctgacttgaactaaactcttggtggaagtacagagctcaacttccatgatactgtttatagactttatatttcctatatgtgactattcttatatttcactacagagatgctgatgc

SEQ ID NO: 225367 - DNA, 640 bp, Homo sapiens
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaactt

SEQ ID NO: 225368 - DNA, 539 bp, Homo sapiens
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacacagagtctcactcccatcgcccagacttgagtgtagtgatgtgatcactgctcactgc

SEQ ID NO: 225369 - DNA, 839 bp, Homo sapiens
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggtaatattttcatgtttcaacctcactggtataactgaataagtaaatgtgacttactgatatttattaacctcttaagtatacccaataggccaaaaaagtactggtcatcagtagtttttatgcatatatctttttctatctctgagatcattccttttagaaggacaactctgacagtatagcatgtgcttctgcctttcagtgtgatttgtgtgacttctgtctcctgtctctgctttgagatcatatgtgcctaaattccctggtaatagctaggtattcctagtgaactcaggtatgaacaacacaactgaagaacatcttggtgcagcagcatttgtttttgcaggagtattcaagattggcaagcagctgttgagtatcattttacaacctgaatgtcccactcatataacgtataatgtgtgtggcaacagggtgagactctgtctcaaaaaaaaaaatgcctttctgttcttggagagaatattatttttaagaggctgcagtgcttttgaaattaactttataggaagaatggttttaaattccgttttttaaagttactgaatttcttatcttccaagctaaggtatgttaagttacctgaaatatttggcaggtgtaa

SEQ ID NO: 225370 - DNA, 1266 bp, Homo sapiens
agaaaagtgcccctgcctcggcgctttcggttttggctgggatcatccgcggcggccgggctcgtggggcgcctggagtgagggttctggttcccgccggcgaggtgagccgcaccgctgcgcgggccgacgacggggccgggcgcagccccaggttcggtgccccagtgttcagtcgcgctgtggagcggcggctgcagcggccctaggccgggcgaggcagccccggaaagggcctgcggtgaacaggctggggctccgggaagggaccgctgggtggcgggtccccgcgaaatgccgcgtccaagctctccgcgcatggaatggctgggagaggtctgatggtgggcgccgggaccgccctcagcgaggcgcctagactgcgcggagaggagcggcaccgtcccggctcctaccgagttggcgtccgagatcaattcaggttgttgaagttccccagggagccccgacgctaatcccaagattcggcgggaaagcggatcccgaacccaggcctaggcttcgcctgtcttccaggagggcttcagggaattgcgaaccctctcctacatcggggtggctgcgcctgaccacaggaattaaaggctggactcgcctgtcttaccaagttgtcaggtcgaggaacccgattgtatggtcttaagtcctatcgcccaaggttttctgtgcgtatgcgtgtccgcacacctgcatagcaggcatttttaaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaactt

SEQ ID NO: 225371 - DNA, 778 bp, Homo sapiens
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggaggaaaaaaaataaataatgggctcgttggcctcat

SEQ ID NO: 225372 - DNA, 639 bp, Homo sapiens
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacaatccttgcgtgaatatgttctacaaaggcatccagtttcagtctgaagctacaaaaaggggccacaggatcagaagttcagccactgattgagtcacctaaataaaaaacagaattggaaagccaagagtgccacttgcacataaggagtgggaattc

SEQ ID NO: 225373 - DNA, 319 bp, Homo sapiens
gcggccgcctactactactactgctcgaattcaagcttctaacgatgtacggatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggaggaa

SEQ ID NO: 225374 - DNA, 619 bp, Homo sapiens
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatggtaacatttcttcgccctacagtacagcattcaaaataagcctttctatttataatccagatcaccaaagaggtttctagataatttaaaagtccacttttaggcttgattattttaaaatgcttatatgtcagatcttcagtttgaccagttattttgtagatgcttcatggaattttgaaaccaaaattctctccttcccttcctttagtgatgaggaactgagggacattgttctccttacctggaaccctgctttctcgaatatagtgtagtatatctccccaacacatattc

SEQ ID NO: 225375 - DNA, 747 bp, Homo sapiens
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggaggaa

SEQ ID NO: 225376 - DNA, 619 bp, Homo sapiens
caaaaaaaaaaaagaaagaaagcaaagcactgagacattggtgtagaaatggaggtgatgcctacccccaccatggaatcacgcttcaatttaaaagttgttaaacatgttgacacagttttttttttgtttttgatataatcctgattttccttggtgaataaaagagaggtattagaaacagtttatcaaattcttaaaaagattttcttgaatattggctttgtacaaaagtctgtgctattttctgtgaggtatctgaaactcaataaaacaaaggtcctgccttctgaaagcactcactctaataggagctaaccccacacacacacacacatgtcaaaagccataacttttattctctactccttattcttctcaggtctgatcattttgtataaagcaaattggctgcttctccaaaattgagttttataagtggggaagtccagagttctgccaactgtagttttagaagcctcagatttatgcaaatgagtatgattttatattttttattttaaatcagatttcagtaactccctgccagcttatttttgctttttgaagaaccttatgggaggaaagccacaattctctatagttcctctttagctga

SEQ ID NO: 225377 - DNA, 453 bp, Homo sapiens
atgtaagtgtgtgtgcgctggagcgggtgtacacaggcatgttcactgcacctgtatacaggtgcaggcgtttcaggggggcattagctacacagcatttctcaaccttttggaagctggggtaatttggctctgaaacctgttccctgggtcgtgccctcttgcggatccaggagagcagggacatttgcctgtgcgttcactgccgtattcttggtgtctggagcagtgcctgacctgtggcgggtgcttagtgagttatccgtgcaatgaatgaatgaatcaatgaatgaatgaatgaatgaatgaacgaaccagccggaaccttgctggccgttgactgaaaatgtctggattcaattgactgaatcaaacagacttagagcttgagagggaaaaattatttcacttagaaaataaaagttatctctgcaggactagacatgaaaggaa

SEQ ID NO: 225378 - DNA, 341 bp, Homo sapiens
ctttcctcctttcctcccctacagcttctccacctttcctcctcccccacagcccccagctccaccatggatcagcagtcacttatgcccagtggttacagtctggaaattatagacacgggccccttggaacagtgtcttcaaatctgcagagagaagggtgaccgtgcggaggtcaaatggataggattggggagatgaagaaggaggaaataaaggaagatgactactcacttatgtggttctgggagaatagtgctattctctgagcttaggacagaatttatcagttaaggtgctttcagcagcaaataacaggaatttcaatgaaaattatataa

SEQ ID NO: 225379 - DNA, 1183 bp, Homo sapiens
gaagaaggtagctatgccctttttacaaaactataatttgcaataaatcaaatagccttatttaaaaatctggaaataagttatattttaattaaaaggggcatttaaaaaatctgtaatcagaaatgttgattagcagaaagagaaggagtatgacatagtgaataattttttaaatagtaataaagttcaaattattgccaatagatggaaaattatgaacagactatgccagtatcagaaaaatataacctcagcttcatttactggaaataaaccagtctattttagtagattctttgttgctagccacaggaacttttgtaaagcttaatattttattctccttcttattccataaagctctttaatttttgatacgtgaaatgtgatcctgcaatccagggactttgcttttaactctcctattaatcacctctgatatcaaatacattcttctagttaagagagagagaacatttacactccaaaagctctcagaaactcagcaactttttttttaatagcatatctacttctccacttcattaatatacaggcttattcagctgcccagaactagtaatattacagtcttcagaatgactgtctaaatttagattctggcttagatcctagtgactacagggttccaggtcattcacagcctaatttgggtagaagttctactgtaataactatcctgattgtaattctaaaggtgttaacttttaagtaatggcatttcataggatatgttagggtctcgtgaataaatatctcagatgcaggatccactaattttttgtcttattcagaagctccgtgatagtaaaaagtctatattttttcttatatttgttctgcccagtaaacctttgtttggtgacttacatgtgagaaaggtgtaagtagaaaactgttgaataattctgaaacctagattctagaacaggtaaaaatgaatttgtaaatagaatgcttatttagtaagcattaaacacagatccatacctcattactaacttagacattgggcttgatctggaatttctggtaatctgctccaggtagtcagtcagaatatcagtaagtaatgagtatttattataggttctaattagtatggttttacagtttttctattgttgtaaaatatacataaaataaaatataccaattt

SEQ ID NO: 225380 - DNA, 361 bp, Homo sapiens
cttcaggaacaggtcccacgctgacccctctcgaacttgttttgctggtctcagaattatgtgtctgccctgcctcctggactgggagcttttcgaggagcagtatcatgtggggattaagagcacacactcgagccctaccacctggttgacatcccagctctgctgctgcctgactgtatgatagtgggcaagttacttagcctcttcatgcttcagtttcttcatctataaactggggataacaatagtacatactttttagggttgttgtgaggattgatttactagtttgtatgtaaagtgattaatgcctggtacatagtgactgctatataaatgttggtgatccataaaaaaa

SEQ ID NO: 225381 - DNA, 262 bp, Homo sapiens
gtacatttttattaattaattctagtgatagcattttgttggataagtaatttgggtaataccaatatgtttctttctgcgtgttttccttacaaaaatcttcttgtcatgaaacattatgatgtgagtataatttacaggttgaaaacagcctaacccatacccaaataaaaatgttagaaacatcttgctttaaaggtgggccagaaatctggctgtagtagaatatctggccagcacacacagatgtctaaggggagtt

SEQ ID NO: 225382 - DNA, 498 bp, Homo sapiens
ctaacgttagctcttttttctccataatttctaatcattatttacatttcaaagtagaacaaagtaaaagaaaattccttagtatataatgtaagaaattaaaagaaaatttcgaattcttaagtgagtaagaaagcttagtgttttggttattggaataagatacagaaaacctgaattaaaaagctaaaaagtgactgggcgcagtggctcacgcctgtaatcccagcactttgggaagccaaggtgggcggattacttgatgtcaggagtttgagaccagcctggccaacatgatgaaatactgtctctaattaaaaaaaaaaaaaaaagaaaaaaaagaaaaaaaattagctgggcatggtggcacacactgtaatcccagctactagagaggctgaggcaggagaatcacttgaaaccaggaggtagagggcagtgagctaagatcacatccactgaactccagcctgggcaacaagagtgaaactccatctc

SEQ ID NO: 225383 - DNA, 452 bp, Homo sapiens
gaaaggagggaaatttttctaagcagttaagttttcttcttaaatatcctccttcaccatttggcttttcagacaggaaaacaaatgttttcagacaagaaaacaaattttcttggagccagctagcctctgctgaaaaccagaagccagggcctatttgcaagacttgtaatatgcaactttgcaaataagcactcaaaatttaccatctcacctatcagtgagtcccagacccccaaagcaactggctttcttactgacatcattgtctcatgtaaataagcactctctgcataggctcttttgggtaacatttgcaaagtccagctcaaatctgtactgtgatggttaaatatttgctatatttatatatctttgtagaaaacaaagtcactttctggtgaaccaatgaggaaaaaaaagtactgtagccaatatctttaaaaataaga

SEQ ID NO: 225384 - DNA, 341 bp, Homo sapiens
ttaagggaaattgacctgtaaacaaatggttgaaatgtggtctaaagaagctagtagtggctgggcgccgtggctcatgcctgtaatcccaacactttgggaagccgaggcgggcggatcacctgaggtcaggagttcgagaccagcctggctaacatggtgaaaccccatctctactgaaaatagaaaaattagctgggcatggtggcacaggcctgtaatcccagctactcgggaggctgaggcaggagaattgcttgaacctatgaggcagaggttgcagtgagccgagatcaagccagtgcactccagcctgagtaacagagtgagactctgtctca

SEQ ID NO: 225385 - DNA, 417 bp, Homo sapiens
tctctcattcgtatttttccatcaccttttttgtgtttcccaaaacatctgtcttctcctgggcccttccaatcgcaccttcacctctgtgttggttctcctggctgctgccatcctttcttctgccaacttgactttgtctcctgctgtctcacttggttgtacaggttgagcatccctaattccaaaatccagaatcctccaaactccagaactttttgagcatggacatgatgccacaagtggaaaattccatacttgacctcatgtgatgggttgaacaaaattattaaaaatactgtataaaattaccttcaggttatatgtataaggtgtatgtgaaacatacatgaatttcatgtttaagcttgtatcccaagttatctcattatgtatatgtaaatattccaaaatctg

SEQ ID NO: 225386 - DNA, 321 bp, Homo sapiens
tccagtgttcaagcgattctcctgcttcagcctccaagtagctgggactacaggtgccagccaccacacctggctaaatttttttttggatttttagtagagatggggtttcaccatgttggacaagctggtttcaaactcctgacctcaggtgatccacgtgcctcagcctcccaaagtgctgggattacagacacgagccaccgtgccaggacaaaacaaacttttaaaaaacatagtaatcatgaagtgtgagtgggatgtgaggatgaaacaatggcaggatgctgctagctgtggacgccgggaaacaggcacagg

SEQ ID NO: 225387 - DNA, 563 bp, Homo sapiens
gttttcatgtatgtaacattcagtgtaggtatttaagacagctgaaataaaaataccttctgacattttcaaatactagaattctgttttgttttattaaagcattaccacttgtttttaagcattcctgttagaggctaagagctaaagagttatttacagtattcaaattgaattttccttatcttttaaaatgctcatcttaaaatatgatctttattgttttggccatacaattgtggaactacatctctgacagtggaaaatgtatagttctttcagaagtttgtggtaaaatgactttaaagatttgatagaaagtaaggcatatctgaattgcatggtcggaagtacctgaaaaaagtaaaattgatatatcatttgaaaatgaaatgcatatccctggataagcagagcaccagattttttttttcttggcatccctgattttaattaaataggagtcagcaaccgtttcaagagcaggacccaagctctgaccctttgcactcttcacctgcaaggatggctgaagtagtggcaggaaagctctctgggatgta

SEQ ID NO: 225388 - DNA, 225 bp, Homo sapiens
taaattgtaggtggcctgaagtggatgtcttctgaggatcacaacttgtattaaacgggcatagcctgacctttgttacacacaacatggtccatttccatatttacaaaatgtgtttttaggaaacatagtataataaaatatgaaatgaggcaaaagggtaggaatttggctttcattttgcttttggtagggagcttttgtctcaatcttggaacaaactga

SEQ ID NO: 225389 - DNA, 488 bp, Homo sapiens
gcctaaagtacacaacactcaattcttcattactcacatgtggcctgaccgctggtggactggctccaggaaaatctgaaccctgggctgagcctccccgccggctggccaggacagacctggatgccctccaccctccagccaaacttatttttttcatatcatagctgcagaatattcggaccctctagtcccagccgcccagtgaacttgagctgtgtgaccttgagcaaaaggcaaaatgtttctgattttcagtcccctcatctggaaaaggaggaggctgtgggacatgatgatctttgaaagtctaataatgaaacaaacagaaaacctgtgcttctaagttggtgagtctggaaaggtacgtctgttgcttaggaaaaaaagtcccaaatcccaaagagccccttttggcaagtgttgtacttaagacaatccgggcgctgcccctcctgaggcgggggggactcgaggaccggctttag

SEQ ID NO: 225390 - DNA, 400 bp, Homo sapiens
gcagagcctgagcaatatccatttaatattttaagagaagaggcatgccccattttaataactgaatgtacttgtagcaaaaaaagtggatttatattgaaacacacattttcgatgaaaacacaagccaattctttaaaaaactgcccagatatagagaccatgtaggctaaatttgtagattccatattttttatgttaaaaaaggaaactctttaaaatattccaattatattcattagtgattagatgaatgattgtagttaaatagtgatgagctttgtcaaattgaaggaaagaaggcttgtggtaatttgcaaacttcatgcttgaatggctcagcacaatcgacattttaattagtaacttggatgaaactataaaaagtaggtttgtcaaa

SEQ ID NO: 225391 - DNA, 439 bp, Homo sapiens
agcctcaaaaaaaaaaaaaaaaaaaaaaaagatgaaccagttttgaagtaactgaagaatttaagtatatttggccctatcccttccttgaagaaaccattttttaattgtttttaattatttgcatagctttaaataatatactcatgctgatatttgagctataactttagattttatctttcgacttcctgctacatacataggcctttagctcaccactaccacccttccccagaccttctcaatttcttatacttaaaatattttgttctttataaatgtaaacgatatttatttaaacctgtatttcttgttccatcaattctcatgaagtaattttataagatactttctcaaccttcccatcactccctccacctcctaatttgccagcttttctattttgtcaagattaacttttatattctggtctgta

SEQ ID NO: 225392 - DNA, 404 bp, Homo sapiens
ggagaagagagcaagaaaaggaatctgtgttaaatcccgacagcctgcaggagaagcaaatgcccttcattttcttcatcagcagcgagactggcatccctgtagctttgagaaaccatgctagtgtagatgccagctccctccagcgggcctgactgggagaacttgggctggggttctggtctggggctcctaggcctgatgggaagagagttcagcccagctttcctgtacttcagctcgtatgcagacgatggccattgttgaaatgagagactcaaaggaagctggaacctgaacttttttgttgtctcgtggacacctgtgttcagtttcgggttctacctcttgctgtctgtgtgttcttaggtgactcacttaaacctttctgagtctcattgtct

SEQ ID NO: 225393 - DNA, 534 bp, Homo sapiens
actgggttgatttcaatactatacaggcaagaagataaagcacagctatatgttaaaacgtggatcaatcttaaaagcataatgttgaatgaaagaaaccaaacacaagagaatacatactgtacgactctatgatgttaataaaaacaggcaaaactaaactacacaaataggaagtcatgcttaagtggtaaaatgttaaagaaaagtaaggaagtggtgaccataaaagtcaatgtttggatcctgaatcaaacaatctaactattaaaagatatattttggtcgggtgtggcggctcacacctgtaatcccagcaccttgtgaggccaagatggaaggatcacttgaggctggaagttagagaccagactgggcaacagagcaaaactctatctctacaaaaaaaattcaaattaggtgcacttggtttctcaagtcacccacttagccctcttccaagttgtactttccttcttttctttcctttccttactgttctaaagcttttaaataaactttcactcctgcttt

SEQ ID NO: 225394 - DNA, 500 bp, Homo sapiens
ctgcctctcgttcctctgcttacgacattttcatgaataagccagaagatagtcagcacagaagcctccctacaacctggaaaaagaaatgagctttcactttgaatatcacacagacatactgaggtgggaaactacatgtgcgtgcttgacacaacttgaaaacaatacaaaacaacaaatcacaattgcaaaatcatacaacacaaatggaatcacagtccataagggaggccatgaaagagagagtgcatgtggtggacatattaagctgatatgcagacctgggatggtgtcagacaagtgctgaaggcactgtttgtttcctgccccaatgctgagctcagacaacaaccgaatccagagcctgccatttatcacttgaccacgtacatctgaacctgcaagaccctcgcacagccttcactgaggtgtgaaaactgacagtttccttctcctgccactggttctgcagtaattaaagcttttttgctatcgca

SEQ ID NO: 225395 - DNA, 339 bp, Homo sapiens
ctgcctctcgttcctctgcttacgacattttcatgaataagccagaagatagtcagcacagaagcctccctacaacctggaaaaagaaatgagctttcactttgaatatcacacagacatactgagggatggtgtcagacaagtgctgaaggcactgtttgtttcctgccccaatgctgagctcagacaacaaccgaatccagagcctgccatttatcacttgaccacgtacatctgaacctgcaagaccctcgcacagccttcactgaggtgtgaaaactgacagtttccttctcctgccactggttctgcagtaattaaagcttttttgctatcgca

SEQ ID NO: 225396 - DNA, 363 bp, Homo sapiens
tccaaacacagctgtggtgatagaaaaggattacttactgaaatgttttagttagttgtgtgagaattgagagttgtggggactggtttcgtgatgatatgtgtatatctcctatatggcataatttccttagtgggatctggggcagccccatgatcaaatatatgtaagcagaatctatgaatcatctaagttggataaagactataaatagtctctcgttagtttaggagaggtcaagttttattgtcaaactgagaaaaaagtttgggcttttagagctttttggatttcagagttgtggacaaaagattatagacctgtgttccagaaaaaaatcttattggctattcattcacgaca

SEQ ID NO: 225397 - DNA, 228 bp, Homo sapiens
ctgcccgcctcccaaagtgctggggttacaggcatgagccactgtgtccaacctaatttaaactttatctttgtaagtgccagggtaatagaggctacccagtttgccattgtgctcacccaaagatgaaagtgctaaggttgagtggaagaattcccaattattaagcccctcctctccctgtgttgaaaattctccatgaaaacccatctctggaggtgtatcaat

SEQ ID NO: 225398 - DNA, 575 bp, Homo sapiens
atagtaatacaactttttaataaagcaaagctgttatctgtcagagttcacggtttgtgtgtacttgcataccctgtagtctagtacattttatatggctatgctttatagagctttagaaagtgaggtcaagctaaatttcttgactttaagggtggcctgaatagttcaccataatctcattattgaaacatgattatccatcttaatatttaagcatgttgccttcatccatccatcccctattttaagtgttcttttgtttttcgtatgttagtttcccagagtcaaaatagatttttaactttttctgatgtttcaaaagttttaaaagaaatctgtatggtgtatttgaaggcatgaaaatgaaattaacattttgttttatactttctcccccttttctctacatttaagatacacgaacatatatctaatatatcagagacatcttccacattgatagaaatgtgtacccatcatgtcaaatgatgggttattatcatttgattgtgcataaatggaagtgctcctctatcaatagatatttaggctttttggaataactttatttt

SEQ ID NO: 225399 - DNA, 438 bp, Homo sapiens
cagttagtggttgtttacaaaactaaacatactttttactgtatgatccttcagttctgctccttggtgttttactcaaatatgttgaaaacttatgtccacacaaaaacctgtacatgaatgtttatagcaacatcagagaataccattggtgtctgggtccctggtcccggttttccctaaaacctatctgctgttagggcctgcaaaacaacagagtatccctaaaattaacttttctttttcctttagctggaatatcccttcaggtacagcttctgtttcttgaaactaaaagattctcaagttcctctcacttcctcactgagaatctcacctaacacccatgtaattatatatgtagtcatctgtcatttatagatgggatcactttaagaaagcttgatgtattaaaatacaagcgtccaaacctgaaaa

SEQ ID NO: 225400 - DNA, 344 bp, Homo sapiens
ctagagtgcatatgcaaataacatgatttatgatgaacacctgctttccttctgagggtatggaactttggtaacgtggctggttgcacaggcagagaatacttgaatgaccagcatcaaaaaccccggattctgagtcttaaatggtcttacctgggtagaaacactgcatatgtgtccctgcatttaactgcttcagtgtgttatgtgagataaccactgctccacccagaggaaaaactttggaagcctgtgctggacttgtccagactctgcctgacgtgtttttcccttgttgatcctgtgtgttcttttgttgtaataaacaagagccatgattacaa

SEQ ID NO: 225401 - DNA, 399 bp, Homo sapiens
tgtgacacagactagcagaagttttttagggatttctgagaacataggtgctttcttgatacaaagcattgcccctttctagaatacaaagctgaagatgaaatgagcatcttatggatgaaaccaacaaagtaaagatggcagtttataaatatacaagttgcctaggccactgattatattgcagattcactgtaccagccctggacttttattcctgaacactttgtgataaaaaatcacaagcattcctgtgcaccagtaacagagagccaaatcacgagtgaactcccattcacaattactacaaagagaataaaatacctaggaatataacttacaagggatgtgaaagacctcttcaagaactacaaaccactgctcaagaaaataagagag

SEQ ID NO: 225402 - DNA, 356 bp, Homo sapiens
gagcaccccaaacaacttttgttaatgtgggaactatatatcaatgtctactgtgttagaaaataagactaaaaactgggtgtggtggctcactcctgtaatcccaatgctttgggaggccgaggtgggtggatcacttgaggtcaggagtttgagaccatcctggccaacatggtgaaaccctactaaaaatacaaaaaccagccagacatggtggcaggcgcctgtgatcccagctacttgggaggctgaggcaggagaatcgcttgaacccaggaggtgggggttgtagtgagctgagatcacgccactgtgctccagactaggcaacagagcgagactccaaatcaaaaaaa

SEQ ID NO: 225403 - DNA, 555 bp, Homo sapiens
ctagaggatccccgttcatgatgattgctgggtgtgagccagagctgttgtatcattgtgcaatcatgtgggatccgaggataaagccagcaccatggaaggagggattggaatgagaggaagaagccagatcaggtgacaccaaaaaaaaccctggattaagatgtgcctgaagcctgggagatatattctcctaggacgttcagttacatccgcgaaaaaacctcctgtttacttcagccagcttcagtggggtttctgtcactcgcaacagaagcgttctgactgaaaagaagactgtcacgtcaggatggagacttgtgttggcctgagaggtgacatagccccttaccaggaggctggaagaagacacatgttcagaaagccgggcaagttcccaatgtctcccgagggttttccaaataactctgttacatcctatgaggaggaaccatgactacctcccagaattgctgttacacgccattagtgacatcaagaagacactactaacccactggttagacttgttttaacctaatggggatgtgctta

SEQ ID NO: 225404 - DNA, 489 bp, Homo sapiens
agcagaggaaacgattgttattctgacagtagaaagatcatagaacattagagatcattgagttagagtcatttattagaaaacaaggaaaacaagaggctccatgttattcaggtagatgatagcagagctgagatttggaaggcaggtattctctcagtgtctgccttttttaaaaatgatataatgctgtcttcttccttcaccttttcttttaaaatttcttgtgggaagacatttgcaaaaaaaaccagacctagtgtataggcaaatatcacatttatttactccaggtcttcaagtatctggaattgaatattgagcctaattcctgaatgtattttgatctcttataggacttgaatcttttagaatgatttacacctcagtgggactgtggaactcctatattgtaatatctagggacaattgcaatatctggggtgatagtataaaggaataaataatatagagagatgataaagacca

SEQ ID NO: 225405 - DNA, 549 bp, Homo sapiens
gagctgctctccagctataaatggctctgtagctgctggcatttgcaccacaacagaaggaagaatgcaggctgggatttgcagtaataatctgaatccagtgacgtggcaggcctccacctaaaatacgtccactgatgcaggattttgctgcaattcttgcacaaacatgttgatgacattgattcctaatggacagaaggcatcttagggactgagaggcacttcttgcctagttccaatttcctctcagacagctggtcccagggaatggccacccagaccagggaagctacctagagctggaattctttgggaaatgttgtgagcccaggtcttagcccctgaatctgaatggttcctcatcatgaggtgtaagaagtggcttcacctagtttcatctacatgcctacaatctcttaggaccagatgtgtcacggaattttgacttgttcaggtgttagaaaggtaacaagatgcatatacatgtgttatgctgttatgcaacagcttgagtgtggtataaagtggactcctatagtcaattgc

SEQ ID NO: 225406 - DNA, 284 bp, Homo sapiens
atttcaagttcacaccatgaaatcatggaggggatgaaatggaattgcccagtttgttgagagaacatgccgacacttcaagggataaaacagacgtgtcaagactctgcaggcgtgaaatctgcatatgcgttggtaaactagcaacctgctccttctccaattatgtggttctgtgacattagtaaacacagaaaaggaccttagctcatcccagggaagagagactgtgctggatatgagaaggatgcagtctgggctacaattatctggtgtagccatac

SEQ ID NO: 225407 - DNA, 528 bp, Homo sapiens
gtattattctctgtgtatgagataaatgttaaatgaggcaaaagacctgtctctcaaatatatttgatagtgaacatttcagagtaaagagggaaaaagctaacatgatgagaataaaaggagttccatgcttgagttgaaatgccctccccacccatttctactgttcctgaatcactggacatttctagattaaataatttaaaatttgttccagatttagttttaaaagcattattataaatttaattttaaaaagtaattatataaaaccttcttttatcacttatgtatagtacctactttttctctctatgcaactacgtttatgtacttatttctgaatctctttgaatttatggagagatcctccattaatgtatacataaaaggctggctattcactgaaacattaagaaaaatgaagcagtatatgttcaccagtcagttgtatgaaaacatataattaataattttttgaatggagacttcttttttttgtgagaaataaattctttattaattaac

SEQ ID NO: 225408 - DNA, 685 bp, Homo sapiens
gcatgaacaatattctctaaggtttcttccagctttttcatgggttctaacagccaattaaatgtccactgtaagtagcatgctcctgacaaccatacacggatacttaactaacatgtaggaaagtgctattcttattgacagtgctatcacagttattcaaaattatcattagtaaaattatacttatttaggtcatgttattcttaaacattaatatatttagtaatatacattaatatattttctatgactatttaataatatacttagaagttaagttactgaatgttcaacagctgccttgtacacattgtctaaatcaatcttcactatactcataaaagacagatactattactttgagaaaacaggcttagagagttaaataacttgactatgataaactaaaaattatagtcctggattcaacctagacattgtggcaatcaattgagtcacaatcgatgtgcaacctttatatattttacagtattctatatcttaaaatatatcagcctatcttttggcttaatagtgtctttgcaataaaaaaagaaattaaactgaagtatgacatcactactgtggccaccaggtggcagcagcacaataatgaaatagtcacataagaaatattgctattttagaaatcaaaatggtctaagatagagattcctgttta

SEQ ID NO: 225409 - DNA, 2122 bp, Homo sapiens
  misc_feature (1406)..(1406): n is a, c, g, or t
  misc_feature (1991)..(1991): n is a, c, g, or t
tggcttatctataatttcggaatttttcttttacaattaacatgaaccatttctgaaacaagaaaaaaaatataaaagaagaaactaagaaggaaataacctgttttaattgagacacagagggcaaataccacatttaatggtaaaaacagaacggaaaggtatttttcattggtgagagaaatattggtttgtcttcttgtctgtttttttctcatcctctctcacagataggaatgtggaagatgaggagagagggaaggaagaaaacaaggaaaggaaggtaacagcagaattgttacatgatgtggacagccgccaaactcaatagttctgagataaataactgtgcaaggtttagaggcaatacccaatgtttgaacctcagagttacacaatccacccaatacagggataagctatgtggcagagaatctcatctgagaaagataaaggatatgtctcaggaacgcttaatcaacaggtttgtccttcacatttatttatcacctacttggtgccaagcatttacaatatcctagggagacaaacagaaaatgttatctttttttacatggcattggattcacatggcatgtcattttcatattgcgtagagtggtgagtgattaggcctgtcaaagagaatcaggttcaggttctgcctccgatgccaactatgtggaggatgctacaccaagcactgaagctcagaaggagaacagttttggcagggcaagaaataagctatgttctacctgttatgtttgtggtaagtgaggaagattcaaacagagatgtctttttggtagctggatataggcatttggagtttggagagaggatagcaatttggggatcctcaatgcagcatgtagagaggaggagatggcccctggacagcatacagaaaagaatgggccaaagtttcacggggtgggcagaagaagctgccccgggaatgaagacgaagaaggaatatgcagagattggggtaaaaccaagacagaatgcttgtgaaatgtgcccaggaatgatcctctccactacttaaaatttgcttaaaatgagctgtttcagtacatccctgtgcagctgtgagcagctgtcctggttaataacatattcccatgtcccaaaggacacaaaccttggaagatgtgtttcccaataacttttcaaccttttactgagcagaacacatgaattttgcccttcctcatttggaaccatgtggaaaggggaaccacgaatggggatctgcttttggtttggattggggcttgctatggtttggataatgggattttttgtccccatcaaatctcatgttgaaatttgctccccactgtggtggtgtcagaaggtggggcctaggggaaggtgtttgagttataggcgtaganccctcatgaatgacttcgtgctgggctgctgttctcactctggcgagatgggattaggttggtttattattatgtaaagccaggatgccctttgggtatggtgtctcttcacacgtactcacttctcctttgaccttctctgacatgttgatgccggtgccatgcttcttgtacacctgcagaactgtgagctaaataaccctcttttctttataaatcctcttttctttatacccagtgtctggtactcctttacagcaacacaaaatggactaagacaggactgaaactcaagcaatggatgtggtaataggaaagagaaaggtacagtgcattcagcagagtcacagttgtaaagtaatgccaacaaaaaaaaccatctacaacgtgaaattcgtctctggaggtcagttgatgacctgaggttcactgaggataaactaaaaaccatacggcttagagtctatcacagcctctgctaaggtaagtgtgagtgacgcagctctattcccaaagacctggcccatgggaagtagtgtacaggcaccagaccccaggtcaagaggtctggctctgccactaaangctggttgagcctagaaaggcctctttacccctgagcttcagtttcctcatttacaaagcagaaatagatatgtctgccttatgtttttcacaggccttttacaaatataacatgcaggatgcagagtgct

SEQ ID NO: 225410 - DNA, 436 bp, Homo sapiens
tcacgaaggagctggaacattcacccaggcccattgccatgtgaattgtagaaggtctgtggggaagacaccatctgccactgtttggcaggatttggccaccatggcacagagtgggcaattgtcctcaaccttggaggcagaagctggcagctggccaaaagtctgctttctcccagaagagataggcagtcactgagccgagatactgatgatgtctctctcttatcgtgcaacatggagagcgggagaaaatgagggaggacagaagagaggagaaggaggaggaaaataagaaaaggaatactaattaactcagcctgtctatccagctaagcttgagcttgattttgctctctagttgaatggaacatgcaacctgaatttctgaataacagaattaccaaattactgtttaagtgtttgagaaaaaaag

SEQ ID NO: 225411 - DNA, 1041 bp, Homo sapiens
actttatggaatttttttctgaatattttccatctgaggttggttgaacccatgagtgtggaacccatgaatgtggaactcatgaatatggaggctgattgtacaggacaaaaagtcataaataaaatgaatgaataaagcctactttaaaattgatatatatttaaaatttttaaaattgtaatttgggagccataaaaaagaatacaggtagtgtctcagatttaggaaaagtcattatttttagctaagaaccatcaattctagacttgttaatcttatcttcactttaatcaatagctctggcaggccactttttggggagagccatattttttgtaaaggaagactgaaagtcagaaagagtgtgtatgtgtgcaagagacaggaacctcgagctattgggccacaagggcacatccccagtgacctgaggcccctctcctgtactcctccaccctcacctgggtgatcttgtcttagattggtgcctcagcagaatcagaacgattgattacatgtcaaggaccaccagggaaacctgcagatgggtgaaaccgcagggttcagtctgggaaagccacggctccaatctctctaattacaaaattaatgagggctggaggcaaagcctccagacggcccagggtgagccagggagcattttgatgccctaaaacagctcatgtttatttcgtggtcttacctgatcgtgtgtggattgaagtgaaggggtgaggtagaaatggagcttcccctctaagattttgcttcttgagttaaggttggggtcaggtcagaaaatgctttttcatcgctagtgttttgatagcaaaagcaaagagccagtggcagaacttttcaaatgactcttagaggagatgacccagcgtccctgaggtatccaacacactagcttgtaagaataaggatcagaacatgactcgtatgtttgtattctgcagaatctctccctctctctctctctctcacacacacacacacacacacacacacacattttaaaagctttcatgtgcc

SEQ ID NO: 225412 - DNA, 282 bp, Homo sapiens
aactcaaccaagatgatagggaattgaaggatgaatttcgggctgtgacactaaatctaactgcattacaaatgtaggacataagctcaatgacgatgatggagagaaaaatatctcacctaggttactggaaacctgtgttttaactaaaagtcataaggggccagacgtggtggctcacgcctgtaatcccagcacttaaggaagccaaggtggacagatcacctgaggtcaggagtttgagaccagcctggccaatgtggcgaaaccccatctctacta

SEQ ID NO: 225413 - DNA, 304 bp, Homo sapiens
agtgagccgagatcgcactattgcactccagcctgggagactagagcaaaactctgtctaaaaaaaaagaaaaatcacaatttcttagcaactagaaataaaaggaaatttctttcacctgataaagggcacatatcagacatatggaagaaactttatacttcatgttgaaacatcagcagcaggaacaagacaaggatgctgactcagtgctacaattcagcaccgtcatagagtcctagccaatgcagtaacacacgcccccaaatcagaagcacccccattagcagggaggacacaaggg

SEQ ID NO: 225414 - DNA, 587 bp, Homo sapiens
gatctgaagtttgccactaacactttagcataatcctggtgagcaagctcatataattttaggcagctagctaaaacatttcttactgttcatggctgtaaatttatcgtattttattgcacccctctctctcctcaactttccccattctttaactctttcttttttttctattacccttacattttatttattttacttatttttatttttattttactttaagttctgggatacatgtgctgaacgtgcaggcttgttacataggtaaacatgtgccatggtggtttgctgcacctatcaacccatcatctaggttttaagccgcacatgtattaggtatttgtcctaatgctctccctcccctttcccccaacccctgaacaggccccgctgtgtgatgttcccctccctgtgtccatgtattctcatggttcagctcccacttatgagtgagaacatgcgatgtttagctgtctctaaacaattagtttgatcctggtctttctgtagcctcctttgaattatctgaaaagttttctaagttgataggctgcccattttccttagatgctaagcatccattg

SEQ ID NO: 225415 - DNA, 375 bp, Homo sapiens
caaatggtgctgagataattggcaagccacatctaggagactatatcctcatctctcaccttatacaaaaatcaagtcatgatggatcaataacttaaatgtaagacctgaaactataaacattctagaagataacactggaaaaaccattctagatattggcttgggcaaagacttcatgaccaagaacccaaaagcaaatgcaacaaaacaaggataaataggtggaacttcactaaagaacttctgaaaagcaaaaagaacagtcagcagattaaacagacaaactacagagtgggagaaaatcttcacaatttatacatctgacaagactaatatccagaatctacaagggactcaaacaaattagcagga

SEQ ID NO: 225416 - DNA, 423 bp, Homo sapiens
ctgtggtgggaggatcacccaggtctcacctacagtgagctgtggtctgggtgacagagcaggagtccgtctcttaaaaaaaaaaaacaaaaaactgtaaaaggtttgatctgtagtgctgttttgaatatagttccattttgtatgcatgcatgtgtgtgaaaagtcattaagtctggaatgaaatatagagtatccgtgaagccattttagaattatatgtgtgtatatttatgtgcataggtatatgaatacataccttaggttccattattatcagtttttcctcttatttgtttgtatctactgtatatttctctgggaaatactcatggtctttaggtcatgttagctattgtcaaaatttagatatgaatcattgatttatatgaaaataaatgtttttgatttctctttacctgt

SEQ ID NO: 225417 - DNA, 306 bp, Homo sapiens
gaacaactgaaggctttcccacatttattacattcatagggtttctctccagtgtgagttctttcatgtgtaagatataaatgtagattatcaaaggccttcccacaaaacttacatttataaggttcatcttcactgtgcattaccatgtatcttcaaaaggtttgaacagaaatgaaggtttttccacatttcttacatggagtttctttccagtgtgaggcctttcatgtgtttgaaaggagtggcaatagctgaaggttttcacacactgcttatgtggcttctatgttcctgacactcatc

SEQ ID NO: 225418 - DNA, 433 bp, Homo sapiens
gggtttagtccacagacatacttgccctcatgcaacgtgatgaccacacgacaaggctatgcacgtgcaccctttgcacctgcgtgtgccgcagagccctccgcaggccctggactgtcacacctgcggcagctcactgcgcgccccgaaatacagtgtcaagaggaggagacaccagtgtgtagtgtgtagccatctgtgtaaaagaaaaaaatgcatgtatgtcaacgtgtgcacctgtttaccggaattttcacgaaatgatctctgggaatatccacaaggtaacactgtttgcccttggaagcagagccagggaacctgagctgtgggggaaatgggcattcgccctcatatcttctgcatcttttgaattttgaaccatgtgcaggaatgacctagtagaaagaaataaaatgcaaatgtttaagga

SEQ ID NO: 225419 - DNA, 434 bp, Homo sapiens
ttataaagtgcatttatttttgttgtcaaagtaatgttgttacccagtgtaacgtctgtgtgacctaagtaaatttcttccccaccttaactctggttatctttaggaaacgggatgtctgtggtcaaaagctccccatcatgacaccaaaccagctaagagtggtgggaaccaagatggcagctcacttgacctctgaagaacctctaacttcattataatctaatttccatgctaaatgaccctccccccagtgccaagacagctgacaatcaccatgacaacgaccagaagaaaccataaaaggacaaaaaagggggacaaaaactctggttctgagaagttatctacctaattcccagaaaagacatgaatacttttccccttgcttttaattccccaaccccttcattaaagatgctccatatctgtga

SEQ ID NO: 225420 - DNA, 432 bp, Homo sapiens
aagatagaccacatggtaggccacaaaacaagccgcaataaatttaagaaaattgaaattatatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaaggaaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaac

SEQ ID NO: 225421 - DNA, 457 bp, Homo sapiens
aaatcaaaacacgtttaatcagtcccctattgttggaatccggattttttcatgcttagaaacaatactgttataaacatttctgtaagtaaatcttcgtgcacagccttaatcatctgcattaatgcactgtgtaatgacattctggtcaacaatgaaccacatatatgatagtggttctgtaaggttataatgtatttttgctgtaccttttctatgtttagatacacaaataacactgtgtaacaactgcctagagtattcagtacagtaacatgctgtacaggtttgtagcttaggggcgatgggctataccatcaaggtttgtgtaagtacactccatgatgtccacacaatcacaaaatcacctaatgacgcatttcagaaaagatccctgtcttaagcaatgcttattaattttattaataaataaatgtattaaatttccttatatcct

SEQ ID NO: 225422 - DNA, 451 bp, Homo sapiens
ccagttgtaccagcagtgttcatctggccccaaattggccaatcattttcctgctcctggaaaattagacttggctttatattcaagtctgacctcaggaatttatggggcaaagtacacagatagatgtgtgtgaatgtccaatcagagaaagcacatctgcagaaagattaagaaattgatgtcgggtgtggtggctcaagcctgtaatcccagcactttcggaggctgaggcaggcgcatcacctgaggtcaggagttcgagaccagcctgaccaacatggtgaaaccccatctctactaaaaatacaaacattagcctccagctacgcaggaggccaaggcaggagaatcgcatgaaactgggaggcagaggttgcagtgagctgagatcgtgccactgcactccagcctggatgacagagcaagactctgtctcaaaaaaaaaaaa

SEQ ID NO: 225423 - DNA, 710 bp, Homo sapiens
ggtggaatgactttattttctgattttgttttattgcaatatgattaaggatttttaaaaaatttttgctacttcttagaatttattgatgttttctttgtaacttagtgttcagttttcataaatgttgcatggacatttgataagagttttgttttttaatttcagggtacagagtgcacccataatattgtagcttatcgactaggttaagtagcctcattatttttgtctacatgaactgcgatggtctaagaagtaaaagtctcctgttactagtatatttctgtatgtttcagcttgccttgctgtttctactttataacatacttttattttattttattttattttttttttaagacgggatctcactctgtcacccaggctggagtgcagtggtgtgattttggctcactgcaacctccatctcctgggttcaagcgattctcctgcctcagcctcctgagtagctgggattgcaggtgtaaaccaccaagcccagctaatttttttgtagttttagtagaggcagggtttcatcatgttggccagactggtctcgaactcctggcctcaagtgatctgcccatctcagcctctcaaagtgttgggattacaggtgtgagccactgcgactggccataatatacttttttttttttttttttgagatggagtctcactctgttgccaagactggaatgcag

SEQ ID NO: 225424 - DNA, 142 bp, Homo sapiens
aggctcagggtccttggcgtgggtgcatgtgggtgggagagacgcacagtggctgagcgcacacacagtcaaatctgggtgtaggagtggcctgctggacgtgccccacagcacagcatgcgtgtatacatgcatgagtatg

SEQ ID NO: 225425 - DNA, 481 bp, Homo sapiens
ttttggaaagatccctgtggtggctcagtgtagggtgggccactgtgggcaagaaggggagcagggagggtggtgagtaggctggcagctgtccaagccagtgagggcggggccggtggagaggcgagagggctcagactcaggtggtgttctgaagggagttcctgcactggacttgaatgtgagggagagaggagtttagaacactttcatactgggctggggcacctgaggaaagcccatgtggggaagcaggtttgggggtagtcagtttcactgtagataggttagacttgaaatgtccattagatatccaggtgcaggtgttggcaatgcaagtagaacccccaggaatctggctgaaaatgatatttgagagtccttaccacataagatggatttaccaccccagaagtggatgagaccgaacatctggggtaagggggcagagagagaagggtctgaagctcgagcccattga

SEQ ID NO: 225426 - DNA, 498 bp, Homo sapiens
ccttactgataacataaacagttaatacatattttttatgttacgtgtattctgtacaacaaagtaagctagacaaaagaaaatgttatttgaaaagtcataaggaagagaaaacatatttactgttcattaagtggaggtggttttcataaaggtttacatccttgttgtctacacattgaatagactgaggaggaggaggggcaggaggggttttgctatctgaggagtgacagaggcagaagaaaatctgtgtattaacgaacctgcacagttcaaacttacatttttcaagggtcactgtgtgattggaatggacaatattttaggaaaatatgaataactaatattgacttaaatagtaaaaaatttgaaattgaatatgcaatcaagcttctttagtgaagacaccaaatggtgatgacttcatagattagttctcccaaactttcaagaaattgtcctacactttattttccagagcaagaaaaaaaaaaa

SEQ ID NO: 225427 - DNA, 535 bp, Homo sapiens
actaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagaga

SEQ ID NO: 225428 - DNA, 373 bp, Homo sapiens
gtgtctccactacaggccatttggctccacacttctgcccccaatttcaaccagggcacattgacaatgtctgaatacagtttggattgacacactgggatgggagggatgctgcagacattcggggaatagaagtcagggatgccactaagcatcctacaatgcacaggagaatctcccaaaactaagaattatccagtataaaatattaatagtgacagcagtgagaaagtctgctataagataaatcgaattttctctcctgtgaattcctacttcatacttttttctgaaatgtcttttttatatcaatttgaaagatttaaatgttttaaccacaattttctctcattatgttttttggatttcttgg

SEQ ID NO: 225429 - DNA, 484 bp, Homo sapiens
aagcaaagtatttttgctcagtcttggggaggaaaaagtaaagatagcatgtccctcaatgagtttataattgatagggacacaaggagctctcactatcaggcaggggttatctaagacagtgaataatgcccagagaagggttataggaattggaggaggatgagaatctctggagaaatcacagcctttggaaaaggccacaaagaggggcagaacccgggggcacccggtggagaactgagcaggtgtggtgtttagaatttaggtaacgggagagtatggtgatgggcagtcttggaaatggactttctgggaagcatttgggtggagatcttggactagactggtgactatggtgtagtgggttgatggtgaccctccaaaatggtacatacatgtcccaactctcagaacctgtaaatgtgaccttattcagaaaaaggtcaatttgcagacagatgtgattaagttaaggatgtcc

SEQ ID NO: 225430 - DNA, 460 bp, Homo sapiens
gtgtgaaccatactcaagggagaaaaaaagaagtcaatggaaataaactctgagaggccctataaattagatttagcagacagccactgtattaaagaaccaacagagaatatgacaatgactcaatatatagagaatatccataaagaaatcaaatctgtttaaaagcaccagataaaaatttttatatttaataccatatgttaagattatttactatattttgctctccacatgagctcactttctggataattgcaaagttaagtaattgcctggaaaaggtaaacatttttaaagttcttaaaaggaggcttaacttacttgacacaactgcaataaaatagcagtttgaatcaacatacaatctttcttgtatctatcagatgatgtcatgcagaattgctaacacacactttttgatgtaagactttctcaataaacttcattcataatcaga

SEQ ID NO: 225431 - DNA, 467 bp, Homo sapiens
gactgtgtcctgtttatgaaaatttggtggctctgggactgttttaaggtttatgccatgcaaaagcttttggaagttcctggtttctttgaaaatacgaccctttcaaaaactcaataggtttatgatctatgtagattagacaaatccatgtgttactaaccacactcaaagttctttcctagatatagttttcaatcctgattcattcatttgcctttttgtctccgtttaatgatagttatcttgggaggttatctgaaactgtaaatttgggtgtggagtccaagatgcatgttgtaatttgtagtgtaattgttagaaagttttgcagtggagtgtatagctaacaagctcatgaagggtggataaaataataaaatataatcaatctaaaaggagaaaagaaagtagagaaaaagaatacagaaaaagaacaactgtctccacaagaaactataggttaa

SEQ ID NO: 225432 - DNA, 793 bp, Homo sapiens
catcggtgctgggtgtgagaaggggatgggagggagggttgttcatcagaggaggcttgaggaggctagctgctgggggatatttaggggtgagggtggaaaattttccagcacatcccatcacctgcactcaacttctatcttcaatgcatcctctgcccagaagctaccactctgatcctaccaccttccagtgaccccaaaactaggtgcccagcactagtaagtgagaggcactgaaaacagagccagagtggggaaaggagtggtgtgggtcactgaacaagcccgctggcatatgtaggtgaagacagtcattctacagcagtttcctgtaccactggcctgcaagatgatttccagtggtgcactggagaacattttttattttaatagtaatgtattagcaaaaatagaacaagcatatcacatgatttcacggatgttacttaaaatgaggctaagttaaattgaattttaatctaatttaaaggaaatatgattaggcacggtagcccacacctgtaatcccagcactttgggagggtgaggcaggtggatcacatgagcctaggagtttgagacctgtctgggcaacatagcaagacaccccatctctataaaaaatttttaaaaaattagctgagtgtggtgctacacgcctgcagtctcagctactcaggaagctgacatggaggatcgcttgaacaaacgaattcaaggttgcagtgagctatgatcatgccaccacactctagcttaagcaacagagcaagaccctgcctcaaaaaaa

SEQ ID NO: 225433 - DNA, 483 bp, Homo sapiens
tccaatttactttttcagctctgtcctcttcaataatggtgcatggtgaccctcaatatgagatacaagcatctgttatctggagactggctgctctcagtgaaaaaagaaggagtactgctaataggctttcacctcacagcctgaatgccaggccaccacacaagaactgaagaggccaggctcctccccattctcccagtgtgcaggtgggcccctcatccattgcaggcatgtgcagaaaagaccctgggcaggttccctcatctgcacaaaagcatctgatgtaaacacttgtggggtgagtcggagattctctggggaccctccctcatctgactcctgcatctatcactaccattacctcaaaaacaataaaaaagttaaattggcatttttttttaacctaaaggctagtgtatctggcaacatacaagatacatacctctcatagaagattaaaagctttttcgtaccagggat

SEQ ID NO: 225434 - DNA, 474 bp, Homo sapiens
gtctttgtctttcttcctaattagtccctttccttacattttccttaattatctacacacctgaatacaagtccctcccaattacaaagccaatgcctattttttgaaacagaaaattttaaaaacattttttgccaatttgaacatataaatatttaagcctctaagtgaaatcgttaaaaatctacttataatattccatttattaatctacacatatgtatattaattgcataaaactgaaaagaaaattatatacactcatactttgcaatattgctttattctactctgatatttcatgaaacaatctgttcacatgtgtcgtgtgcatcttggctgtcagcaactttgccatcactggaaaccctttctgattttttaaaacagttttccaaaactatcttctctgccacccacgtttctataacacagcaatttttaaatacagatgtaatactatcacagaaaatt

SEQ ID NO: 225435 - DNA, 358 bp, Homo sapiens
gacgtccaaagccgcatggagggtgcctggtgaaaggccaagtgggggccgagtgtggccatgccatgggacaaggttgaagagagcctaatggcatctgaggaaaaagaactctaaggaagctattcttggggaaacggaacattcacccccaaatctggccaagcactgtgcagtagacttcttaggctccttctcagccttatcgttgactcgatatttactttaccctcccttccccctgtgcagggagaaggccgagacgtttatgcctatagagcgggccataaaatcttgactcttagataatatcattttatcattctttgtagtaggaaaacaataaatattttaaaat

SEQ ID NO: 225436 - DNA, 300 bp, Homo sapiens
agcatttctagtctaagttggttaaagagcctcagggtccagcaattttaacttcttctgagcatgcaattatccctttaaacttacattgatgaaacagaaaaactttaatttgaataacattaatttgtactttctaacaaataccataactttcaattatatttcattcaagcatcacttggatttaatattctaggccgggtgcggtggctcacgccggtaatcccagcagtttgggaggccaaggcaggcggatcacctgaggtcaggagttcgagaccaacctggccaacaagg

SEQ ID NO: 225437 - DNA, 353 bp, Homo sapiens
tggctaatttctgtatttttagtatgttggccaggctggtcctgaactcctgatctcaagtgatccgcccagctgagcctcccaaagtgctaggattacaggcgtgagccacagcgcccgaccataatattatttttgtgaaaatatgtgttctgagttctaaacattcagcttacaaatccccttttgcaacatgagtgtttgtagagtatgtgtgtgttttgaatgtgtgcatgtgagtatatgaatgtgaatgtgtaagtgcacgagtttaagtgcacaagtgtgtgttagtgtgtgcatgggtaggaatgtgaatctggttgtgagtgtgtgtgagtgtgactgtgtgt

SEQ ID NO: 225438 - DNA, 440 bp, Homo sapiens
tgttcttttctggtatgtttttggtgtaatggcgtgctcatgcgtccccggcagatgtggcttagcagcgtcaggacttgaatctgagacacgcagaattgctgtccaagaggaagcatgtgttggtcctctctgctcagctagtggagctcacctgcagtaccaagccctgttctgggcctcatgcttcaagggaacatagagagtgacctgaacacagaaggatctcgaaactctcatttctggagagaggttaaaggaagtgtttggtgttcagaggtgctgactagggtgatggcagctggtgtgggaaagaaggattagatccattgcctgtggccccaaggcagagaaggaaggaccccttagggatgcccagacactccctaaagcagaccacgctattctgatgtgtctatgaagacttcaccttattcaaa

SEQ ID NO: 225439 - DNA, 270 bp, Homo sapiens
atttttacatttttttcctacattgcctccaaattctatgtttaatacatttcttccctgttttgctctggtgaaaactttaggggacaaataaatgagtgctgtttggagacaaaattttgtgacatgggactgggcattgtggcgtgtgcctgtagtcccagctacttgggaggctgagatgggaggatcacttgatgccaggaggtcgaggctgcagtcagtgagctgtctgcacttcagcctgaaagacagagggagaccatctca

SEQ ID NO: 225440 - DNA, 351 bp, Homo sapiens
ggcacacagcaggagctcaggaaacatttatgtaatgaatgaatgaatgaatgaatgagtgcacacagtaactaggagtaagggctcaataaacatttctgtattaaacgcacagtgtctggaacacagtaagcgctccgtctatggcagccgtgaatatccctgggcgaagcctgtgaaaccttgtccaagagcttggcttcactgtgcgcgggttcgaatctggactcctcttcccaagtgtgcgacctcgggcaagtgatttaatccctttgtgctttagttttctcctctgcaaaaggcggacggcggcgcgagcctctgaggacacattccccagggcactcggac

SEQ ID NO: 225441 - DNA, 434 bp, Homo sapiens
aggatagaaaggaaatctcaggataagtttgttggcctcatttgaagaaaagtaccttatagaagagccataagaatgacgtggctttcattcactcagcagatacattgggaccatctcttgtgcccaccttgagcttggttaggggtacaggagatggggtcgggcacgctgggaactaaggaggtctgaacccagcctgggggatggaggactgcctggaggtggaggccagacctgaatgagtcacacaggctaagtggggagtcaagaggtgcaggcagttaggccaccacacctggccgctcatctttttcagcattgaataatattccattgcctggatatgccacattttatcattcgcccaatgaaggatatcctggttgcctccaagttttgcaattatgaataaagcagtataaacatctgtg

SEQ ID NO: 225442 - DNA, 528 bp, Homo sapiens
tccacctccaaggaagctgtttcaagagataggaattgtcagaaaaagccggagaaggtggtgttaaaggaaaacattgagaatggggagtgaagacgagggtttttcgtagcagaagatggatcttcgaaagccaggaggcagaggagagcaacgctgtcggtgagataaaggtgaagggaagctgatattccctgaagttagtaatattaaaacagtactgaagaaagagaaagttggaaaatggtctagagggaccttttagcaacatgagagggcgagggatgaatggagctctggaccaggatattccctctgcagcaccatccctgggaacgtcagacgtctggggtagtgaaccaacaaaaatagaatatgcaattaacaatttcccaggaatcatgtttacacacgtaaaaaaaaagagaaataggtgaaagtaatttcaatgatgtattttatttaacacaatatattttagatatgttttaaataaaatatatcattaaaattgatgtgtcaatatac

SEQ ID NO: 225443 - DNA, 539 bp, Homo sapiens
aaaatctcagcccgtgatgggggcgcccagaagctgaaggactggaccacggaaccataggaggctgtggggcttccaggaaggcagtgcaggtgggagggcatgttgagagtttgtaagagaaactgcgaaagccctcctcactgacttgactcccctctccctgcctgcagaaggtgaaccagaggctctgactagggacttcaggccccgcttcaggaaggagtggtgctcttagctgaccacagggagtcatgcaaatgtccacagcctgcacaggcaccagctcccctgccccaccctgctctgaggggccgaacaccatgggtgagcgtcttccatcctccaagagcttggaggagtcctcttagaaagcagcctaaaaggaaagccctcacgatctggggttctgccaatgacagggccttcccacggccttgcaggaaacccacaggccaacaggcccaccaggcatttctttgcagcttcctggaaatatctaattatttcaaaataaaaagttaaatttttaaaaaatt

SEQ ID NO: 225444 - DNA, 300 bp, Homo sapiens
tcaaagaatctggatttctaagcagcttccaggtgatgctaatattaccggtctggagaccacatcttgagaggcactcagctaagccaatcatggtattttcattgttcccctttgcctgactggtttaggcccacgccccagacacaatcctagccaacagaaactgagagaaaatcatctgataagcttgcggacaagtttttccttaaagggaggtggaagtgtcacaaaagactcaattatatgcttcctacaggaaacgcaccttaaacatgggcaaacaaataagttaaaagt

SEQ ID NO: 225445 - DNA, 1084 bp, Homo sapiens
gaagtctcggtctttcagtttggtggggtcccacccaggcagccatctgtgagagactcccacacagttctgcagggcatctttgaaacaggtagagtcagccttgactacatgttcccacccccaccctatcccatctgtactctctgagtctgacatcaaagtggcagccctggcggctcctgcctgtaatcccagcactttgggaggccaatgagaatggatcactggaggtcaggagttccaaactagcctggccaacatagtgaaaccccatctctactaaaaatacaaaaattagctgggcaagtggtggcaggagcgctactcgggagggtacagatttagagcctgtaatcccagctacttgggagtctaaggcaagagaatcccttgaacctgggaggtggagattgcagtgagctgagatcacaccattgccctacagcctgggtgacagtgagactgcctcaagaaaaaacaaaaaagagtcagccctagtgatcttgtaagttgcctttggtgggtcagtctttccttttcttaaagaatagtacacattgacagccaggtagctctatgatcctgttctatagaattcaaaaagtcgacaaccttcctttgttcctttctgttttctctgcctacgttagtttaaattggcagtgtctctgctggaataatcccatctctcttcctggcttctgctgagatggctgattaaatccttgggtcacacccattatctctttatcaaatggttgttcaggctaggctcagtgtttcacgcctgtaatcccaacactttgggagactgaggagggcagatcacttgagctcaggagttagagaccagcctaggcaacatgtcaaaaccccatctctataaacaacaacaaaaaattagccagggtgtggtggtgcatacatgtagtcccagctacttaggaggctgaggtgggaggattgcttgagcctgaaggcaaaggttgcactgaactgagattgtgccactgcactccagcctggatgacatagccagaccctgtctcaaaaaacataaaaataaaaataaaaccaagaa

SEQ ID NO: 225446 - DNA, 330 bp, Homo sapiens
cagttttcttaaagctgtatcagtttcagtgctaacctaagctgagattattttaaatacttggagaaagctggcatttaatttagctggagctagtgttttgcagttgtcttccaatgaaagaatctacctcattgggagatgttgagcagtaataacacagctgttcaaaactagtaaaaatcctaaaatgattcgtaagggacagtgcagaggctgccttcacaagattttgtaactcatttgaaatcaaagactgcaaagtaccaaagagggagctctggttattctagcctgggccatcagagtggcattgaacaattgattaag

SEQ ID NO: 225447 - DNA, 400 bp, Homo sapiens
cagaggtttgctgcagcattgttcagagagtaaaaacaggaaaaaagagaatgctcatcaaccaagcagtggcttaataatttataatatttctcaaacaaagtaatatttttaatgaataaaaatatgaattacagttaaaccaaatgatttggagggattcccataagatactactgaaggaaaaaagagcacatatatcctattgagggaaaaaatgataaactctgtgtgtgtacatctgtatgggattatctaagtacagagagctggacagaggatgcatattaggttgttgagattggttgccatggtcggggaggagggaaggctgctgacgttgaaagagggagaagaagggaaggacagagctcagttaaaagaagtttaaaaagtcact

SEQ ID NO: 225448 - DNA, 473 bp, Homo sapiens
ctgggttcatgcaattctctgcctcagcctcccaagtagctgggattacaggcacccgccaccatgcccggctaatttttgtatttttagtagagacagggtttcaccatcttggccaggctagtcttgaacttctgacctcatgatccacccgccttggcctcccaaagtgttgggattgcaggcgtgagccactgcgcccagccaccctattacattttttaaaagtcctaggagtaaatagatttttccatctcatggtagcctgagatatttgtttctttctaatcttaaccaattctattttagaaataaaaaaaaatgaatctaatctacatcccatagggcagccctgcaagttattgattatgctagcctttctctaagttttgtttgttccatactgaagaaacccatgtccttaaagcaattcaggtcactcttctctggatatgattcaagtcattaaagtc

SEQ ID NO: 225449 - DNA, 345 bp, Homo sapiens
gacatgatggtatagataccagggaaagcactgtatttatctgacattcaagaagactgaatggccaggcgcggtggctcacgcctgtaatcccagcactttgggaggctgaggcaggcggatcacctgaggtcaggagttccagactagcctgaccaacatggagaaaccccgtctctactaaaaataaaaaattagccaggcatggtggtgcatgcctgtaatcccagctgcttgagagggtgaggcaggagaatcgcttgaacccaggaggcagaggttgtggtgagccaagatcacaccattgcactccagcctgggcaacaaaaagcgaaactccatctc

SEQ ID NO: 225450 - DNA, 390 bp, Homo sapiens
aacaacaacaacaaaaggaaagaatcagactggcttgggactctgctgtcccctgcccgtgacctcccaaaagcgtgtgttagagactgacctgcctagtgcgtcagtggagggggcactttggagaggggcttggatcgtgaggccccgccctcgtgaatggctcagtgccttgtgaaagggcttgatggagggagtttggtcccttttccccttttgtctctctgctgtgtgaggacaccatgttcctcccctctggaggatgctgtaacaagctgtcatctcgggaggagacaccaggccctgaccagacgctgaacatgccagcaccttcatcttggactttccagcccccagaactgtgagaaataaatttctgttctttataaa

SEQ ID NO: 225451 - DNA, 468 bp, Homo sapiens
gcaactgaaaataaatcgaaagccttaatgtaagagctaaaattataatactctcagaaataaacatagacataactctttgtgaccttgtattagacaacataaccaaagaaaaaatagatgagttggagttcgtcaaaatgtaaaactattgttcatcaaaggacaccatcaaaaaagtaaaaatgggccaggcatggtggctcatatctgtaattccaacattgggaggccaagacaggagggttgcttgagcccaggagtttgagagcagcctgggcaacacagggatacctcatctccataaaaaatacaaaaattagctgggggtggtggcgtgtgcctgtagtcccagctatttgggaggctgaggagggagaattgcttggacctgggagattgcgactacagtgagccatggctgtgccactgtactccagcctgggtgacagagcaaggccctgtctt

SEQ ID NO: 225452 - DNA, 644 bp, Homo sapiens
actccaggctcccagccttgactatcggttccctgagggtcttggacgctgccccagcacagggatgtcccttctgcctgggaaccaccagaggcaagctccaaggatgtagtttggcaccttcttacaattaattggttttggacgacttggtaatttagaaactgctgaggtgaacctccaatagaggaagtctggcatggttctgtgcctgactgtgccccgattatgcctcaaaatgcctcttaagcccctgatgatgggtgttagtttccttacaaaggtgaacatgcttctcagaagatgctcctgccaccttctgcatcaataagcgaagtttggaggacaaagtacaggttacttttggaacaataggatcctctctccctctggcgttttgacagattttcagaagtagaagggaaagacctaagacactatccaaacccatgggatctatcactacctatagggtgtgacatgtcacactagctgagccacctggccttagctgcatgtctgccaaacagccacttgaaagctacctgttagaaagcaatgtgcttgatactagatactgcctgttaaatgtgttacatgaattctaaaaaagataaataaataaatcttatttttggtaaata

SEQ ID NO: 225453 - DNA, 577 bp, Homo sapiens
aatctgatttcggtggtgtgtgagcagggtgcattcggtagaaactactttgagttttgaccgttccccagctggccgtatgaggtcagtactctcctgtgatgaggggcggtgactgcagccccagcgggccacgtgatcaggagggggccgaatgtcccgaggggctctgcgtgcagggggttttgccggactgtaggctggcgtgtgtctgtcaggttaaggcaggtaaggctgcgccgcttggtcgtgggttctgtgtggaagtgcagtctccacccaggatgtttccagcgccgctcggtcgtgggttctgtgtgggaagcgcagtctccacctaggatgtttccagcacatggagggtttattgggaggtgaccttgtctgaagctgaggagcgtctgtggaatttgtttccagctgtgtaaatggttgcagagctactgaaataaaacctttaaaatacactctcaaggaaaaaagcagattggatagctcgttcagtgcattttggaggaggttgaactgaatcaggagaaagcccagctctagctctgtcctccaccccacccaactt

SEQ ID NO: 225454 - DNA, 302 bp, Homo sapiens
taaattctaatttgccctatattttaacctgggtctttgttttttttcttttttcttcttttccattcgtggaaatgttgaatatagtttcatcatccttttcctcttcatgaagatgttttgctgacacctttgttgactctagtccagactaaatattttttattcttttgtctccttcctaggtagagccctgcttggaagttcaagccagcctgtgtatagttttaagttaaagattttaaaaataccctatgtgcttttcagtctaccttaattatatccaatccaaatccataaga

SEQ ID NO: 225455 - DNA, 479 bp, Homo sapiens
actggtttacacacagctatacacagccagttcctctgttggactcaagtggccatgaccctcaggaaaatcctctaggagtgctcggcacagggcagcaggaagtcacgtggggagggtccctctgcagacccttgtggcacagcaataggagagcagggcggtgttggaggcccagccctgcctgaggccacttcttcataggtcctggctgccgcaccctgcttatgccctgcaaacccctggcacctctctaaagccctgtgaatcaaccatctgacacggcctgtcactactcatcaacgctgactggcagtgacaccacctctgaggcctgatgctctgccacagctgctaggtcacctgagtagagttaggattattaaaaatcaaatgaaccaagcaggatgtttctcctgggcaaatatttatctgtccctacccaaatgaactaagattaaaaaccaaatattagaaag

SEQ ID NO: 225456 - DNA, 536 bp, Homo sapiens
agaaaaaaaaaaagcaagttttacttacaaatgtattggaagaagcattaaaattatgaatttttattaaatcttgatctttggttacatgtctttttaatattatgtgtaagtaggaagtatgcataaagcatttctgctacattgaaagggtagttgtatggctgtggcattgttgagagctgaactggcccctttttttcatgaaatgttattttttttcttgaaggaaactggttattcagactagggaatttggcagacattttctcaaaaaagggtgaagtgagcttgtcacttcaaggaacaaaactgacagtatttgtggccaatgataaaatttgagcttttcagttaaaatcagaagtttgaaaatgtgtatccaccactataaacttgacagcttctcaatacttaaagacagggccagctacatcatttgcagggctcggtgcaaaatgaaaatgtggagctccttgttcaaaaagcaggaaaaaggtgccactaaagtactaaaatataaagcttttttttcc

SEQ ID NO: 225457 - DNA, 578 bp, Homo sapiens
tctcgttcttcttcatcacacttcttatgctgtgtagtcttacaaaagaaatcacaaaggcccttgttagcaatttttagttaagatatttatcatgctgtatgttttgtgataccagctttcaaccttaagatgtcccttgaaaaagaatctactccctctcactcctcccattatagctaaaaagaggaagcaggcttcaacttggccaaatcaattttgattagctttgtccttgtctaatcagcctccatgtagtatattttccttttcacagattcatttggcactcttgaatagcatgtgtattctgaaagttattgacgaaagaggaaaatttaaccatatcttttaaggtacattttaaaagaagaagggacatccatttgcaatctaccagaagatacctgtggtttgtgaaagcacatggtagagtcggagatatcattttagtcactaaaaatgtttaaaaacaattggtaaaataggatccagattataacttatcaaatactgtcattaccttttcttcaaacactgaaataaaaataaagttataagtaacactacaaaaaaaa

SEQ ID NO: 225458 - DNA, 496 bp, Homo sapiens
gcaacgcactttgcagatttaaggagcagagggcgtacaggggagagtgagggagccagggcagagcggggaccaggaaccagcccggtggcgtcagacttgactgggaatgtaggggctgtccttaaggccttgtgtttaataaccattgagtcacaaaagcagctgctgggcagtgtgaaaaacagcacggagacaagcaaagtgctgggattacacatttgagtcacctcaccctgttctgtcatttaaggttctaaagtacttggagaggaagcaagagcagaaccacagcttcagccgtagcagaagaaagagacgggaagtgagacaaatcttgtcttttttgagcagagtttccttagacactggtctaaagtttagagcaagacctgggcttggtggcgctgatggcaggcgtgcctgccgagggctccagtttcaagaagctcacaggcagcgcgtccagaaaattacagttacttgtaaagattta

SEQ ID NO: 225459 - DNA, 552 bp, Homo sapiens
tcatgcagagtactgcactccgcctgggcgacagagcgagattctgtctcaaaacaaacaaacaaacaaatcagttgacagtatacatagaattctatttctggactctcctgtgttttctttatgattctaccctttaagtttatttgttttaacactatgctgtcttgattactatagctttaaaataaagcagctttcaaacaaattgagtctttgatttaggatcttgtagtgctttggagcggctgtttaatttgttcagccaataagtatctatcattttggatctgtgacagatattatttttattacgtggtgccataaatgcagatataagaaattaggaaaagcctagattgggccctgtagttttcctttcagaatttctattatgaaccttacattttaaaattattagtctttttcatctcttactgatgtgatgaaagaggattgcaacaaccatgacttaacgtaagtgtctgtttaccagctatcagtcatgtttgtggaaaagggtgggatataagaataaactatctaaatgtg

SEQ ID NO: 225460 - DNA, 394 bp, Homo sapiens
agctaaaggtgatgggcttccattattcctgtaggctgaaagggctctctcctgaaaaccatctacacagaaaacggaagaggtatgaacccttgctgagtgtttgtgcatgtttgtaaaaggtcttttaaaacaatgtgtatttagggttttattttctcatcttgattcatgagcctcagatatgcaacatttaaaaattattgatacataatatttgtgtgtatttatgaggtacatgtggtattttgttacatgcctagaattacaatgattgtgccagggtatttggggtgtctgtcgcctaagcatttatcatttctatgtgtacagaacatttcaagtcttctcttatagctattttgaaatgtataatacactgttgttaattgta

SEQ ID NO: 225461 - DNA, 580 bp, Homo sapiens
acacagaaaaaaccacacacaaaacaagacaaaaaaaagaaatcccagtgatagctgacattcggcctgacagcaggagaggggaagaagttcccttttacaaacttctgtaacctgaagatagttttcaggctggagtgagatggtgcaatcgtggctcaccgcaacctctgcctccccggttcaagcgagacatcctgtgtctcacgctcccgcagtaactgggaacaaagggtgtgttgtcagcacaaactgggttaattttggaattttaagtagagacgggactttgccgtattagccaggctggtttcaaactcctgtcctcaggtaatccaccccgcgttggctccccaagtgcggtgaaccttgggaaaaaggtagaccctgggggcttcgcttcatttcccctttttataacacagaagatagtatatctatatgtactatattacacattgggccttttccacttaacggtgtacccgggaaataactctgcatcagttgaccgagatattcctcattctttttttcacagctgcatagtactctgtcatgtgtgtgtaccctagtttat

SEQ ID NO: 225462 - DNA, 329 bp, Homo sapiens
acacagaaaaaaccacacacaaaacaagacaaaaaaaagaaatcccagtgatagctgacattcggcctgacagcaggagaggggaagaagttcccttttacaaacttctgtaacctgaagatagttttcaggctggagtgagatggtgcaatcgtggctcaccgcaacctctgcctccccggttcaagcaattctcctgcctcaacttcctgagtagctgggattacaggcatgtgccactacgcccagcctatctgtgataccgagattgtgttttcacatactgtcttttctgaaagctgctttttgttttgttttgatttggatgg

SEQ ID NO: 225463 - DNA, 496 bp, Homo sapiens
ctaaagtgatctggtggtggggaaggaagggaggaacaagttttatagacttctatcgtccaatcattgtgtaaaccaggaggaagtgttacagaattctcaaacatttccattgaggaaacactgaaatccatcagaaagagatgtctaaaaaggcatgtgagatccatagaaacactgaacagaaatctacctctgggccgagcacagtggctcatgcctgtaatcctagcactttgggagggacagcaggggcttcactagcactggccatgtttatttttttaagtagagtgatagctttatggctgttcattttattgtcactctttggaggttatgtatgtatcatatatacttcatacatatcaatgattacatgataaaagaagagaaaagccaccctactgactcatgccacatcttccgttcaaatgctcggctccttttgaactaactcccctttcaggctctcccttctattcaccatacacag

SEQ ID NO: 225464 - DNA, 196 bp, Homo sapiens
aatctgtcaaaggtaaattaaaagggaaatttaaaaatatcttgacacaaatataaatatacatttatcatcccaaaacttatgggacatagaaaatgccaatttaatagggaagtttatagtaataaatgtctacatcaaaaaagaaaaaatgttctcaaataaacaacctaattttatatctcaaggaactaga

SEQ ID NO: 225465 - DNA, 186 bp, Homo sapiens
tcccagctatttgcatggttgagttgggaggatcacttgagcctgagaggttgaggctacagtgagccggcccgggtgacagatcgagaccctgtctcaaaaaaaaaaggcatttgaaaataatttagtaaaaatcatacttaatacttgaaaatagtagttctcaaccttttttcctcaggaccc

SEQ ID NO: 225466 - DNA, 311 bp, Homo sapiens
cataaaaataaaaaatgaaaacaatgtaaattccaaaataaggatgaattacataaattcttacagtattattaaatgggttaccatgcaactgttaaaataacaaggttggggaatagctaattacatggaaaatatttatggaatgttattaagtttaaaagcagatcaaaaaagtctatacatacaatccattttgcagtatatataaatgtatcctaaatgtatctataagcatagaaaagagactgataggataaacagaaaactgtgagtggttatttctgagtagtaaaatttcaagtgactct

SEQ ID NO: 225467 - DNA, 467 bp, Homo sapiens
atattgtgaatagacttgaatacctagctctgaaatgtgaacttccagagacagtgaacaaccataacgttgttttatagttgcctggaaaatgaaggggcacaaattttagaaaatataatctgacagtggtgcacaaaattcactggtggctggagagggaggaggtggataattggtttccttgtggtagtagtctgtatgtgaagaaggtaccatggcattgttgcattccacatggtagaaatggctataatttgcccagacctgagcctcccgtttcccatgtgaagcctggaactgtggggccaatcagagacaaattattgctctttgtgcatgtctaaattcttgttcatggcaaacaaacacagtcatcattggtttctagccttatactgtccaagccagaaagcttatcatccccatttagaattttagactagtgaataaaaattttaactttc

SEQ ID NO: 225468 - DNA, 458 bp, Homo sapiens
gcgtgggtgagaggtagaagagggtagagaaaggaagtcgaagtatcttcaaatttaccataaaatttaccataaaaacctatcttcaaatttaccataaaaacctgtaaggtttttaacaaaactgtcaatgataatgtagctgacaagttgtcatgaagctttatgtgtttaaactagtttagaattggaggatttgttatttcatgtgacacatttttctattagggttttatttttatattatatgaacgacatattttagaacaacagaaaaggtaaacattaagacaggtagtgaaataacatttgtcaaaatggagagtctgaggacatttgacaaaatgtctatattgtaattccaaagcaagtagaaaagtaatagcttaaaaaacagactgtttcattttcttgtgacaagtccaccttatcctctacttaaaaattatattcataac

SEQ ID NO: 225469 - DNA, 514 bp, Homo sapiens
tctctttgccaaccaaccaagtaaccataccagacctgggccgttccacagcaaagtgaccctgtcagatgccatcctaccctcagcccagtgtgctgagaggatccgctccagcccgctgctggtcctcctcctggtcctggctgccggcttctggctggtccaactgcttcgctcagtctgcaacctcttcagctactgggacatccaggtgttttacagggaggccctgcacatccccccggtgagctgggtggctgtgtctgtgcagagggtgccgtgagagggtgggcagaggagaggggaagaagtgggactgtacaggtggaagggccaactggaaagagggcagaaagagcgaggtcttattgacacctgccctaggcccagaataatgtcaggagggggctaccaccacctagagagcatggcccttaccctaagggagtttagtttatttagatggctcatataagatgacatatagttacatgtttgtgctaaaaacattgat

SEQ ID NO: 225470 - DNA, 346 bp, Homo sapiens
caatagcaaaactctgtctcaaaaaaaaaaagaaagaaagaaagaaaagaaagcaaaagcaaaaattttaacattagtggagtttacaatgcatgtaaatgtaatagaaaacatctataatataaagagggaaaggtaaaaatacctatccagctgtaagatttctaccttccacttaagtggtaatatgttcattctgtgaaaaattaagtgcattgtaatccctagagtcaccatttaaaaaactattcaaagagatatattcaaaaccaatatatgaattaaaacagaacgctaaaaatcatttaaataaccaaaaaggaggcgaaaagtggtaagcagaagg

SEQ ID NO: 225471 - DNA, 166 bp, Homo sapiens
agatacgaatcgagccggtacccaggtcttttcccctcaaaaggaaatcagtctttaaaatggcacagaagttatgcatggtctctcctctccagcttctctgacctctcctgatcatctcaaccttgttcagtttgctccagccacagctgcgtttcacttccga

SEQ ID NO: 225472 - DNA, 321 bp, Homo sapiens
tcacctgagttcaattcatccttcaaggtcccggctcaaattccaccttcaccaaagagcttcccagttttctccagtaaaaaatagtttccctcccttgtgttcccaagggggaagggaggaaaaaggataaacaagcattaagcacttgatccattttaggcacttcgcatgtgtcacttgtatgaggtaggtattgccattttacttaatgataaaagagttggagagggtaagctgtctgtaaaaggtcaaggtcatataactagtaagtggtggtgctggggatttgaactcagtctaacttcagaatataacttt

SEQ ID NO: 225473 - DNA, 596 bp, Homo sapiens
tgatgctctgccatctaggaaatggagcttaatttttctcctcttgagtgtgggctggactcagcaacttgcttctaacaagtagaatgtggaaaggcaaaaacagtgacttcacagtggaaaaatctggcagacaccaccttaaccaaatgaaggctggcaccaccagtcaaaagtcttgttgatatcacagcctctgaaatgatgtggtgagaagggcacttggcctgagtggcattcttcccccaaatccgtaacgtcagcctaatcatgagaagacccattctacaaaagatctgaccagcactcttcaaatgtgtccaggtcacgaaagacaaggaaaggacaagaaacggtctcaggttggaggagactaaggagacgtggctgaaggatacacaggatctccctgtactgtccatgtaactcttcaataaatctacaattatttcaaaatagcaaaaaatacgattgctggccgggcacagtggctcacgcttgtaatcccagcactttgggaggccaagaagggcagattacttgaggtcaggagtttgagatcagcctggccaacatggtgaaaccctgtctctact

SEQ ID NO: 225474 - DNA, 554 bp, Homo sapiens
tgagacgagtctcgctctgttgccaggctgaagtgcagtggcacaatctaggttcactgcaacttctgcctcctgggtttaagcaattctcctctctcagcctcctgagtagctgggactacaggcagacgccaccacgcccagctaatttttgtatttttagtagagacggggtttcactatgttgaccaggatggtctcgatctcttgaccttgtgatccatccccttcggccgcccaaagtgctgggattacaggcatgagccaccatgcctggctgtatcttaagtcatatattttatttatttatgtttcttttgaaaaatgcaatattaatcaattaatttacccatttatgactcttttctaactaaattgcaagttcatttacaactctgatgttatttacttcagatagcttttcatatctccagtataattcacacataattagcaattagtatttgctgaatgaatttgagactcattttagctattacaagatagtgtccaagaatggtaacatgggaaaaatatattgcatgttactgata

SEQ ID NO: 225475 - DNA, 524 bp, Homo sapiens
cgttctgtgggaagcagggaaaagacagacctggccctgagacaggctggtgtgactgccgttcggagcccagggttaatggtgctggttagtcagccagtgtcgggggcagatgcccatcgtcagtggctcccctgtggaccctcccacccagcctaacgcgaatgaaaatcattgtttgcataaggtcatagctctggctagcagcgttttgagaccaaggccagtgtagggacctgtctttgctaacatggactcctgggctctgagggtgttgggaaggtggctcacgggagggagctgaggggcctgagctcacagctgtgaaaccaccgtggcccttggttgtctgaaggagcagcggtgtggggcagccacaggcctcgtggtttttctctgctgtcagttggggttagtcagtgtggacagaaagaattgctcatcttagcggattgaagactatggttagcaagcagttgtagatctcctgattgaaaaaagtgattattgatgtgctttgatat

SEQ ID NO: 225476 - DNA, 687 bp, Homo sapiens
taacttttaaacatctagccatgttctcatcaaagcattcagctttagtagagatataggtttatttttataatattctaacattagcttaaatgtttcctaattttatcatgtggaattaccccctatcaatcacacgttttgagcatcttcatttgtgatcctttgagaagggagtgtgtatatgtttatatatacacatatcaatacatatcatttacctaaattggtagattgagttgtcagagagagtttgatcaaaatatggcaggttgtttcaaagatatggttgttgtgtggaccagatcattgctgagataatgtagccaaatcacagactggtaagctagactttttcaatcacatagagtctgtaaaatacttcagaatttaaataaaactccattgctcatgcaaaactcatcagataagttcaaggagtcaatgacattgatatttcaaaaactcaacattggcttcacttgcgttattgacaagcatgtttcttggatctctgggaatttgtaggtttgccctgtggattttgactgttttcaaagttctaatgatttctcagtcgttcttcttaacttcagaaaaaaaaatgcattgttttctcatctttcctatgcaaaaccaaaataaaaaattgattctttgttttatgatttttgcaaatcacaatga

SEQ ID NO: 225477 - DNA, 361 bp, Homo sapiens
gcttagaggtcagtgacaggctttggcaactggcttcctgccatcctcagagatgtgacctctcttctcacctctccagaattcgagttactcccccaaaagatggttctcctggtattaaactgtagctatctaaagcatttctgtccaaagggtcttctcccaaagcctctaggccctttctagtctaactcctctacattttagttaatgtaaccaggaatctcccgtaagaaatgtggagtgaagccaggtgtgatggctcatacgtgtaatcccaacactctgaagcaggtggatcacttgagcccaggagttcgagaccagcctgggcaacacagtgagaccccgtctctacaaa

SEQ ID NO: 225478 - DNA, 431 bp, Homo sapiens
gcatttcaaaattccctaaggtgtcattggccaagcagaccaggagctttgtctctatgccccaggaaaagaaaggggcagagacaggaagaaactagctgaagtcatcgggctcatgcctgtaatcccagcactttgagaggccgaggcaagcagatcacttgaggtcaggagtttgagaccagcctggtcaacatggtgaaagcccatctctactaaaaatacaaaaattagccaggcgtcgtggtgcactcctgtagtcccagctactcaggaggctgagtcaggagaatcgctcgaacctgggaggcagaggttacagtgagccgagattgcaccactacacttcagcctgggtgacagagcaagactctgtctccaaaaagacaaggaaccggaaagaaagaaagaaagaaagaaagaaagaaaga

SEQ ID NO: 225479 - DNA, 430 bp, Homo sapiens
ctatatgtcagataaactaactcttgcagatgcaaggatgaataagcacaatctaataggaaatatatgtaaaccatgttttgaacaactccattttcaggcgggctattagaaaatcagtgagtttttctttgctgaatacaaagacataatctacatataagaagtaatgtagacttaaaaattttagttacctgagtatatacttactgtacaggttgctgaatttcctagctaggcagtcagctacagtggcttatcagcttagtgactgatccatacttgctcacatcagagtgggtgggattgatgccctgactgtctcccctggagatgaggagcattggtggggtttgactcaggaatgaatgcaaatgtttgttctgcacattactcagtgattttaagcttaaagttttcttagactgca

SEQ ID NO: 225480 - DNA, 261 bp, Homo sapiens
gaaagtaacaaaagaattaagagctggaaggaatgatttacctggaacatttttaaaaacagatagtcatctgatatcacgaaatgttatttataaaccttaatatctacatttgtctcatgtatgtgctaattgtggtgagcttaaccctacttgttaacagaatatgcaggcatataaacagtatattttaaaaggttttactgtcttaaaatatcttctaccatatgactgaaattcccaccattaatgtgatccctt

SEQ ID NO: 225481 - DNA, 405 bp, Homo sapiens
aaatgtatatacagaatttctaggactgtttggtggaaatgaaatcagaatttcagaagagattcacacatattgacaagtatttgtcattatttcattttctctggctgcattttgaatacaaaaactgaggatttctcttaattattagtctacctcactttcacacgagacgtcaaactgaaaacgaactattatcaccaagaagacacattatttctagactttggagataagtgtatgtgattttcagaactattcttcactatctaggctgccaaactctgaatggtgctgtaaaaatgcattatcaatacctaaataaccaatgtaggggaatggctaaattaattgagctgtaagtttttaataatgtaaaataataagttagattaatttggactt

SEQ ID NO: 225482 - DNA, 451 bp, Homo sapiens
tggcgccatctcagctcactgcaacctccgcctcccaggttcaagcgattatcccgattcagcctcccgagtggctgggactacagctgcccgccaccacacccagctaatttttgtatttttagtagagatggggtatcaccatgttggccagaatggtctcaatctcttaacttacgatctgtccaccttggctcccaaagtgctgggattacaggcgtgagccactgtgcccggcccatcgtaatcacttttaagtgtatagttcagtgacattaaatgcattcatattgctgtgcagccattaccaccatccatctccaaaactcctttcagcttcccaaactgaaactatacccattagacattgatgccctattcctccggtggcctaataaccactgttgtattttttgtctctctgaatctggctactctaggcttgccatgt

SEQ ID NO: 225483 - DNA, 461 bp, Homo sapiens
taaaagctcctttttttctgttagacattatttttctctttatggaaagctttaaaagagctgcttgaatataaataaaaaagaaatatactttttaatttctgaaaggtgtaagtcagaaaatttccaagaagagcattttttacattttttttttaaagccgggcatggaccgggcacagtggctcacacctgtaatcccagcactttgggaggcgaggcaggcagatcacctgaagtcaggagtttgagcccatcctggccaacacggtgaaaccccatctctactaaaaatacaaaaaattagctgggtgtggtgatgcacgcctgtagtcccagctacttaggaagctgaggtaggagaatcacttgaacctaggaggcagaggttgcaacaagccaagattgggccactgcactccagcctgggtgacagagcaagactctgtctcaaaaaaaaa

SEQ ID NO: 225484 - DNA, 252 bp, Homo sapiens
atcacagtgtgggtgttgcctatagaacacggctccatgaatattgctatggttcctgggatatctggaggcgacgagtttgcctgtgtgtagggctggatcctgtgggcctcccccaaagccagagtgccctgcacatacctcgggctttcgtgtgaacacaccctgaggttccccgagcttttctgtgcagaacagtaatggagaggtagagaaggaataaaagaactcacttgaaactttggcaaagta

SEQ ID NO: 225485 - DNA, 358 bp, Homo sapiens
tttcataaaagtgagttttttaatgtaaaaaaattaatgtataatttagaatgtgttgtcattttttctctatttaataagtatgtaatttagggagaatatttatcatttcattcctttgtttaattcatagaattattacagcacattagctatcacaacttatggatttacatcatttgtttataataaaaaagtgttcagaaaatattcgtcttcataacataggtcaagttatggggtgcaagtgttggctaaaagtggaggatacaagatgagcaggtatgttttctgctttcaataactcattttctgctgcagagatagccttgtaagcaagcaatggaaaactctgaca

SEQ ID NO: 225486 - DNA, 433 bp, Homo sapiens
aaactccacctttgagagttacttactgctaaatataaaggcttttttgttttgggtttttttttttctttgcaatttcttaaccttttagacatttccatgtagcatttgatagtgtggaaactctcaccctgctttgttctctgttatgacaatttggcctcacttctctaacaattctttccttctttgtacaagtccttcttcttcctttcatttcccaaatactgacatttcagtccctgtattcatgctcctgtccctagccctctatgttctactacggcctatgtttttcagcctgggtcattcttttcccaagcccagagtgtaggagagtctgctgaaagtgaaggcagaggttacacagggcatatcttcttagcttatcaggtttacttgatacttggggaggagaaaacattttgtttaa

SEQ ID NO: 225487 - DNA, 316 bp, Homo sapiens
gcacgaggatgaattggggtcaggcagcttttttagcaatttagaaaataattaaaccagtcgagcgaggtggctcacacctgtaatcccagcactttgggaggccaaagcgggtggatcacttgaggtcaggagttccagaccagcctggccaacctggtgaaacaccgtctctactatggcgcgcgcctgtaatcccagctactggggaggctgaggcaggagaattgcttgaacttgggaggcggaggttgcagcgagccgagattgcaccactgcactccagcctgggtgacagagcaagactatgctttga

SEQ ID NO: 225488 - DNA, 550 bp, Homo sapiens
gctcgacttagaggatccctcgaatcgacggtttctcttcttcttctgccccaccacccctcacaccaggccctgtcactccttgactgcacaaacagtctccttttccacagggaggctcttggcttgtctgggtatagagacacagaagggacctccagcagaacaaaggggctctgaacacactcacccaatgtctcagtaaaacctggatgaaagtggaatggggagtggcagtgcacaagaaaatcaaaggcgagactaggctctaatcattccccttaaagcagaaagtccaaggttctccaactcttgacctcaggtgatccactcgtctcggccttccaaagtgctgggattacaggtgtgagccggatgtttttgaataccttatctgggcattcaatcctggtaagattgtgcacagcacaatctgagtgtcatgtagcctgatctgcagcagggctggagatgccatgggttagggcacagtgagattttgctaagataccagatggagaaccttggactttctgctttaaggggaatg

SEQ ID NO: 225489 - DNA, 463 bp, Homo sapiens
tactcctgttcactgaccttctcctctgcatgaggcagggtgtgaggcacagtgggagatgcatagatgacagccccatcctggaaatgagtgcagtgagaggcctgcaggcagagcagcctgtgaagtgtgtgctgaacttgtttgagagcagcaaatcctacattactacagatttggggatttgaggcatttgtccaacaggcttctgagccttgaatctgtttcccttttccactccccatcaagagatctgcttgctcagctagttcccatcagctctggttctgcggttctggtccaggctgagtggccttggagttaggtaagaggtggtgggaagggagggatggaggagagctgagagctatggcccgttatgtgccagggtcaagcctgtcacccaagatcgtgccactgcattccagcctgtatgacagagtgtgactccatctcaagaaaa

SEQ ID NO: 225490 - DNA, 825 bp, Homo sapiens
tactcctgttcactgaccttctcctctgcatgaggcagggtgtgaggcacagtgggagatgcatagatgacagccccatcctggaaatgagtgcagtgagaggcctgcaggcagagcagcctgtgaagtgtgtgctgaacttgtttgagagcagcaaatcctacattactacagatttggggatttgaggcatttgtccaacaggcttctgagccttgaatctgtttcccttttccactccccatcaagagatctgcttgctcagctagttcccatcagctctggttctgcggttctggtccaggctgagtggccttggagttaggtaagaggtggtgggaagggagggatggaggagagctgagagctatggcccgttatgtgccagggtcaagcctgtcacccaggctggagtgcattggtgcgatcttggctcactgcaacctccgcttcctgggttcaagcaattctctgcctcagcctaccaagtagctgggattacaggtgcccgccaccatgaccagctaatttttgtatttttagtagagatgggttttcaccatgttggccaggctggtctccaactcttgacctcaggtgatccactcgtctcggccttccaaagtgctgggattacaggtgtgagccggatgtttttgaataccttatctgggcattcaatcctggtaagattgtgcacagcacaatctgagtgtcatgtagcctgatctgcagcagggctggagatgccatgggttagggcacagtgagattttgctaagataccagatggagaaccttggactttctgctttaaggggaatg

SEQ ID NO: 225491 - DNA, 512 bp, Homo sapiens
atatatgtttactgaaagacctgtgtgtacacacatgctcatggtagcttcattcacagcaactgaaaccctggaaacaagacaaatgtccatcagcaagtggccagattgttgtatgtgcaaataatgggatacttctgagcaacaaaaagaataaagtaccaccataaaaacaaggatgaatctcatcaacattctgctcagttaaagcagccagaaaccaagagtacatattacataattccatttatatgaaaatccagaaaagacaaatctaatctatagtgacagaaagcagatcagtggttgccgggggctgggggaagggtggggaactacggggaagaggcacaggggagctttttgggatgatgcaaatgccctatatcttcattgtagtggtagttatatgtgtctataaatttgtcaaaactcatcaaactgaacacttaaaatgtgtacattttattgtatgtaaattatacttcaataaagttgaaaaaagaaaccaa

SEQ ID NO: 225492 - DNA, 561 bp, Homo sapiens
tagcttctaattttggttgtgctagtaactcacagcgggactttgggacttggttctttttctcagccctagttccctgggctgtctgagacataaagtgcataagatcacctcgaagttcttttcaagcagtaacagtctatgaagtcataattaaaatgtcctaggagaacgctctctacttaaaagattttttttttgttaaatcaaactgtgcaaagctaattatcactccttaattcgtctattttataatttccattttttctacttaagttttctttttttggtgtaaaagtgaacatttatttaaaatatgaaaagaaaacacaaaacaccaactgaacaagcgccaaataccacaaacatccccaaacccagaacgatgacattgtattttttacaaaataacttcctaacacatctctataagaactttcatcttcctacagtttttctttttcttttttttggcttcatatgctgtagtcatctcttcatatattgcaattttataatatttttcatataaaaaattaaaaagataagccaaccttttct

SEQ ID NO: 225493 - DNA, 628 bp, Homo sapiens
tgtgtttttgacagtctttgaatagtaatttcatttcttatagaatattcacttttttgtaggggtaattgtttaacagtaaagaagcagatttgaatcttccacttgatcttagatttttttccttttatttcattttgccaattcccctttcaaggatatgaaactttcctttacctacttccagaagccagccttttcttttagaaggaatgttttaaattgtattagaagaaactttcctgataaaagataaattttgtaaatgtgcagtttaaagtcactgtgtatgaaaagtgtgtaaaatagatcagctttcagttgctaaaacccagagggttactatttcaggcattctagcagcattttcttgtttctaatctctaacagttatttctagtatagtctcattataatgttcttaatgactgacaaatagataagctaaagcagagtctcatggtggatatattcctttgctctggacagaaaaattgactgtctgggcagggaaaatagaggatgtgtcctataacacttaaaaatattactctgggtactgttgggaagatgccatatacaaagtgccaaatgaatagtagagtagtacaggcaagtgctataggtg

SEQ ID NO: 225494 - DNA, 206 bp, Homo sapiens
tcaggaagtttcctttaaccctcactgccttcattaggggcctccctcaagctatcaaagtagccagagcatacctctagcagtagtattgtaattgttttcttgttgcttgtcctcaatttttattctgttcttatctgaccacattttgtacattgaagcaacttatggcaagaacaaatctaataaaatgatggtaaaatata

SEQ ID NO: 225495 - DNA, 517 bp, Homo sapiens
ctctgttcgccaagttctatgcacaacaaccctggaaggtattagtaaatctattttagagatttaaaatagtaagtcctactaaagttaagtaagctgggcttcaaacagaattctctgtaaacctgaagcctctgtttgttcatctttatcacgtggtctctcaacggcctccacatcctgagtgttctgaccatcactttctccactggtatgctggtaaatgtttctcagctgttactggaaagtggtcctgatccagagcccaagagttcttagatctcgagcaggaaagaatttaggatgagtccatagagtaaagtgaaagcaagtttattagagaagtaaagaaacaaaagaatggccactccataggcagagcagcaccgagggctgctagatggctatttttatgattatttcttgatcatatgctaaacaaggggtgggttattcatgaattttccaggaaacaggcaggcagttcccagaagtgagggttccttccctttttaga

SEQ ID NO: 225496 - DNA, 810 bp, Homo sapiens
agtgttagaagcccctccgttatttacccctcttccaattcttcagtctcacctcttcctcctactgccctgtgtgacattccacgtctgccaaaccggactctgtttgggcccagatcggccctgttcctactccgctgcccatcacttctccctcctagagcccattcccgctctttaccatcccaggctgtagatccattttaagcctcacctctcccagaaagttcccccagacctgagcagagggagcctacttcctcctcagaatctacaactgtactctctcactctaggtggaaatgtcaaaattggtccaaccttttaaaaaataatttggcaactcacatcaagggctataaaaatgttcataccccctttcgtgcataattatcccaattctgggaatctttcccaaaggaaataaacctaaatccagaaaaaaactttggcttaaagatgtttattgcagcaatgaaaaaaaagggggtgggtgggtggctggttaacaacccaaatctccaacatttaaggaacagttaagtaaattacagtgaatccaattgttgaaatattattaggatcatcaaaacaaatattcatgaagagtgtataaagatgtggggaaatgcttgacaatggtaagtaaaaaagggtataaaattacaccgttacaaaaaaaataaaaataaataattttaaaaaatatttttaaaaactacatagttatctgtattgtctaattctacaataagcatgtctacaggcatgcaccaccatgcctggctaatttttaaattttttgtacag

SEQ ID NO: 225497 - DNA, 826 bp, Homo sapiens
tcactcatgaaattacggcgtgtaagaaataccactttcctttacaccatttcttttttcgttgaaattaagttctagctctgaactgtgatctctatctccctgggttgagagaaataacaggcattactgggaatccaggactacatgccccagctccctctctttcctgaccttacctcaatgtgaggtcctgtacagtctagtattctcagacaggctatgcattcttcatgcttcagtcaccgctgctcactgctgatgtgatcattgtctatgcttgcaagagctcttaagacaggtactccaggggttctgtgcttgccttggatataggcttccttgtctatgccctccaggctcccatgcccttgaggacctgatgtctgcagggctattgtgaaagaacaggctacctacccagctacctgtggagctgcacactgcctgccacttcaatcttgaggaatttttttctctgccctccatcaccatttttgcttacctaccatcttcagaatcacacctcttgtctccctctctagcatatctccctcaatcagtgttggcttatgagttttaacagttctgaaaatacatttactttaaacaacttctattttggcttgtattacaactctaccaagaataaggcaacaaaaggccaggaaactcttaggtggtggtgtaggtctaagggcaggggtaggcagggttgtgtttatgcaaagaagagaaaaagatttgtcacatttagtatcattaatacatataatcatttataattatgtatattaataaattacttataattaataaaaataaa

SEQ ID NO: 225498 - DNA, 402 bp, Homo sapiens
tggggctccaggggcatctgaggggtaattagtgacttctttgatgatcacctaccgcctgccagcaccttactgagcactcaggattcatcatctcgtgggacgctcagccaaccgcgtggggtgagctgtgccgtttgctgcatctgcagagaggagactggtcccaataggctggacactgccgcaggcagacagcaggaggtggccgagcgggaccagaagccatgggacctccctggtgcctgagtgccccagcacagggctgagacgcaataggtaggtgctggtatccattgtcactcgaacccaggagcatccccacctgaattcatcttactctggtttagaagcttccttgggtttaaacaaactcttcgtgggttacatgtgttttgtcta

SEQ ID NO: 225499 - DNA, 343 bp, Homo sapiens
atgggggtcttactgtgttgcccaggctggggcttgcagtcgtttaaaccatgcaatacacagattaagatggtggtgccatctcaacagtggcctgccacttcccagggagtcttccttcctcagtgcagtccaccctcctcctggctactttcctggggtttggttgcaagtgggtcttccaccacctgcatccaacactcgggcgcatgaggaaaaccaactctttaatttgcttatctgtgataacttgaagccctggatagtgtcttgcatatggacatgttttccacaattatagctactccagtaaagtcacatttcagagactgacagcttggga

SEQ ID NO: 225500 - DNA, 247 bp, Homo sapiens
caaatagcggccagtcaaacagtgctttctaagctgtcagtctctgaaatgtgactttcctggggtttggttgcaagtgggtcttccaccacctgcatccaacactcgggcgcatgaggaaaaccaactctttaatttgcttatctgtgataacttgaagccctggatagtgtcttgcatatggacatgttttccacaattatagctactccagtaaagtcacatttcagagactgacagcttggga

SEQ ID NO: 225501 - DNA, 453 bp, Homo sapiens
  misc_feature (420)..(421): n is a, c, g, or t
  misc_feature (424)..(424): n is a, c, g, or t
ctcttggagaccgctatggccccggtttcggaatcgggctcgggaccccagggggcccaaataaaaaaaggaaaaaaaaaaaagcactccggcctagactgccatgtcatgctgttcatgagacttgagggctccaaattggctgacactcttctttcccccatgttcattttactacgaaactggaagtttttccttcaccacaaggccacttgtcacctacttttttgtacactcacttccagcaaactagttccaacccaggccacagccttcagcttccttcttcctgcatatgacaccagcttagctttccagacttccttctgtcatttcacccttcagccctccaaattggctgacactcttctttcccccatgttcattttactacgaaactggaagtttttccttcaccannagnccactgtcacctactttttttgtcacctc

SEQ ID NO: 225502 - DNA, 701 bp, Homo sapiens
ctcttggagaccgctatggccccggtttcggaatcgggctcgggaccccagggggcccaaataaaaaaaggaaaaaaaaaaaagcactccggcctagactgccatgtcatgctgttcatgagacttgagggctccaaattggctgacactcttctttcccccatgttcattttactacgaaactggaagtttttccttcaccacaaggccacttgtcacctacttttttgtacactcacttccagcaaactagttccaacccaggccacagccttcagcttccttcttcctgcatatgacaccagcttagctttccagacttccttctgtcatttcacccttcagccctcaatggttcacacacatgatcaaatctggatgcctaagtcttcctaggaccttcttgctgcctcatttgacaagcttcagtgctgcctttgagcctccctgcctccatggacctcccttcttcccttcagtcttgtccatcatcccactgggaagccaagcacctagacattctctgcactagcagtgaagaaatgaggtactgaatgcagaggtgtacaaaccctgttgtgccctcaatgtgatgcaatgtgatgaaatccttcctggaccttctttgtacaaggtctaaattatctccttgacttccattttattttaattattttgattaaaaacaaaaacttggctgg

SEQ ID NO: 225503 - DNA, 705 bp, Homo sapiens
gctcttctactaatgggtttttgctttattaggttatgaacctctgtttctacctatcctttttttccagttttggaggcagcagtttgccctgtaacctcatttctctcacagactttagaagacttgttgatatttcagttttttcagctttttattttattttttttaggactgagtggcgacttctgatatctttacacgctgggctagaaactggaagtctgtattagctttttatagtttcatagcctagccatcttcctgagttccatatctatctttctgcctggtgtccatctgtacttgtatattcaaatgaaataataatcataggctctaattatattaagtatatctgcttaagtataacctatttttctatataacctactgttcttctttatatttacttctgcccagaagataatcttccgtattagttagacaaaatcttaaaccttggttatctttaacatttattttccatttacatctttaaataatcattttctctaaatcctttcaccctgcttccagtttcttcattctgttctccatgctctatatcagctccttgtttcttttcagctaaattagttagaataatttctttaaatgataacatccatattcattctcagtgcatcttgttcactgaatctagctttgtcctatttcttctagcactctcttgtctttttc

SEQ ID NO: 225504 - DNA, 417 bp, Homo sapiens
acagagtgagaccctgtcccaaaaataaaaaataaacaatttttaaaatgtacttcctgtgtatggtaggattaagaaatgagtaaaatatattgaaaatgttgtttcatcctattagagaagggaattataagtggaaagagggaaaattagaatgatattgaattggaaatggaggtattaatatgaactcatcattttaaatatagttagaaacagatgtagttatatgtatatgaatttcttgatccaccaaaagggcttagaaaagataccccaatagcactgagtacccctgcttctaagatttggtttctaaataccattcattcttcactggagccacttttccttgaagggtatttctaggtctggaggaggaaaagtacctcatgagcatggaatatcttatgtcat

SEQ ID NO: 225505 - DNA, 473 bp, Homo sapiens
ggggctgtttgtggggaagtggtttccacagcaacaggaggtgagatattggtgttaccccagaccacacttagctacttccttctcactaaagctctgtagtcatattttccctggcagagcagaaacttctatgttatcccacagctgttctaacggcgtagacttgacttatgcaatgatgccaggagtcctgagcagcacagcccaacttcaatcacacacagatggacagagctgtattagcaaagcctgagctactgagcgatgagagtacagccaggctttcagacatctgttcattcaagagagatatgcgctaagccaaggacctaaagatgtgtttaatatgggtgctaatatgcataaggaaccttgaaataaatgttcttagcctttggccaagagggtccatgtctaggaatctattctccatagaaataaattcaaatatggaaaaaatgaacaatgca

SEQ ID NO: 225506 - DNA, 498 bp, Homo sapiens
aaagtggcaaaaataaatctcaattttatccccctaaaataaaatgacagaaaaatgtagggacccagtttaaactggcatttggattctctgaaatagggattctttctattgggattgagcactagcagagagctcacactcaaatgtctggatgaaagtgtaaaattgagaagttcagtttcaaaaaaaaatagcattcctgcattttttcagaacttatggcattgtgtttcatatactttgtattttccgatgcctattttggagcttccattattttgtttctattgctttgcatgagagcccttatataagtgagattgagtagtaggcagattctatctatagctttgtcctcttctaaatattacagaatttgtttgtttgtttgtttgtttttttgagatgggagtctcgctctgttgccagactggagtgcagtggcaccatcttggctcactggaacctctgactcctgggttcaagcgattcccc

SEQ ID NO: 225507 - DNA, 488 bp, Homo sapiens
ttgcccacccagaaaacacatttggcttcagacaccaaggatgcaggggacagagaaagagacctcaggaagcttccatcatgggggaaggcaaaggagactcaggcacatctcatggctaaagcaggagcaagagaatgagaagggaggtgcaacacacttttaaatgaccagatctctcaagaactcactcactattgcaagaacagtaccaaggagatggtactaaaccattccattcatgagaactccacccatgatccagtcacctcccaccaggcctcacctccaaaacttgggattacaattgaacatggaatttggatggggacacagttccaagccatatgaacattagagctagatcaggcttcaaagccagccttggccacttatttgctgtgtggccttggatgatttgcttgacctctctgtggctcagtttcttcgtctataaaataaaagtagtactcacgtctaccttgcga

SEQ ID NO: 225508 - DNA, 591 bp, Homo sapiens
  misc_feature (11)..(12): n is a, c, g, or t
aaggatccccnngcagaatcacactcaaacacacactgtttacttgagatagatccacctggctcttcttacagaattgttttcctcagaagttggctaggtctgcagggttagcaagaagggctttaagctgaggtcagagctgggtctgctacaaaccagctgtggagcaaccctccaagccctagttttctcatcagtgtgaccatgagaaaagattccgtgtgccaagagcacagcgcagggtgcagcttttatgaagtgcttgataaagggtagcagtagttcaatgttgctaaagaaagataacacagacattaggtatgactcaccccatgctgttaatttttaaaagatgggtaagaatattcagaaaagcatctgaaggaataaatgataaactgttaagaggagttatcactgattatgggggtccatttgctatattgttggaactcactatatcaaacaaacatcagcaggagaaaatgcatccctccttctcggggcagctttttcagaatttaacacatgtatgggtatatattcacggcagttgagcaaattctggctttttgagtgtgattctgg

SEQ ID NO: 225509 - DNA, 286 bp, Homo sapiens
gacagatacgaatcgagctcgtacccaggtcttttcccctcaaatcctgaactcaggtgatccggcctcccaaagtgctgagattacaggtgtgagccaccatgcccagccaaaatgtgctttttaaacgttgctgctaagatattacatttgatagcttggtttttctcagtggcctgaaaatagttgatgtaattaaagtaacgagagttcaattggaacctcagtctctctttttatttaaagaaacaagatttgagattctggcagctgcgttgcctcttca

SEQ ID NO: 225510 - DNA, 363 bp, Homo sapiens
gacgggatttcatcatgttggtcaggctgctgtcgaactccggaccttaggtggtccgcccacctcggcctcccaaagtgctgggattataggcgtgagccaccacatccagtcaagagtttatttaattagacatcttcccctgaagctctcagtgcttcaagtagcccagcccagcatttgtcttgtttcaaggatggtgagattgaccttcctttcctgtctgagattgcaggagaatatatagagaatcctggtagccccatgttgaaaatagaactgatagagaaagagggaggtcaactatgacaagaagcattctttccatccaccactaccagctttcatgtctgaaatcatcag

SEQ ID NO: 225511 - DNA, 547 bp, Homo sapiens
tgggtatcacaaggctgaagaccaaaaaacaaaagcaaaaccaaaaacaatcctgtatacaaacaccatactctagttggtaaatctataagagtatggattagtaattcagtaactattttatgtgtataataggattgaaggaataaatgaatgtgtgatagataatgagagtcaggtttcccatggtcagaaatagaaatataaaaataaggaaaaggggaaggctgcaatgaatattgtgctgattgacagtatcattatgaactcaaattatttaacataaatgcatacagatatagaaatagagatatatgtatgagtcagtacacatgcatatgtttcttatctgtacatgttcagaaagcataggggcaatggcaccacagaaaagtaagcctagcattcaaatatttgtttccaaatactattattctccagtaagaggaactagggattctctagttgaatgcatgactgggccagggaatatgcaagatgagcctgtaccattttgtggtagcagaaaaaaaatgaagtgattaag

SEQ ID NO: 225512 - DNA, 260 bp, Homo sapiens
gaagtcctagtgtaacacattccaaggaacacctctgattcattactctttggagactggctcccattagcaattactggaaataatggctgtccacagagcatggccgggagtgtggcatgcagggaggatatcataaggtgggccactgatgtgtggaaattaacccaggagcccacaaaggcaacagctatgggcctggtaggatctgaagatttcttctccagtggctcctggaggcccctatgcttattcaatgg

SEQ ID NO: 225513 - DNA, 204 bp, Homo sapiens
atcaaacctggcctatactttccatatccagcttttgacgcttttgaaagatacgaagagcattctgttacaagcaaataaaggagagcttcaatcttcttaccagaagaacaccccaagaaggattccttctaatcagcctaagacccaaaagctattagctaaaaagaaagggaaaaggaaagaaattaaagactgtgaact

SEQ ID NO: 225514 - DNA, 450 bp, Homo sapiens
tatatatgacttaaaatttcccagacaccgaggaatgaaatgtcagaatcgtctttgacttttccatctccctgcaaatccagttgtttacttaggcctggctgatggaactcaaaaaatgttttgctaaatcctgccttgcagggcagaaacattttgctaaattctgcctcacgatttctctgtgacattttattaagaagtgagtgcatatagctggtacactgaaaactaggtttgtgttgggagttgggaagccaggactggctgcctctctgcctctagcacccaagagtgaccttgttcagctactaaaactctgagttgcttgggtggttatggctcaacatgcttcaagccatcaaggaacaagcatggagtccctccaaagagacgacaaagactacagcataagatttttaaaaataattaaaataattaaaaccccta

SEQ ID NO: 225515 - DNA, 516 bp, Homo sapiens
aaacacgtttccctccctgaggcctgcagtatccacattctgcaaagcctcgactacaggggagtggctgaggctggaagtccctgagactcacaccttgtccatgtccctgctgattaccaccaagaggctggaactgccccagcctgagaaagcaagaagcagctctcaggatggcagagttgggtgtgggcctttaaacctattggcccataagagggaagtgccccaaattactttttccagtgctcacagtgctggatggtttaacaggacacagaagttgtgcatgaggtttttttttcttatattttcaatgaatgtttttagtataattattatgaaaatttataatatatttgtctttaattagacatttactattaatattataataataattcaataattcaattcagaagaaaatgtttaacatttggaactttatggttcctaaaaataatgtattgaaatttctatttggctgcaaataaatattacagagttaatataaaa

SEQ ID NO: 225516 - DNA, 338 bp, Homo sapiens
acaaaaacaaaaaattctttttctcagaatagctacattcatctcatcattatataaaagacttactaaaaattaaagccttggatttgactctaggtaaagtgcatggagaataaacatgaatcattatttgttttagtatactattagtataataattgaaacagactactcatattcctgcttatgtgacatacttgtttttgttttgttttgtttttttgagacagcttcttgctctgtcacccaggctggagtgtagtggcatgatcatggctcactgcaacctctacctcctgggcttaagcagtcctcccatttcagcccctcaagtatgt

SEQ ID NO: 225517 - DNA, 436 bp, Homo sapiens
cacataaacatacatctatgtaacctcttgccaggagtagccacgatcagaatcatgttaaagaccctctttgttcacctttataaaggagaatgttataaaaatttagaatcataaaggaactcttaagagagtatctaagctgggcatggtagctcaggcctgtaatcccaacacttggtgaggctgagggcgtgtggatcacttgaggtcaggaattcaagaccagcctgccagcctggccaacatggtgaaaccctgtctctactaaaaaaaatacaaaaattagccaggcctggtggtgggtgtgtaatcctagctactcagaggctgaggcaagagcaatagcttgaacccaggaagtggaggttgcattgagctgagattgtgccgctgcactccagcctgggtgacagagtgagactctgtctcagca

SEQ ID NO: 225518 - DNA, 375 bp, Homo sapiens
ttgatgtgacatggcagccccatttttcagtcttcctgctctgttacagtcttttccagttttaaatatagcttatcatgtaataaggactagcttagaaaatcttcagaactgtaattttatatttttggccacgttaatagtcctttggtagctatcatattagcttataacaagaaaagcatatttgtttcagaagaacattttttaatctgatgttattgatgttaggcatttttgccaaatatttggtaaatttgataattatttaagatcaaccttatagcaaaaagattgcattttacagtttttaagaacagcattatcatttgtttttatgttccttgaaatttatttaatcatttttatgaagct

SEQ ID NO: 225519 - DNA, 275 bp, Homo sapiens
gtctgatattttgttatgacagattgagccacatagttagccttctaaatgtctgtgcacatatggatatatatatatatatatacatatatataaacaaaacctgaatgagataattcttagatagtacatcatagattatagcataggtgttggctgggtgtggtggctcacacctgtaatcccagcactttgggaggccaaggcagatggattgcttgagtccaggagttttagatcagcctgggaaacatggtgagatcccatctctgcaa

SEQ ID NO: 225520 - DNA, 338 bp, Homo sapiens
agataatgttttaaagtttaatacaataattcattaaaggactttgctcaggcatggcacatagaaaggcatcggtatgggcctggcacggtggctcacgcctgtaatcccagcactttgggaggccgaggtgggcagatcacaaggtcaggagattgagaccatcctggctaacacggtgaaaccccgtctctactaaaaatacaaaaaattcgcccggcgtggtggcatacgcctgtagtcccggctacttgggaggctgaggcaggagaatggcgtgaacccaggaggtggagcttgcagtgagcggagatcttgccgctgcactccagcctgga

SEQ ID NO: 225521 - DNA, 427 bp, Homo sapiens
gggtgcggtgtctcatgcctgtaatcccagcacttcgagaggccaaggcgggcagatttcttgaggccaggagtttgagaccaccctgggcagcatggtgaaatcccatctctactaaaaatacaaataaaaaattggccaggcatggtggcaagtgcctgtagtcccagctactcgggagactgacacatgagaactgcttgaacccaggaagcagaggttgcagtgagccaagatcaagccactgtgctccagcctggacgacagagcaagaccgtgtctcagaaagaaaaaaaaaaaaaaaaaaaagaatgcaactcagcaccctgcacttagcagacactcagtcaagtggcagttgtaattaagtcatcacatccctcccctgcagctccccacagaccaggaagcctgctccctttaacag

SEQ ID NO: 225522 - DNA, 466 bp, Homo sapiens
tccacgaggatccatgccatcatggcactttgggaggcctgtcacgagttacacaggcctaggctgcccacaccccagctcagcagaaaaagagaactgcaatccaagtcagacagatcctgcctggactctccgcagagagcctggagagtctgaccagcaaagaaacagcaatcttcctacctaccccactctcaatcccccaccccaatccaggctcccgaagaagaaaaacaaacaacaacagagcaggcaattgcacaagagctgcagagtgaaggcgaggtggacggcaacggcttctcggctgtgccccgtatctcttcccagaacactgatgacaaagctggagacgttactcacatgctgagccagtcagcccctcacccagggctggtgctgagaagtctgactagaaaccggcagtcaacgctgacacactcatttataataaaaggtgtatatt

SEQ ID NO: 225523 - DNA, 908 bp, Homo sapiens
gtatagaagaaacaaaacgagagtttaaaaagttagagtgagtaaagatacgaatagaatactgatgaaattaaaatttaagtcatgaaattagcagtttttcactggaagtatgattttaattaaatattgaaagaagtttaaatttgcagtcaatacttaagtgttttggggaaatttaatttcacttttaaagtttttatttgagtaaatgggatgtaaatattttgagaatgttggtttaatatttaaaggaatgttaattgtttatgacattcataagatagatttgcaaactggatttttaaaaagctttatttagaattaaagagaaaggactcataatttaaggtgattaaagttttctacggtcagatgtaaaaatccataaggctgtgtttcctttagccctaaagctttgtaacttattggaaatttggaatggtttaactgcataacaaattgctttgctattagttaaaaaggattggttgtgaaaagacagtataggcaataatgtatggttttcctaattggctagtatttataggcagtggaaatgcaccattaagtatttatgttatttgctaccactttttcttgacaaccttagaacttccttagatataaataagttagtaaaaatttagaactggaatatgtttctttaattggcttcagtatactagatgaacattatattgctttgttttcaaaatgaggttgtaatagaaacattcagtaatagaattcaagttgactcattaagtattttataacaacaaagggaaatgagaaactatttccatttcatattttcagactaatcttatggttgtcttggatttggctactgtactaattacatgagcagtatctaataaatccagcattgttggtaaatatga

SEQ ID NO: 225524 - DNA, 505 bp, Homo sapiens
tgagtatcttataggtcctggagtttagcttctaaatttgttctgtatgcctttaaaaaatacttaagaagatgaagcagaagtgttataagctgctccagaaagcaaaactaggggagaactttctaatacccagagttatctaacattggagaaaactgtttcaagagattacgacctgcctttcagaggggtgtggtgggaaacatgtaattctccatctaataatttatgctttgctaaccctatagcatgaaggttcttcccatgggaaacctttgaaaacacattcctttttctttgctaaaagacaaatctctgttgacgtcaaagttatatgtcagtgatttaagcacaagcaaatgttatgaatggttcttttgctttagttgttacaggcttcttcccttaaaaaaacagaagagctttagaatcttttaacaaatgcctgccgtgcaactaccatattctaagatctgacataagtgccacgtatcgtctatta

SEQ ID NO: 225525 - DNA, 409 bp, Homo sapiens
gacagggtcttgctctgttgcctaggctggagtgcagtggcgcaatctcagctcactgcaacctccacctcctgggttcaagcgattctcccaccacagcctcccaagtactcaggactacagccatgagccaccacgcccagctaatttttgtattttttggcagagatggggtttcacatgttgaccagcctggtttcgaactcctgacctcaggtgatccacctgcctcaaccttccaaaatgctcggattacaggcgtgagccaccacacccagcctgaagttgaccaatcttatttgtctattctaatgaacacaaacgaacctcaccaagtctatccttaccttcccactgcctactagatctaacagttatgcacccagcctcatggcttcctcacatgcca

SEQ ID NO: 225526 - DNA, 548 bp, Homo sapiens
agcgcctactgtgtgccaggtgctgtctatctccttaggagactgtggggagtggaccacagtctggttcctcacatgcctgtcttcctgcccctgcttctatcttgcagctcagggcctggccgacctcaggttctgccagcagacctgggctggttgcccctaactaggcacacatggtcagagaaggaaacaatgccttcctgtggcccaaggactggttcgcttggtttatagcagtgacagccgttcatgcacagctgcttcccaacccagtcctctgagagagcagcagagaaagcttatgttccaatccatcatttaccctttttcttctttcttccaagcttttttcatacacacactcacatgctcactcatactcacccagcccagaagggagctgagacagaaagtccaggctttcgtgtctgataaccacactaattcatctgcttccaggttacagctccgtctagcagcaaggttgaaaaggttaaaaaggcaagagctggaaagcatttaccgccctagtgttcgttccattt

SEQ ID NO: 225527 - DNA, 203 bp, Homo sapiens
gcacgaggtgcagctaaccaccatggcacatggatacctatgtaacaaacctgcacgttctgcacatgtatcccagaacttaaaactataataaaaaaaaatgccatcatcagcttacatcagccactgatacaaacagtgcaacatcagacactgatcatgacactgagatgctgagactaaatgctcctctagcagcttcc

SEQ ID NO: 225528 - DNA, 414 bp, Homo sapiens
cttggagatagtaatacattatttggtattagcattctagctcattcatatactttcccccgagtccattctgtatccctttgaggtaagttttattattgagcccattttacagataacaaaacaagctcagagaaaataagtaacagtttaaggtcttgcactcagtgagtggtttctaatcctataggtgcaatatcgttgctaattccaccaagaaaatcctcacctgtttgtgtagggctcatgccaatcccagcttaacatggtagaaaaagcactgagggtcatcctgaggacctattatgtaccagccactatgctaggccctgaggatacaaccctgtgacccatggagcttacaattgagtaggaaagacagctagaaaattatatatgtgatatctgctgaca

SEQ ID NO: 225529 - DNA, 603 bp, Homo sapiens
gctacttctctcagacatgttgcttcaatttctcacctgaactactacattagcctcctacctggctctgctttcattcctgcctccctgcagttcattcttacagagaatctagaaaaagctcttcaaaagcaacaatcagatgtcactctcctactttctaaaaacttttaaagaggacctcttcttctgccagtataacagactttgtactccaaaggatatctctgttgcattttagaactcctaggaagtaatgaaaatatctaagaaaaaaaatacaagtagctaagtgcatatatgtcaacagtaaacaagccagaaaaggcagaattggccatcccttgtgtttgtgtgtgacggtcatgtgggggtgcaaatggggaccgtactgcaactcccagtttaagcctgggattctagaagggagataaaatagcccaggttggtagtaccactaaattccagataaagcaaatgtaatttaggcttctagttttttttcacagattgggatcttgagctttcaaaaaagattatcaaacaaggaaacaaaccaccgtgagtgaaaatcagcaaaactagcgttaatatattaattac

SEQ ID NO: 225530 - DNA, 447 bp, Homo sapiens
caaaatatggtattcataagagtttataaataatatatatatattagatcagatgaatgctctatgaagtttttactctgccacctacagtgaatatataaacttaaaagattaattgaatattctctaaccatgaataagcaaattcccattacttaatactacaatatagatttccaaagtaattaacactttgcatttctgttccgtgaaattctgtctgtagcatattaagtatacttttgtactgaaaggagtttcttcatgaccaaaaatactcttcaggggcaaagtaagaattttgtacactaaaccgtcaccaaatgattctatagggtctaacacaatcactttgttttctaagtattgctaccttatttctggaaatgctttacccctctgggagacacagtctaaccagtttgattaaagtcatttggaacaatg

SEQ ID NO: 225531 - DNA, 502 bp, Homo sapiens
tgaactgttggatgttagtggttttgctcataattttacagaagagtgagtttatttagttcttaattatccagtccagaaacaaaattattccatcaagggagttcatttttattgtgaaattttattttcacttgataaagatcttgtcagtcaacctataagtaaattaaaattaatagtatcttattgctattgaaatggctttttcttatttctaaaattagtactgttacagagggaaaataaatcaaattttaaaatttaagtttaagaaattgaaaatagaaaataaaattataatttcaaaggaactaaattattacttggcctccatcattgcaaaattttaaaatttttggtttatttgagaaacaccatgcgttatttaagtgttaaatattagttgagctaagctatgtgttttcatattttccatagcctatattatataaaataataaattatgacttactagatatatgggaaattattttcaaaa

SEQ ID NO: 225532 - DNA, 479 bp, Homo sapiens
ggcaacaacaatcatttcttctgcttacaaacagaaatttggttagaacttagccaggaccacacagtctcagcggtggtagctcagaggctggaatcactacagccagggctacagtcatttcaaagtttgctcagttatatgtctggcagttggtcctagcagttgactgagtcattggggttaccaaccagaacaactacatgggagctcctatgtatctgcttggttcctctcagtgtgttggatgggcatacaactgagtattgcaagagccgggaaactgccagtttcttaagacctgggctaggaaataagcacagcatcatttcagtcatgttcttttggacaggcagtcacagcatctacacttaagggaagaggaaataaaatttacctcttggtggaaagagtgtcaaagaattttggggtcatacttaaaagctaccacaatattgtaactttttaattgtataagc

SEQ ID NO: 225533 - DNA, 471 bp, Homo sapiens
gaaacaaaggtggaaggtgcattcttgagcatcatctactcagtgctgcctgcagctgtgcttgggagacagctcctgctgagatgtctgaaagctttggtggcattgagtatcctgtaaattatctgcttgagcagttggattccacccttcaccctccagccttccaggaggctatggaagcctccaatgatttcctgcattaaaccgagaatacctagattgacttctgttttcctgaagcagtcacccttcacatgaccccaaactgatcgttgtaaactcaactctcttcatactgtcatttctctcatccccagtatcatagcttccagtcacaatcaatcatgggcttcccctggagagtttttcccactccctggaggggtttagtgaccagctcagtgcctggcatcaggaaaacactcaatggatgtatggtaataaaataaatatatgcatgaatcttta

SEQ ID NO: 225534 - DNA, 141 bp, Homo sapiens
tccaggaaaattcctttgtaacaactatcaccacattaatttgatctttgtatgctactcagccttcactattttttgttttcagaattctagttttctttactatgatctttattgattctcattgattttacctgttct

SEQ ID NO: 225535 - DNA, 730 bp, Homo sapiens
  misc_feature (24)..(24): n is a, c, g, or t
gaagaagtgcgtttcaccctctgncatgattatgaaacctccccagccatgtggaactgtggggtctccctatgttgcccaggctgaactccaactcctgggctcaagcaatgctcccatctcagtctcccaaagtgctgagattacagtctcgctctgttgcccagtctggagtacaggtatgatcttggcttactgcaagctccgcctcccaggttcaagcaattcttctgcctcagtctcccaagcagctgggattataggcccgagaaggcaagggagggagcaggaaccagaaccagaggaggttttgcaggacttgcctatatccaggcgtcagagtgagcccagggaaggttggccatgatttggggtcttcagagagagccagatggaaataggagaggaagctgctgtcacaggggtcacacttggctcaccagagaaagtcgcttggcatcagcagctggtatgatggatttaccatgcctgccttgcccacagtggagtcccaaaaggtggccatcatcaaatgactgcacccatagtcttctgtgcttcaccctcttctgtgggcttccctggcctagcatgctccctacaccgctggactcttctccatctaagtcatgtcatggaaacccctccagagctgcagacagacagatctggctctgagtctctctactatcccttcttagatgtggggcaggaaactagcctctgagat

SEQ ID NO: 225536 - DNA, 343 bp, Homo sapiens
cagacaaccaccaggcaagtgagtgagacatcctagaccagtctgctgtcagctgcttgcagacatgcccgagaaggcaagggagggagcaggaaccagaaccagaggaggaagaagacagcaggagagatgttcttcagggtgtctgatgtgatgcctggaactgcagcagccattttgcaactgtgagggaagccagtggagtcaaaactgacctactgtggatggaaatacaaatagacagaaagaattaggttcttgataacttcatggagcttctctaagagcctgtcctacatccaggttttttttttaatgaaataataaagattcttgttgtttg

SEQ ID NO: 225537 - DNA, 540 bp, Homo sapiens
  misc_feature (24)..(24): n is a, c, g, or t
gaagaagtgcgtttcaccctctgncatgattatgaaacctccccagccatgtggaactgtggggtctccctatgttgcccaggctgaactccaactcctgggctcaagcaatgctcccatctcagtctcccaaagtgctgagattacagtctcgctctgttgcccagtctggagtacaggtatgatcttggcttactgcaagctccgcctcccaggttcaagcaattcttctgcctcagtctcccaagcagctgggattataggcccgagaaggcaagggagggagcaggaaccagaaccagaggaggaagaagacagcaggagagatgttcttcagggtgtctgatgtgatgcctggaactgcagcagccattttgcaactgtgagggaagccagtggagtcaaaactgacctactgtggatggaaatacaaatagacagaaagaattaggttcttgataacttcatggagcttctctaagagcctgtcctacatccaggttttttttttaatgaaataataaagattcttgttgtttg

SEQ ID NO: 225538 - DNA, 342 bp, Homo sapiens
gcgagtgaggtcgcatacccgaggtcacccagcaagcagtattccaacccaattctccatccgaagctctcagcagcattccggaaacagcgccaggccccctggaggagccggtctgctgctggctgcggggctggaaggggcttgcggttccctagcctccctcagagctgctgggttcctggaggagaggcttgtgctgcccccaggggagggagggcaaaattggcctaagaccaaggcagccgcaggaggggccagcctcttgcaaatgaaatattcatgggggttattgaatcaagttttattggaataaaaatacacttgctgaatacatttatt

SEQ ID NO: 225539 - DNA, 615 bp, Homo sapiens
ccatgggatttttaaaggcttcaaaattaaatatttaattgtgtggtgatgtttaaatatagtaatattctttacaattctatgagaataaaggagggaagatggaaggctcattcatttccttgaaataatgtattcgtaggataaaatatggtatttctttcttaactgtatatggaaggattgtgattccccaaatacactggactctttcaacaaaagtaaatataactgtgcattaaaacatacaaatgatcaacaaactatattacaagaacatgcatatgtgaattcctattaatattgaaagcactgaaccattttcttcactcaaagttcagggtaggtttgctagaattctgtaagaaagaatctgtaaggagagaatctttccctttttttttcagagaaaagtgggggagcaaggaagacattttaagttggccaggtccctagtggcttcacatttttgtcttctttgaaattgagaaaatgaacaaatgtcttgtattccgtgtactgatattgcatgcagtcagtttgatgagtcattagatttcatgattaattttaagaaatctttcgacctcttcctccattggagttctcactgcc

SEQ ID NO: 225540 - DNA, 370 bp, Homo sapiens
caaggctgttgtgaagattatgtgaactaaaatatgtaaggtggttggaatgggctctagcacacagctgttctgtgtttagctctatgacggtggggcagaaattttggtagttgggcccagcactttaaatacttggagcgttttagacaaggtgggaagggacttggacctgtttcttggactctgtttcttagtggaggaagaaacttgagtcaaaagaaaagggatggctgggtgcggtcgctcacgcctctaatcccagtactttgggaggcctaggccggaggatcgcttgagcccaggagtttaagatcagcctgggccacatagtgagacccccgtctctgcaaaagaaaacaagaaaaag

SEQ ID NO: 225541 - DNA, 435 bp, Homo sapiens
aagtaataaatacattattgttgagttcattttggagttatttactgtactaaaccagcctcacaatgactttgcagatttgtgatattactcttggcttttagagagagaaggacacacagtaaataatccctaaattcaaggaattgacttaatgagaatagttgaatttttaagctctttggattctgagttagtatttagatttatttgatttaagatgattgttgaagttacatgaaaataagtctttccaaaatgaaaatctttttagtaatcaaatgaggattttctgatagcaacagggtgcattggaaatgagattttctgatcagcagcagcatgcattgcactgtattggggaattgaggtaaagtaatatttaaaagttcatattattggccgggcaccttggtcatcaagagtgagtgagtc

SEQ ID NO: 225542 - DNA, 385 bp, Homo sapiens
taggctcctcctgttccccaggcttggggagctttgcacaaggagactgcccccagcctagtggcacctacctcatgggctctggggcaggtaggggaagggccagtccagctctggtaatgttggggggaggcataccaaagaatccaggggcagggagtggggagggtgacttccgagctggcctctccccttcctctacccagactggggctgggatcctctcctcccgctgtaaccatttctacctcattttgctgcgtgttgtacatggacgtatttatctcctgtctgacgatgctctgcagttgtggtctgtctacctcagaagagactgtattttaaaagaaagtattacacagtattaaagcgatgacatgtggtt

SEQ ID NO: 225543 - DNA, 510 bp, Homo sapiens
tatgaataggcctaaaacatgttaagagattaagttggaattcaaagacttcctacagagaaaaggcctcacccagatggcttcactggctaattctgctaaaggtttaaaaagaaataatatcaaaacttcataagttatttcaaaaataaagaagagcagggaacacttcctaattgattacatgaggctcatcctaccctgataaaggaccctgataaaagaaccaaagacatcacaagaaaagaaaaccatagaccaatatctcttataaatataaatacaaaattcttcaacaaaaatacaagaaaatcaaatctggcaatccagcaaaaagattatacctgatggccaagtagaatttatcccagaaatgcaaggttggttcaacataaaaaaaaatcaattgatgtaatataccatattaataaaataaaggatgaaaaccacatgatgatctcaatagacatgaaaaaaagcattcagcaaaattcagcacactttcataaa

SEQ ID NO: 225544 - DNA, 439 bp, Homo sapiens
tcattaagtaagctgctgctgcttataatttttaaattttttgtcatttggttaatatattaaaggacatgacaaggtgaagtttgccttatctgatctttaagtatcactagttaacatatagatattggagcatttcctttgtattcatgatcatctgtaaattcagattcttctaatgcttggtgaagcatttcttgacattagtgcacacctgtgtccctcccaaagtgctgggattacaggcatgggccaccatgcccgtcctcagaagactttttttttaagtggaatatttgaaaatagaaaagggccaagcgcagtggctcatgcgtctaatcccagcactttgggaggcagaggcaggaggatcacttgagctcaggagttcaggaccagcctgggtcacaaagtgagagcctgtctctacaaaaaattt

SEQ ID NO: 225545 - DNA, 542 bp, Homo sapiens
tctgaggcagaaaagtcaaataagtcaaaggctgggcagaggtttatttctcagtcacacctgcagggaagtccagggataaaatgaacaatcctgtacatttcccagttataggtatgaggcaacacttcctatatgttgggtctcagtatatgactcacaatttcaacagtggactggatccacgcatgacagcctcagtccctcctgcagactgtgtacccttagtgaagtcacagcctcacagctgtgctgaatcttggtctgagagtcaccaacccacctgtggacaggattcacctatgagaggcaattttccaacttttgtcagcttcctaatgtgagattcagagcctcagtggtgggttgtgttactgttaaagaatgacaatctttactgtcatctgggtgtgcaacagtcacaatatcacctctgtgccatatttcattaggtgtcaacatttagcatgaaaattataaaactataaacccagctcaaggcagaataatctttttgtgatttttaataaatgagacattta

SEQ ID NO: 225546 - DNA, 369 bp, Homo sapiens
cataaaaattaaaacacatttttaagtattttagccaatctgattaaacatagcacatacatacattgttttcattcaaataaattaaaagagaaatgaatgaaaagaaatttcatgtacagtaagaagacacgatgattaagaatgctgatttcctttcttccatacatggttattagcattttgccctgtgctagatttggaggaacacatatgacttaggagtttaggttaatcttctgggataacagatcttggaagaatagtgtttttgaaagaatcactgcataactacacctcctatgtacgtctatttttaactttattaagtactatatttgaatgaaatatctaacaaatgaaaataaa

SEQ ID NO: 225547 - DNA, 497 bp, Homo sapiens
catgctgacccagcatccctcctgatggtcctatgtagaaaaagatacataatgtttgacatatttatggggtccctgtgatgttttattagatgtacagagtatgtaatgatcacggcagagtgtttgtggtgtctgtcactttggtattcctcattttcctgtgttcagaacagttcaggtcctctcttctgactactttgaaatacacaaggctgggcacggtgcctcaggcctataatcccagcactttgggaggctgaggtgggaggatggcctgagttcaggggttcaagaccagtttgagcaacatagcattaccctgtgtctattaaaacccaaaaaaaattagctgggcatggtggtgcatacctgtagtcccagctactcaggaggctgaggtgggagggtcacttgagcccaggagatggaggctgtggtgagctatgatcacaccactgcactccagcctgggccacagagcaagacactgtctc

SEQ ID NO: 225548 - DNA, 539 bp, Homo sapiens
acgaatgcagacatttacatacactgtgatttgtgagtttcagggtgggatagatctagcaaaaattatgtttaatgcttagattttatgtaaaactactgtgatattgaatgccgtatgttttgattagagtacagcctgtgcagccccattatttgggttcaattttagttgtacatttatttgttgggtaactttggtcaaatttagttaacctttctatactttcaatttgtaaagtagaaatcataggaatgactacctcagaggtgttctggaaagtaagtgatttaatagagatacagtacttaggacagggggagtaaggcattcttagaagtcgctttcatcctgaccttgcctattattcaaggctgactgctaagagactagttaagcaattagatccagatcttgatagttgccctatttttccccttcaaggccatatgtgttactttcctctaatacatttgcctaaagccaaagaacaatccatctaccacttaagaatacatttattgcttttaacttaaaaa

SEQ ID NO: 225549 - DNA, 475 bp, Homo sapiens
ggaagtatcttttcagcctattatgctgtgtggtggaggtatagtagcacatcttagcacacggagttctggagtatcctctcacactgtcaaagtttagactcctctcttgttccagtggatgagaagagaggaaagaaactgtagaaatatggaggtctggtagaataagaggagtcagctaagtgaactgaaggacttaagagtgaaccccagatttctcatttgtaaagggagagataataaaagtactacattatggagttgtgaggattaaataattcatgctagattattaaaacctggcatttatgtaatattcagtgaatttagcaattatgattctatttttattataatcagtacattaataagatctgggaaagaaagggtagtgctcaatacatacttggctgatcaattgattcttaaaacaaacaaacaaaattatccttattccttcccatttgccagt

SEQ ID NO: 225550 - DNA, 379 bp, Homo sapiens
gaattagtttttgtgtttagattccccttaagtttgattaggaagtgtataaaagttcaatcttttgtaatgacagcccaccactggaaaaaaaacgaaaaacctagtgtaatatataacatgctgtttttcaaacactagattttacctagagtccttatgtgtaatacgtgggttggttaacagtccctacgtaaagcgtacagatggcctggagagaaaaactttttcagagattggagagaaatgttactacaaactcatggtaaggtcagtgaactcaatttagaagccagtgcagctagttgcatgttaacttctttatatcatcattgcctgaacttgttaaaggttccaacattttacctgtgctgcagga

SEQ ID NO: 225551 - DNA, 761 bp, Homo sapiens
gatgtctctgagaagccatcaaggcaaaagagaactttaagttcctgttccagcccgtgagtttgggaaagaacacgacacacgtgaacgacacgacacgacacacacagaacagacggacacggaacggacacacgaaatgaaaaacgaaacgataacgaaacgaacacgcaccgacagatgacagacacgaaagacgaaacgaacgacacacgaaagaaagaaagaaagaaaagaaagaaagaaagaaagaaagaaagaatccctgtttgaaaatattacctagtaagggatagaggactctgtattacacaatgaaaagtgaaaaatgccagagaaaaaattaaatgaatatgctattcccctatgacacaggacagagccagagatgggaagtgaagggcaaatgagggtgatgagccactccttccgagccaactcgtcctatcgcacttgctctgagcagagtgttccaaacactttatcaaaaataatacgttattgaagttcagagaaagaataacctcttatcagatatagcaaagaaggattcttggaaaggagacatctaaagttcgactttgaaagattggtaagatttaaacatgaaggtttcaggcagaagaagccaccttagtcaaaggagtgaggcagaaaattacaaagtaagtcaaggaaaggagaaaaagttgatgttcacataagtgaagggaagatattacataaagtggcagatggctttaaaatgcctggctcacgag

SEQ ID NO: 225552 - DNA, 232 bp, Homo sapiens
ctgaccttttccatgaatgtatatttgctacttgttcattcgttctgtcatctgctggcacttgctctctagaaatgtgaaaggtcatgagctcatccaggacttgctatcctccctgcatttagacagttcctacccacctgatgctggcctgtctgatgatgatgagcctcccaatgccagcctgccccccgacccgccactcctcactgtgccccagatgcacagtgtt

SEQ ID NO: 225553 - DNA, 531 bp, Homo sapiens
ctagggaggcccacctgcccagttccgtgctgctgacttagagcacggctttgctgatgatatccttggctccttctctgcgtcaagccgcaggtgttctctgccttctgtgattctgctcccctccctaggtggtgtcatgaagtgcatggtatttctgctggctcctaggcttttcccctgaccttgcacatacagttgcctgctccacttccccacctgcccagtcagggcatcacacccccttatccatccagtcttccttgaattttacccacctcagtgagggcagctcttcccagtcactcaggccaagaacctgtgtctttcttaacttcttttacacccctcttctggtcaataaggaacttcttggtgcttctttctgaatatataccaaatctggccatttatttcctccattatgcccaccataatgcaagccattgtcatctttagactgaactatagtaggcctcccctgccctcccctcccctgccacttagtgtcagtgttccacgaaaaaaaaa

SEQ ID NO: 225554 - DNA, 616 bp, Homo sapiens
acaaatggaatcccttcttatctgttttattctcacaatgactttttaaaacttgtaagtactgaattatacttttgcaagacatcactaagtcttagaaaacattaaagtataaatggaaatggtgcttgcattcaagaaatagatattttgtttcagattcttaaggtacaatttagaccatgaagctaatccagatgatactggtcgttagaagccctaactatttggaggatcatactaattacagtgaaactgattactttttgaaaagagaaaaactgcttgttgttgtaaaagacagtaatgaactgtaagggctacatgctgtgcaggaatattaagcatgactgctttatatctcctactgctaagcagcattggaactgaattgatgtaaacaagcctgtgtattcttgttcattattgcttttagattgcaccatttgaggattgtggtagatttggagtgagaagtactagttgttattaggagaaaattatgttttaacatttgagaaaattatttcaagtacattaaagttctgtattctacagaagctgtgtttttctgcttttgcttttagataacttggattccttaatggaatggggt

SEQ ID NO: 225555 - DNA, 467 bp, Homo sapiens
  misc_feature (2)..(2): n is a, c, g, or t
  misc_feature (104)..(104): n is a, c, g, or t
  misc_feature (125)..(125): n is a, c, g, or t
  misc_feature (135)..(135): n is a, c, g, or t
  misc_feature (154)..(154): n is a, c, g, or t
tnaaaacccccttccttttttttttttgtttggggaaaagaaagaaaaaaaaggggaaaggggcaaaaaacaaaaaaagaacccccttcggggccttctttggnttttggggttttggggttaanaaaaaaaggnacccatgttaaaattgtanacctggtgaaagaggggctacatgctgtgcaggaatattaagcatgactgctttatatctcctactgctaagcagcattggaactgaattgatgtaaacaagcctgtgtattcttgttcattattgcttttagattgcaccatttgaggattgtggtagatttggagtgagaagtactagttgttattaggagaaaattatgttttaacatttgagaaaattatttcaagtacattaaagttctgtattctacagaagctgtgtttttctgcttttgcttttagataacttggattccttaatggaatggggt

SEQ ID NO: 225556 - DNA, 178 bp, Homo sapiens
ctttaactacattagttgagtgtagttgatacatctgtggccttgtgtctataaagagcacactagattgtacccagcacttttggatatgacatgctaattagatgtatttaactattcataggaaagtgtatgataaatgactgtaatatttctaataaatatattttgtttctaa

SEQ ID NO: 225557 - DNA, 204 bp, Homo sapiens
gaatgatctacagtgatctttaacatactcagaaatatgaaaaatgtttgaatatgatctttagggacttctaatgaaaagggtatatgaaatgggaacaataaattctgtacatgtatacagtccatatacacattaagtgtttgtcatttggacaaattgaaaacttttaataaagccattttcttctttgttaaaatgcca

SEQ ID NO: 225558 - DNA, 416 bp, Homo sapiens
ggagttaaactcctgcgttccagcgattcttgatctccaaaaggactaggattataggaatgagccactgcacccaggtagttctcaggattttattagctatgtggggtcttttgtagttccatatggattttagaatttttttttctatttttataaaaaaaagtcattggtattttgagagggattgcattgaatctgtagattgctttgggtagtatgaacatttaaacaatattaattcttccaatccatgaatatgggatatcttttcatatgtttgtgttctatttaatttctttccaataatttcctttgtggagatccttccacttctttggttaaagttgttcctaggtattttattttatttttcgtagctattaacaatgggatagttttcttgatttcttttt

SEQ ID NO: 225559 - DNA, 385 bp, Homo sapiens
aatgttcatttaatcaagctatgtttttaaaagcatattaacagcatttggaatgacctggatgagattagagactattattctaagtgaagtaactcaggaatggaaatccaaacatcatatgttctcactgatatgtgggagctaagctatgaggacacaaaggcataagaatgataaaatagactttagggacttggggggaagagtgggaggaggcaagggacaaaagacaacaaatatggtgcagtgtacactgctcgggtgatgggtgcaccaggatgtcacaaatctccactaaagagcttactcatgtaaccaaataccacctgtaccccaataacttatggaaaaataaaatttttcaaaaagcaaaaaaaaaaaa

SEQ ID NO: 225560 - DNA, 395 bp, Homo sapiens
agacgttgtggggaagatctccacatttggaaagctgaagatctgcagattaggggtgacactcaaattccttaaggggttgggcagataaattgtgtaaaatggtaaggcattagaaagtggaccagactgcagaggactggagaggcacagcccacctaaagacattcaaatttggtacagatgcttcttggcttaccatggggctactgtgtcccaataaacccacctaagtgaaaaaatgcatttagtacacctaacctaccaaacatcacagcctagcctagcctaccttacacatgctcagaacacttacatgagcctacaattgggctacatcatctgacacaatgcctgttttataataaagtgtagaatatctcatgtaatttatt

SEQ ID NO: 225561 - DNA, 384 bp, Homo sapiens
acaaggatcctgtttaccaaaggactgctaagccagataaccttcagttagtttgtggcttttggttcttaatataatgaagtttaggggttaaatttaataaattagtaattacttttttttttttttttgacacagggtcttgctttatcacccaggctggactacagtggcatgatcatggctcactgcagcctcaacctcctgggctcaattgatcctcctgctgcagcctcttgagtaattgggaccacaggcattcaccaccacccccagctaatttattttatattttgttttttgtttttttttttgagacggagtttcattcttattgcccaggctggagtgcaatggcgcgatgttggctcactgcaacctcca

SEQ ID NO: 225562 - DNA, 386 bp, Homo sapiens
agactgacggagaaatggagtgagtgaacctctctaaccataggtatttttcttcataggatttaatctactcaatgaacaattttgaccgctctggaaataaacaaatgctatcctaactcctctttgctgtagcttaatctgcctgagaagagagtaaacaggaaatggtctgggagtccccagatacttttccccagttttgaggttgacatctgcagtgcaatgaaggcattgcagacaccctcagtagaaagtagggtgtaacagtacattgatagcaattttttgacacttacaaaacgttagtatacatagaaatgctgactcccactaaagagctagcagtggtccagttttgttactttttggaacttaatgataaa

SEQ ID NO: 225563 - DNA, 462 bp, Homo sapiens
gactgagtaaatgaatgagtggggttaattaactaattaattatattaatagaacaggggggaaaaaacttaaaacctaactcatagatacatgaacaaatgcagcaacctccaacgctagactgtatgccatgacccatagtgtgtggcctgctgtgtatactcaaagcctacaccctttgctcattggagtggatggatgttgtagtcatgttacttttcaaaatgaattgacttggattttgatcacaacttcgtgcacaataggcctccaatgtcagacatgcacaaggagaagagagtggtgctccccagttcttgcaaaataactaccatgttctaggttaatcttaaattgttatggggggggaagcccttaaagctctttttctagaaacagtttttaaattattcttattttgcactgtaaatttaaaattttgcagggaatatttggttagt

SEQ ID NO: 225564 - DNA, 397 bp, Homo sapiens
tagtctatggtattttgttatggcagctcaagctaagacatccagtgagccacagagatatgtgagaaagaagaacttccgttagagaggccttcaagggaattcgtggagtaggaaaaagccaacttgcattgcagtaaagcatggaattattttgaaaacagaatgctgatgagtatgggggagagtttattcacaatataacaagaataaaagaatgaatatttgaaaaattttcacggtaaattctgtatcctttttcttttgcctgaggggctttatgattttggtgaagatcatttagttttctaaagagatatagtttgggtaatcattctcctgcagtttccccgtgctatgcaggataaaataaaagccgtatgccttttcttctgtt

SEQ ID NO: 225565 - DNA, 402 bp, Homo sapiens
tgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcccgaggtcaggagatcaaaaccatcctggccaacgtagtgaaaccccatctttactaaaaaaaattagctgggtgtggggcatctatagtcccagctacttgggaggctgaggcagtggaattgcttgaacctgggaggcggaggttgcagtgagccaagatcatgccaatgcattccagcctggcgacagagcgagattccgtttca

SEQ ID NO: 225566 - DNA, 503 bp, Homo sapiens
tgctgggattacaggtgtgagccactgtgcctggcccattagtgttcttaacctgcaacatctgtccatctttcagaaagagaagctaaagctgaggattaagctttcagattattttttcagtaattaaactgtaggacagggctgagttatcacacataaccatggtcaacattttgacatacagcccagggaagtttcacatgcaaacagatacaaaactgtggataaacactgctgcttgcaaagagcttgtgacagcagtataggtgtccagttgagtgtgtggacaagggcctgcactggactgtatcttccttccatcaaggaaagcacattattaaacatcatggaagagagaaggactaacactatttccattaaataagagaagtggacattgaagaatacaattcttcaaggtttccactagtggattcaggaataggtctagactgtccagcctccttcaacagagccctagctccctcttgcagtgagga

SEQ ID NO: 225567 - DNA, 469 bp, Homo sapiens
aagcccttaagaaagggaatgctgtatttctactttttgccatcttttactgctttgctgtaaacaattagatgcaattaacttagtgaaaaaaaaaaacaagaatcagaagatttaaatatgagcctcagctttcccggtgactgtgacactacaggtaaattgccaaagttgacaaccttaagaaagctaaagaagctctttctggctacttgttaagtcacaccaagaaattagctttataccattaaactaaactcattaacctttcttggcaacaattctgtctcgcaaatttcctgtcttactgttaataaatttctcctgatgcagtttagcccattctgcctggtactaatgatagactaaaagatagtttacatcagatctcatcccttctctgctcagaaccctccaatggcttctcatctcactgaaagtaaaatccaaactccttgcagtggcctac

SEQ ID NO: 225568 - DNA, 232 bp, Homo sapiens
gcctggcaagttgagaacacagtctgagagttcaatgcctatgggctctgagccttgcccaggccacttcaccaacagggaaatgcctgccaggaggacccaacacttgggcctggcaggccaccatctccctggctctgctcccgtgggcctcaccgcagtgtgcctcagtgacatccccttttcaccgatctttggcatccaatgaacacatcttttcttcacctccagc

SEQ ID NO: 225569 - DNA, 457 bp, Homo sapiens
actgtggtgccatgttgactcactgcaacctccacctccagggctcaaaccgtccttctccctcagcctcccaaataggtgggactagaggtatgtaccaccacacttggctaatatgtgtgtgtgtatatgtatatatttttagtagacaccgggttttgccatgtcacccaggctggtcttgaactcctgtcctcaagcagttctttgcctcccagagtcctaggattataggcgtgagtccattacgccccaccgaggatgttttaattaatgtatgtgataataagcaacatgctgtaatatattctggactcatttatgacttctcattactaatgctgaaattggattcccctaagcagtggcagtttgttttataggaagaaagtagttactttctatatcagatcagttctccctcctggttccacagagctttatgtgagaactccaa

SEQ ID NO: 225570 - DNA, 386 bp, Homo sapiens
tctaattttcctataaagtaaggggaataaaatagatttacagaacacttgtgatggtctagctgatggatcactttaaaaagagagaaagaggcaaagtatgggtagtttattttcacaaatcagttttagtttttttctatgaaattaatgaacaagaagcccattaaaatgattgttacaattcttctttttaattgtttactctattaaggtgacaatacttgacagcttgatatatgaacagtgttcacttgcccaacataaacatcaattataacatgaaaatgcgatggtccttcaacccttcattcactcatccaggttaaatgcagaatttggaaagaaaccaaaattaaagttaattttacctagacttccccaga

SEQ ID NO: 225571 - DNA, 421 bp, Homo sapiens
gagtgcagtggcgcgatctcagtcatcactgcaagctctgcctcccgggttcacgccattctcctgcctcggcctcccaagtagctgggactacaggcgcccgccaccacacctggctaatttttttgtatttttagtagagacggggtttcatcgtgttagccagggtggtctcaatctcctgacctcatgatccgcccacctcggcctcccaaggtgctgggattacaggtgcaagccaccgcgcccagccgggtatttcctttttgttcactatggctaacaatactctcaaaaacatccctgaacctacagacttgctgatttgcccagccattgtccttatacattcttaaagcagaatttctgggtcaaaaaggaggcccattatatatgttcttaatgcccgttgccaaattgc

SEQ ID NO: 225572 - DNA, 451 bp, Homo sapiens
gtaattcatacagaactctggtgagcctgaattttgggtcctctttattctttttgcctttaaggtggaggattaggattgtcataaaagaactgggataggtacaaccaaaaacaaaaaaggaggagggggaaagacagtggaattcagctaaaataacagataggattatttttaaatggcttcagaggcaagacagtgctactgaaatagcgaaaatgtgactgacatctttttacagcacatactcaatgaaaatgaaagagagggttggggaaagctataaaaatgagaattcaaatgtaactatagaggatataggtttactctgatttgcctttacactaggattcagtgtctttcataaatttggaaatttaccatagacattacttcccttatgttgcgtctgacaacttcagtttttcatggattttatatttcaacttgt

SEQ ID NO: 225573 - DNA, 472 bp, Homo sapiens
agagccctcgccaatcagctcagctgaacacctaggtctgtcccttgctgcatggcacaggaagaaagaactctccgtgtgttaaatgtagacaggacctgcttactgcagcccatggagggtgtcctgaggacagctaatgctttgtgctggacacaggcctcttttgaaagaacagataaggctgggcgcagtgactcacgcctgtaatcccagcactttgagaggacgaggtgggtggatcacaaggtcaggagtttgagaccagcctggccagcatggtgaaacccccgtctctactaaaaatacaaaaaattagccgggcatggtggcacgcacctgtagtcccagctactcgggaggctgaggcaggagaattgcttgaacccagcaggtggaggttgctgtcagccaagatcacgccactgcactccagactgggcgacatagtgagactctgtctcaaaaaaaa

SEQ ID NO: 225574 - DNA, 396 bp, Homo sapiens
gggaggatgaggcaggaggatcacttgagcccaagagttcaacaccagcctgggcaacatacagaggccccatctctacccaaaaaaaaaaaaatttaaattagccagacatcatggtgtgcacctgtggtcccatctactcaggaggctgagatgggaggattccttgagcctgggaggacaaggttgcagtgagctgagatcacaccactgcactccagcctgggcggcagagcaagaccctgtctctaaaaaaataaaatcagtggaaacggacagtccaaacccatgttgttcaagggtcagttgtattttatttatttcatttaacatgtgatcactactaaaattgttgagatattttaccctgttttgtactaagtcttcgaaattcag

SEQ ID NO: 225575 - DNA, 502 bp, Homo sapiens
cattgtgtttgcagctgaagccccagtgggtgtgtgttacagggtattcttttagtttgctgtctataggcggcttgtgttaaccagctcaattagaccctctagcttgtctcaaggatggagggctttctgtattccgggttcttgccttggtgtaccagaagaatccgatcacccgtgggctaggagaatgagtgcaacgttttattgagtggaagtagctctcatctgatggtggaatcagcagggagatggttttcccctggagttgggcttctaggtggccccgtctcttctctgactgccctggccaaactccaccttgtcctgccggtcaatggcctgccagcatgccagtgcctctcggtgtgctgttctgctggcgtgctcctcttgacgaccagctgcttgggtcttccaccgaagtgttcctcacaatgtccagccgctcgtgtgtctgcccactagggtctcgggtttttataggcccaggattggggca

SEQ ID NO: 225576 - DNA, 552 bp, Homo sapiens
gtatgttgatatctatagagactatgacttcatttgaatgaagtatatatacacacatgtgtatgcgtgtattactgaagcataacttacagtaataagcacatatgttaagtgtgtgatttgatgagttttgacaaatgtatagcctatataatcaacactcatatgaagacatagaacgtttttcaccccagaaatttctctcatctcttttccagtcagttccaccaacatctcccagaggcagccactctttgaatctctatagcctgcgttacttctgccttttcttgaacttcctttaagcagaatcctatagcttatgttcctttgtatctgccggttttttgcttcacatggtgtttttgagattaatttatgctgttgtgtatttcagtggctcattcctttttatcactgagcaagagcccatgggatgaatgaattatcaccgtttcaggtcacttacttgttaacatttgaatagatctttggaatgttagaggggttttgactgtcacgaataaagttgctgtcagcattcttatccat

SEQ ID NO: 225577 - DNA, 179 bp, Homo sapiens
gaattgttgtcatatgtaatatacttttaaaattcagtagtttgcttttggaggttatgaacattgacaaatagagctatggcagaaaggatatattctatccaccttcagcccagttgagaatattatcaacaacctttttactttcctaagctgtccttatcaaatctatttcctag

SEQ ID NO: 225578 - DNA, 245 bp, Homo sapiens
cagttgttttatttgtccatagttagcttccttttccataccctggaaggtatttccagtattgttttcttatccattagacatcatatggcctctcattttacgaataaaatagagactttcatacttgactcctgcttatgtccttcccccagctggcatctgttagacttcttgctgaaattaaagtgaccttgacttctgtggcatttcacctttgattgctcccttctttcgaggttgtg

SEQ ID NO: 225579 - DNA, 506 bp, Homo sapiens
tgtcttcatcttccaaacagtgataataccaagcacttcataaagttgtgatgagagtgaaagatgatggtccatggaattcgaatttgccagaatacatctttgtacaaatgctttgactttcaatgacgctacagcctcttgtgagattgcaaatccaggggacctaaccctgtcttggtgagtcataaaaggcatcctaaaaataactactttttctgttaaaagttaaaggatgattaatgtttatttaaataaaggaaaagggaaaaagagacacaagtgagcttgaaagagggaaaagccattgtgaagacagagcggtgaaagaaagctaacacaagaaaagaacagagagagagagagaaaaaagttcaatgaagtaaaagaaatcacataaactggaggggaagggacccatgggggagaatggagacagccctgcccagatcgtgcagaagagatttttttaaaaattctaattttaaagcatattggatgtcaaa

SEQ ID NO: 225580 - DNA, 546 bp, Homo sapiens
taactaccacattacgtctccatgctagtaacatgttccatctccagtctgttgctaagcttgggtatatagagtataatataattcactgttactttgactcatgattccttgctcatcagctatattaaaccactttccatatgtttattggccacttagttttgctttttggtgaattattcatactgcttacctatcattctttgaattggttgtcttttcattatcaatgtgtaagtgctttttattaaggagactaagcctgtgttatctgtgctacttaaacattttctcagtctattaatcttctactgacctagtttttgatgtatcttgcattttttttctactttatgttgtccaccctatctttcctttcttaccgagctactaggtttctggtcttcattaaggaggtctcttatgcaattatattggtaatatagctttccaattgctcatgatattttagtttgtttataatatcagaatcctttctggaacttatttttatatgtgatgtaaaataaaaatccaaataca

SEQ ID NO: 225581 - DNA, 627 bp, Homo sapiens
ccacctgggcctcccaaagtgctgggattagaggcgtgagctaccacaagcggccaagaaacttaataggggaaaaaacccaacttcacctgaagagtcctgacagacacgccctttatcaagtgaatatccccaggaatgggatgcagagactgcgtcaccgggcaggacgcagggagaagagcacagcctcactccaggaaaaggcacagcctcaatcaaactgtggacaaacagcagaaaaacccaagcaggcagtctacaagtaactaggctgcacccctcaaaaagacaaggacagaggcctgttccagacccaagaggacaaatacaataatgagcgcaatgtgtggccctgggttgggttatggatcagaaaacaagaatgttattgggacaatcggtgacatctgagtgtgggctgcggagtagatagcaccaggacatcagtgtaaaatccccgattttgatcactgtgctgggagtacgcaagagaatatccttgttcacatgtttagtgataaagggttacggtgtctgcaacttagtttcaaaacgctcaaaagtcatcatcatctgtatgagtttagagggaataataaagtaagccagacaaaatgttaataa

SEQ ID NO: 225582 - DNA, 297 bp, Homo sapiens
aaaaaaaaaaggtatttaagtagttgggcatggtggtgtggtagcgcacacctgtggtcccaactacttgggaggctgcaccaggaggaacgctggagccagagaggtagaggctgcagtgagctatgatcacactgctgtgctccagcccgggcaacagagcaagaccttgtctcaaaaaaaaaaaattaattttgatgttaaatgaaaaagtaaaacaaatgcaatgtgcgtgtatacatgtagtatatatgaaaatgcatgtactcccagttgcacagccactgaacaattcga

SEQ ID NO: 225583 - DNA, 609 bp, Homo sapiens
attgaagtcaagcagagaaaaatgataattgtatagaaaagtcccagagacttcaaggattaccacatttagtacttaggtaaaggggttggtctcaagtagaaggctaatgatagtgggttggtagatacgtaagtgaaactatgacatgctttgagtccgtctgattgtcacaataactctataatgtaggtcttactgttttacagaccaataaattgagttttaaagatgttaggtgaagaacaattaaattctagaaaactttggtgagatggggtccagcatttgtacagttgaagcaaataaggtatttatatgttatagatgaaatgatttcaaactgccaggagttatttggtacagattgtcagtaagcacagtacagtgaacatgcatgaatttgcagaaagtagatgaggggaaattgccagaaataatcctagtcaaaatggaccttacctaacttacttcagttttctctatttcttgttttgacccccaaattgaacatcggttatttgtaagcctgtaaaaatactcatttctgggtcttcagtgtctctcattaaatgttgttagatgtgtagacatatacctgacttcaca

SEQ ID NO: 225584 - DNA, 496 bp, Homo sapiens
catacagtgtagctgggagtggtggcgggcacccataatcccagctactctggaggctgaagcaggagaatcacttgaacccaggagacggaggttgcagtgagccgagatcatgccattgcattccagcctgggtgacagagcgagaccctgtctcaaaataaaataaaaaagatgagggagtttccaagaggatgagactgagatcctcctagattcattttatagactgttgttctctaccagattctgtgttctgctgctgatggtgatatttgcttaatacttcttatataccaagcacatttataaactcttattctcgtaacaactcttttactgaactgctctttcaaaagaggaaattgaggtatggggtgatgatctaaggatacacagttaaatggtggagctggaatttaaacccagagagcctgactccagagctcactgtggtaagctacctgcaaaaaaaaaaaagatagctcctggtctt

SEQ ID NO: 225585 - DNA, 432 bp, Homo sapiens
  misc_feature (325)..(325): n is a, c, g, or t
tccaaacagggcaggtcttcagctgattagaggttttgattctacagagaaagtcaggacttccccggggcctgagctgagtcagccttagtcatccccaggcgggacaaacactccaaatcctttttattggcagcctccctggtgtgccactttttccgatggtttccttgtttttatcaaggtgaagataccctaggacttgtgaagaatcagttatcaggtttttaggggatgagaaatccagctttatcaaaaggaaaagatagcaaagggaaccagataacagccagttctactgtgaaaatggtagtctaggccaggncacggtggctcacgcctgtaatcctagcccttttggaggctgaggcaggtggatcatgaggtcaggagttcaagaccagcctggccaagattgtgaaacccccatct

SEQ ID NO: 225586 - DNA, 461 bp, Homo sapiens
tgttctttggctttataatgtagaaaatatatctgactcagaaggcaaattgggatttgactgcaactctgacacccgagttcccaatctgtgaggcttagttctcgaggctgcaaaacgaaggtagcattggacccaagaagaatatgagaacctaatgaacgtgctctaatatcccccatggaaaggcacaatggtattttttttaaataatcatgattataataacagaggtactttacaattggcacaaaagttaaagctggaacaaagcaggcaagattaacatggccactctgtaagaataatatgcaaatctataaggtattttctatagtgatgaacaatgatttgctccttaatctacattttcactgccctttatctataccttgatgatagttctcattatactgtgtcataattgtgattacatatgacaacacttctagaaagtgagt

SEQ ID NO: 225587 - DNA, 202 bp, Homo sapiens
ggaacccatctaggataccacacttacatttagttttcaggtcttcttattcttctcttggctgtgatgatttctctgataatctttattttttatgttcttgacaatttagaggagtactggtgagggatattgtagaatgtccctcttttgtgatttgtccaatgtttttctcatgattagactcatgggtttttttcct

SEQ ID NO: 225588 - DNA, 773 bp, Homo sapiens
gcagctcagcaccgtgaggccagagcatgggggaagggcataggctcagtgagctgcaaggaacacctgcctcagacaagggtccatgaggtgactgactgtccctgcatgtgtggggtctccttccacagtgcctaggacagagtccccagatactaggtgtggtgccagtctccagcacggtcaccggcgatccccaccagcgatcccagcctttgtgttggtgcctcccacattaactatagatgatctatgtgaccaaaagaataaagaggaagtgatgatgtcgaattctaaggctaggccacaaaaagaactgaagtttccatcttgctgtcctatgttgttcactctgggggaagccatggggagacctgcacagccctgtggagaaactcacagagagagaaaccgaggcctctcaccaacaactggcaccaaccagccaggcgtgtaaactggaagcagattctcatacccagtcaacaccctgcctacatttccaaattcctgacccaaagaaacagaaaaataataaactattactgttgttttaacccactacatctgagaataatttgttatacaacaacacatagctaataaactggacaagagggaaaagagctgcttcacagcattgtttccagaagtgtgacgtatccatagaagaaccaaacctggtgtcagggccagaggccaccaaaggccctgactaagcccctaaggtcttagaacactatatgagaaaaaacaatgaccttcacggccca

SEQ ID NO: 225589 - DNA, 494 bp, Homo sapiens
gtgagatgggattgccagagctcttagggtgtttagttctccccaggtacttttccagaacattcactgtgcaaactttgatagccttaccacattgcactgtcctgacaggattttatgtacgtctccctcaatagataagctgcttgagaacaatgaccaagacttatttatgttttacatttaggaccataaattttatataaatgaatgaaagaatgatctcctggggcgggtgggggtggtctgcattatgataattagcaaactgttttgttactgtggattttgctaacagttccatttttaaagtacttcttatcttcatacaattttgattatttgtgaatacttttatagaaatcattaaggaaaattgacttggggaaaagtatatttctcagactgtcttgacattagtgacttttgattgtggaaaaactattgaacacaagatggcagtataccgttaactctgaaaacaagacaaggaa

SEQ ID NO: 225590 - DNA, 594 bp, Homo sapiens
agggactgtggagccaatttgtattagagatagtagcctggattttgttctttctttgactttacaagctcttcttgctctgtgggtattgttttccttatctggaatgtgggatctgatgatttaaaccacactattgttgctgccttatcttcctataagaaacctgaaccattttcttctttagatggctaaaatgtctgttttcaaataggacatggccagtagaataaatcttccatttatttcttctgaggataaagcagacagaataagttagagcattatcatgtgcaattatggttaacctacttttatttcttcttgaattcataaagtatgtctttatgtcacaaagctgggaggaaaataacagctccttagacattccattgaacagtgactttattatcttttcctctctgtttctcttcctctctttttttgcctgtgtaaaacataatgtttatacattttgtaacctttctaaagctttttgtgtggagggaagcatgtttattccataaaacatattcataggtgcttgatatcaagatatgataatctcagcatttaataaatattttagtgata

SEQ ID NO: 225591 - DNA, 395 bp, Homo sapiens
taaaaaaaaaaaaaaaaaaaaaagaagaagaaaacaaaaacaaaaaatcttggtctgtcttaggcaacaagcaattaaaaaaaaagtagaaaataaagcaaaagggccgggcgcagtggctcacgcctgtaattccagcactttgggagactgaggcgagtggatcacctgaggtcaggagtttgagaccagcctcgccaacatggtgaaaccccatctctactaaatacaaaaattagctgggcgtggtggcgggcacctgcaatcccagctacttgggaggctgaggcaggagaattgcttaaatccaggaggcaaaggttgcagtgagccaaaatcatgccactgcactccagcctgggcaacagagcataactccatctcaaaaaaaaaaa

SEQ ID NO: 225592 - DNA, 508 bp, Homo sapiens
atgggagaataatttctaaatttctaactgttcatcaatggatttggatatatttagatatagacaaatatatgcacactgcaagtttgcacatgtgtatataaatttatatgagatacccataacgtgtgggttgtataatcttttaattaattctcaattttacatgtggaaaacttgattaagtgtttaccctcatcaaatactcagtttgaagtactatactcaatttgatgtaaagccagcaaaatctctgccaacattcatttcaattaatccaataatgttaactgttgataacttcattctccttgtcccctgttaacagctgaaagttgattctcaccctaattcagcaatcagggtgtcatcctcaagagactatcaccttgctttggattgtgacctctgactccaccactttcatcctatagcagtcctacctttgtgtatttaatcaactttgtacatggttaaaaaaataaaagtgcagtgaaatgtcaggcca

SEQ ID NO: 225593 - DNA, 482 bp, Homo sapiens
cactccaacttgagaagcactcctttcccctctaactacgaacagaactggagagctactttctggctgggtgacttggggaaatttgtaaacctcttgagatgcatcagtaagatgggcataatgacaggaaatcagcagctccaagagggcagaaactgtgctcctgtttgctagccctgacctcatacctggtattcagtatgcaggaagaaggtttagtaaggcctaaaattccccaaggaaagaaagcatgcctcaagactgtgaatgccctccagacatttacaactcatactgatgatttagctccctttcagtagggtctttcctatattatttattatttatgtgctggggcagagacatgaagaaaatggagctgtttagaacaggagtttgcaaactgcaatggccagtgaaccaaatccagctcaccgctcactgcctgtttttctaaataaagttgtattggaacacaa

SEQ ID NO: 225594 - DNA, 664 bp, Homo sapiens
gagaaaccctgtgaatgtaagaaatgtgggaaagcgttccataatttctcttctttgcaaatacatgaaaggatgcacagaggagagaagctctgtgaatgtaagcattgtgggaaagcattcatacctgccaagatcctttgaatacatgcaagaacacacaatggagagaaaccctatgaatgtaaagaatgcagaaaagcattcagcttgcctacttcctttcatagacatgaaaagacattggaaggaaaccctatgaaggcaagcaatgtggcaaagctttcacttcttccagttcttttcaatatcatgaaagaattcacactggggagaaaccctatcagtgtaagcaatgtgcgaaagcctttatttcttccacttcttttcaatatcatgaaaggactcacatgggagagaaaccctatgagtgtatgccatgtgggaaagccttcatttttctagttgctttcgatgtcatgaaaggactcacactggagagaagccctatgaatgtaagcaatgcaggaaagccttcagatcagcctcacaccttcaaatgtatggaaggactcacactggagagaaaccctatgaatgtaagcagtatgggaaagcattcagacctgacaagattctttgaatacagataatgaatgtaaac

SEQ ID NO: 225595 - DNA, 170 bp, Homo sapiens
gagactgagcacccaagagttttaaactgtcaagtttgtctacactgagtctcaacaattcatgaattattacatgtttgtatgttgctaaaaatactggcttcatctgtggtcctctgaacctgggctttagtttctagaattgagaataaattgtgattatctgtctt

SEQ ID NO: 225596 - DNA, 500 bp, Homo sapiens
gcctatttctaacctttatcctaacacgaattttatccttgtcccaatttaaaaaactttttctcttaatttaaaaaaaacaattaatagctttattttttagagtagttttaggtttacagaaaacttgagcaagagtacagggtttcaatgtactgtcatccaccccagtttcctcattattaacatcttacatttgttgcaattgatgaacgaatattagtatattattattaattagtggtttatattagggttcactttttgtgttgcaaaattctatgcattttcttctcctgattttttttttaaaggcaggatctcagtctcccaggctggagtgcagtgatgcgatcacagctccctgcaacctccacatcctgggctcatgtgatcctcctacctcagtctcctgagtagctgggaccacaggcacacaactatgtcaggctaattttttttttttttgagacagagtttgtctcttgttgccgaggctg

SEQ ID NO: 225597 - DNA, 223 bp, Homo sapiens
tctggttaacatatggcatattccttcaagaatcttctctctctcagctctagcagcatggggctgactcaccaagtttctacatcttggccagcattcaggtagggagtgaggtaacaggcttttcacttgaagatcttcatagtctctatgactgctttattttgcagggaggagaaggtagcttaccctcatttgtattctgggtaagggtgagaaggca

SEQ ID NO: 225598 - DNA, 434 bp, Homo sapiens
gaggctaatggactggcacaggtgtgtgaacatcaagaacactgtgacatgccactgccacatagggaggagcagcaggtgaggagaggccttccctgttctctgatacccaacaaacatgcaagctctcaacgcctcgctccatgatgcccgctgctcagcttctctgcatgggcagtttctgaatttcacctcaggcccttgaaggggtcagtctgagtcctttccaagaaccctacaactgccttccactcatgaagacgctcatggccctgaaagcatggtagccacccagaatcagacacctgtagttatctcctgcctggggctctggcaggtggtggtgggtgtcaggctgactggtggatactgggatgtgctggcgtattccctctgtttttaatatgtttggaaaatttcattaagcaaaaaaa

SEQ ID NO: 225599 - DNA, 212 bp, Homo sapiens
ggggtatactggcatcaacaaatgatcggggaaatgcacttcctcttctgttttctaaagtaacttcagattaaaattaattctctttaaaatgcttgataaaatttcctagtgaaactatctgagtctctagttttcttcgtgcattgtattggctattttttattagacatagggttagataggttttgtattaatatctttagggaggg

SEQ ID NO: 225600 - DNA, 347 bp, Homo sapiens
gtaaataggataattaacccctatagacccattcctcaaattgaacaatttcattgttttgattttcatcacacttgctggatctaaccattctttatctctttctctttccgtgcctttctctctttgttttcttagttcgtcatttaaggcgtatctttgacaccatgtcacttcacctcaaaatatttatgcctttgtttttttaaattgcttttaaaattttttatttcaggtttgggggtacatgtgaaggtttgttgtataggtaaactcgtgtcatgagggttcgtcgtacagattatttcatcactcaggtattaaatctagtacccaatagttatttt

SEQ ID NO: 225601 - DNA, 501 bp, Homo sapiens
cagtgatgcttagaatggtggatggagttctagctgcgtttttgctgcttcacccctggggaggccacgcctctgagaaagaggctgggaggcccttccgcaacaggtgttcaggtatgagtgaaagaatctaaggagtgagcttggagcactgcacccacagacaggaccatcattaggagcacattctcagtgcgtgttgaatgttacgaaaaggtttgatttatacatttttgacctaaatagaatttaatcaaaatgtctagagaatttttacgggttactagcccctcactttttctgaagtactaaaagcagaatcaggaattcaagattatcatgttgagtataaagcactctagtcttcctaaaggaatcagtgtcagactgggctggtggttcacacctgtaatcccagcacttaggcaggctgaggcaggaggaccacttgagcctgggaatttgaggccagcctgggcaacagagtgcgaagtccctacg

SEQ ID NO: 225602 - DNA, 314 bp, Homo sapiens
ctactagtgtctaataaatatgtgcatgtaagattatactcataaatttgcataatttgctctacatgtgtgttctatttttatatattgatttagtgagctgagcagacacatcttactgtgaggaaaaatccttttccctgaccaccaatgtgtccctaagtagtgtgatgtgaggggacagtacttttaagggtatggaggagggaagtggttttactcaagattcttgaataaatcatgcagtcactgctaagaattgatgagaaatagacgtcgacgcggccgcgaatttagtggtagtagtagtaggc

SEQ ID NO: 225603 - DNA, 423 bp, Homo sapiens
atcactggcatgtagaaatagttgatatttacatattgattttaaatacaaccaccttgctaaactcttattaataacttactcatgtacgtagtcataccatctgtgagtcaattcagttttgtatttctattatttatacttaacgtgtttatataattgttttaatgtgctgtttaggacaccattataatgtttactgtaacataatgtttcctttctgtgggaaaactttcagtatttcatagttaagtatcatgtttgctgttaagatttttatagataacctctatcagactaagtaatttccctttaattcctagttttttttattgtgaatggatgttaagtttttaatgttgttttttctgtatttattgaaatgatttatgatttttttttcctttaatctgttaacatggc

SEQ ID NO: 225604 - DNA, 388 bp, Homo sapiens
atgaaattcaaatttcagtgtccatagagttttactggaacatagccatggttgtttcttttgtattgtcttattttctgcctctccaagaaagcttgctgactcctggcataggccaagtggactaggggcaggtgctttagtcagctggaccttggagaactgggcaatctcctccactccacagctctatacatggtggctgcccttcttttcctactggccctcccctggggttccagagtaccttttgttcaagccagccccacttgacccagggcactgggatctagatttctgaacaatgagccaaatcattgcagaatcatagggggaatcaggacaaggctgttttgagattaaaatgaaataaaatatgtgaaagtac

SEQ ID NO: 225605 - DNA, 627 bp, Homo sapiens
caaacttttacaagatgagatggagatactattttttaaatatttgttttaatggcatagacatcataaacatttttaatcaaaggaatttcttaatgaaaacaacgtggattcaattcaattgctttgtgatggagatctaggtgtgacactctgtgatgcagcaatgtagagttccaagttcggtttatgggtacttggtatttagggttgaagtggttggaaagagggtcatagtagtcacctggggtgtggttcttgttaatgatagtggatgtaaatccatttctcaaatagccttcttgatgattttgattcttttgggtggacttcttgtcagctctgcagtcatcattgtgttactcttgtgatttagctgacgaagagcttaagctaagtagaagcattagcttttccaatttttaaattgtctgcttttgcttaggtggttatggtctttgtaggaacccttgaatgtcattttaaagtccattttgtgtgttgaaaataaatgagatcattcatgaacacagtccactgagtaccttaacctccaattcacaggcacaaacacagggtgtattagtccgttttcacgctgctggtaaggacatacccgagactggg

SEQ ID NO: 225606 - DNA, 520 bp, Homo sapiens
actcagaaactgacaaatgaaagagatgtctaggaaaaggaacagttgtgggtgaaggtaatcctggaaatagctatatttaaagaaattcccccattctttgtgttctcaaagaacagcttagtgaagagaaacgtgcttcccattatgactttgtggatgttcccccccccccccttttttttaacctatcacaaagacggacacagattacaaattcctatttttaaaaatgaacaaccattctgtaatttagtcttcagtggtcaaaacagagtacttgttaacaaaactttgcttgttccccttcttccctcagcccctgaactttgactcacccacagcctcagagaacctacaacccatatttatacatatccctcctaagaacaggctgacttcaagatgaaacattatcttatctgggatctgattttgctaccctccatcctgtgcttcctttccaaccttctttgtaaacttattttctcctccctatgaaataaaacccttttccacc

SEQ ID NO: 225607 - DNA, 302 bp, Homo sapiens
gttgctataaggggaagttttcctgcacaagctctctctttacctgcagccatccacataagatgtgacttgctcctcctcgccttccgccatgattgtgaggcccccccaccagccatatggaactataagtccaattaaacctctttcttttgtaaattgcccagtcgcgagtacgtctttatcagcagtgtgaaaacagactaatacagtaagtcatttttgcctgagattagatattacagaaagtcacacagaagtgttccatgaagtttagaaataaaaattctagaagacataca

SEQ ID NO: 225608 - DNA, 559 bp, Homo sapiens
catcagactggcacaaattaaaggtacacacaacacattctgtggcaattctgtggaaacaggcaatctcatacaccgttagtgtgaaagcaaaatacaggagaattgttaatatctcacaaaactacataggcattaaccttcaacacagtaatcgcacttctaggaatttatctcaaagatacacctctaacaatattcactactaccattacaaagtattggaaaccacgtaaatatataaacatgagaaactgaatgaataaactatcatatatacacacaatggggtattacatggaggtaaaaaaaaaaatgaagagctttatgaattgatatggagtgatttctaggagagatgctgaagcgaaaagagcaaagtgcaaaagagcatatataggctattacctttaaaaaacgggaaaggggaaatatatatatttatgtacagtcacatgtcacttaatgacagggatatgttctgaaatatgtgtcattaggtgattctgtgatgctgcgaacatcagagtggacttatacaaacctagacggtataact

SEQ ID NO: 225609 - DNA, 499 bp, Homo sapiens
cgcatcctgatcagaggcacagctgagacccagctgcactcctctgccctgtccttttagcccaagtgctgacatcaatggctgatccaggaccagaaaaaggctgagcggagagccgtgctgcctggcccctcctcaccgcccttccccgcacctcttggctgtaccgggagcctctgagcaccggaaatgaagggttttccaggcctggctcttcactccatccttcaggggaactttgaagccatggagacatctggctttggagccatggcgattcccctgccactctccttgctgggataaagccagggcgtggcatcctgggatgatgttccctgctgctgagtgtgcacacaacctgagctcatcctgtgtacgtcagctacacatgctcgcatctaattttctcaacaacctagccagtactattgcttctcctcctcttacagatggggagatgatgacatatagaggttaacttatcagagaccacaca

SEQ ID NO: 225610 - DNA, 397 bp, Homo sapiens
cgcatcctgatcagaggcacagctgagacccagctgcactcctctgccctgtccttttagcccaagtgctgacatcaatggctgatccaggaccagaaaaaggctgagcggagagccgtgctgcctggcccctcctcaccgcccttccccgcacctcttggctgtaccgggagcctctgagcaccggaaatgaagggttttccaggcctggctcttcactccatccttcaggggaactttgaagccatggagacatctggctttggagccatggcgattcccctgccactctccttgctgggataaagccagggcgtggcatctgggattagtggcacccaccaccacgcctggctatttttttttattattgtttttagtagagacagggttttgc

SEQ ID NO: 225611 - DNA, 503 bp, Homo sapiens
atagtgttcggccataaagagcttccacacgggagctggagcccactgaggcctgcggagctgctgtactgccctcggtgggaatgggtctgttcctactggactgtggaacaagggtgcagagagcaaaggggaccctcttctgctcttcatcctcctgtctcctcacccatgtcagccttggcaaggacacagggcctgtggggtcggggaggggcagtgagatgcagggaggtgtttgttagtcacttctgagcccccaggctgccttaaagaccctcccctacccttggggcccagaatgaggacagggtggtgatcctgggccagggccctcaggaaccagagagctatgggcaggggtgggcctgctcttctctgtgactccacctagtgtccctggtcagcagtcttcctcacctcatgccggggagagtaggggcgaggagagaaggggggcccccagcacactctgctctcccagggaggtggggaggcggccg

SEQ ID NO: 225612 - DNA, 372 bp, Homo sapiens
ggacaaagaagggaatccatgtgtggttctctttctggacccatgtttgattaaatccaaagttccctctcctgtctctctctgctccctgtccattctggaaagcagatagacagacaagcagagagacagtaggatgaaagaagctcgaggcatcctctatcccagcagctattaactacagtagtctctcagtatcaaagaggaactggttccaggaagctccagacaccaaaacccacggatgctaagtcccttacattaaaatggtatagtacatacgtatctgcatataatctatatgcattctcctgtataatttgaatcatctctagattacttattatagtagtatacaataagttgttgtag

SEQ ID NO: 225613 - DNA, 248 bp, Homo sapiens
gtttgaggtgggaagattgttcgagcctggaaggttgaggctgaagtgagctgtgatcatgccactgccctccagaccgggctacagagtgagaatttgtctccaaaaataaataaattcatagactactcaagtgataaatattaaaccagagactgctttaaacattttaaagccttattatactgtcatactgtgattgtactgacatatttattcatttaacaaatacttactgagagctattt

SEQ ID NO: 225614 - DNA, 1869 bp, Homo sapiens
tgacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacgtaagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatcttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcttaaggaagggcaagcaaagacagc

SEQ ID NO: 225615 - DNA, 1705 bp, Homo sapiens
tgacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacgtaagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatcttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcttaaggaagggcaagcaaagacagc

SEQ ID NO: 225616 - DNA, 287 bp, Homo sapiens
gcatggtggtgcatacctgtaatcccagccactcaggaggctgaagtgggagaattgcttgaacccaggagatggaagttgcagtgagccaagatctcaactctgcactccagtctgggcaacagtgagactccatctaaaaaaaaaggaaaaaaattcaaatttccaagagctgtttcttgttttctgattgtttcctttttcatttaatactatgcttatctctggatgcctttgatttatcctctgaaaataatagttttattaaaaactactttttatttaac

SEQ ID NO: 225617 - DNA, 1053 bp, Homo sapiens
cctttttaaggtttgtgctgcaaattttggtgatatttgtcatgctgttggacaagaagccactgagaaatttttgatcccaaagttctttgagctctgctctgatgctgtttggggcatgcggaaagcctgtgcagaatgcttcacggctgtgtcgcacagctcctcccctggggtccgcagaacccagctcttcccgctcttcatcagacttgtcagcgacccctgccgatgggtgcaccaggctgccttccagtcccttggccccttcacttccacctttgcaaacccctccagggctggcctttatcttcgagaggatggcgccctgagcatctggccactcacccaggatttggactctggttttgcctctggctcccctgctcccagcagtggtggtaacacttcccctgccaggtatgctctggctagggtcaccaccaggaccctcgatgtaccttaagcacccacctaaaatttcagcaattatcttgtctcgagttttagtagtgaccttctgggcaagatggaatattagagctttaattatgtaaagaatcaaaaagtaattgcaataatgattttgaaacatgactactgggttataaataatgaagctactatgtctcctaaatttagataaaatattcattgagattagtgattaaataacctataaagaacattttctcttactttttgatgaatgaagttctctgggtaatttacttagggaaaaatgtgaagtctcccaaatgtacttttttggaggttgggttacatgtacataaaggcgacactcctgaccaacagcggtagaccctccagtgtttgctaatatggcgctggatcttggctttgtcatgtctttcctctgaggctgatgcgtatacaccagccatcctatttgaggtcgtttgtaaatgtctctccattgtcgctagcgtgcaggcatgtgagagtgggtaactgatgcctcacagaatacaaatccttccgaggttggcccatcctccctccatcccacttccatcagagttcattgagctc

SEQ ID NO: 225618 - DNA, 437 bp, Homo sapiens
gcagagagtcagtatacagcagtatttaaagaagaaactggcatgaagagaaaaaaaacaagagcctgaaaataagatctggcagggacgtgattaagaggtggaaaatcaccggactcggtcggcgtgtgactgtctgatcgtggcatgatgaccagctcagcatgtagtcgacagctaccaatttaaatgagctgggtttatggatggctgcagaaatcctctttactcaaacccagtatctatccatcagccactgcgcagcactttactgtggaggcagcggggggacagctcatcagaatcgccccagtggaatgttacgataggaaaaaagaggaatggattacatatttatgtggtctttgaaaatgcagtgggacaggaagattgcttgtaacgtatgcagttacattaaatgactattaaccttcact

SEQ ID NO: 225619 - DNA, 576 bp, Homo sapiens
agtttaagtaactgaccaagtcaaaaccaagaagaaataatagagctgggatttaagctttactttgccttcagatccatatggccaactatatggataagtagcaaacttatgacccttaggccaattctggcccttggctgtttttgcacagccagccagacaactacaaatgttttttacatttttaaaaggttgtaaaaaaataaggaaaaaatcaaattgtattagacagtgtatgtggcccataaggcctgaaatatttactatttgaccttttgcagaagaagtttctcaacatctctattatgcttttactacgaaaacatttttctttagtagaaagttgagaaacagtaatctttacagataaaagacatgtctggtcataaaatcagttagttgtagaatgagaacagtgtactcacagttacttctgtggcacaataatttttttttattgttgccagtttaaaattaagaactgtgtttaaagttacttgagaagatatggataaaaggcagctgggctagtgctgttatttaactgtgatgccctcattaagaaaattgatt

SEQ ID NO: 225620 - DNA, 595 bp, Homo sapiens
cagctctttcaggaacacattcccagtgggaattttgggtgggattcaggaggcaccgatctgccagtgagggatttctaggaacacaaggttagtcaggacgtggatccccacagtggacacgactgccccaccccgccgaggtcggaggtggccttgaggagctgggccgtcgcttgctgtctgagcttccatccacgaatggtgtgggagttcgggatcttcccagacattctttcttcacctttgggaagatggagggggacggtggtggcatcccttgcagtctgtgctgcgctgacactttggagaagtgtctcccatctgtagagcagaatcctctttggagaaatgcagctgtccttgaccttgaggcagaaggcgtctccatcctgggcatctgtctgcccctccccatctggatgcctcatcttgctgtgtcattaatggtaatcttattctaacagcctcccatgcatcaactctatcagtccccgaatattatctttaaattttgtcagatcgctttgtgggtttctggctttttctcttttctatcaagctattcaaagcaaaaactgaaagtgaatttaga

SEQ ID NO: 225621 - DNA, 163 bp, Homo sapiens
tatttctccaccttcactggctgctctcctctagctccacagtctctacaacccaggtctacactaacacacaagacaatgtaaactgttaagggcttcacaacttatttctgacatggattgctgtgttaagataatatgaaagaaaactcagtgaatataa

SEQ ID NO: 225622 - DNA, 532 bp, Homo sapiens
gaaaatgtggaggtttctaatttttgctactgtaaatagcactaataaataccttgagcatgaaaccttttccattatggattaattttataggatagttgtacaaaaatggaattttactaattatgagggtgtgactttttatgattctagttatatattgccaatttatgtctatttttaagtttcattacacccttacttccattggatatagtcattaaaatagagaaaaaaaacttcaataactaaaggcaccttattgctatttaatttacattcctttattattattttttaaattattattttttgaggcggagttttactcgtcacccaggctggagtgtaatggcgcgatcttggcttactgcaacctccgcctcccaggttcaagagattctcctgcctcagcctcccaagtagctgggattacaggcgcctgccactacgccctgctaatttttgtatttttagtagagatggggtttcaccatgttggccaggctggtctcaaactcctgacctcagg

SEQ ID NO: 225623 - DNA, 373 bp, Homo sapiens
aatgatccctgaaagaggtggtgtctcccggggaggtggaaaacatgaagggttcacctacgatgacgacaggggacccgaaagaggccagtccaatcagggaaagcaaatcctcctagagacatcatgacctcgagaagccactgaggatttaaaggggccgttcagggcaatagctgggtctccttctaactcgaaggacagtcctctaagcccctggcagcggagggagggcgggcattgtggctgcgtgggcctgctgaggcggccagccaggcagctcttacaggattagcttgctgctttcaggaaaggtgccaggtgaggctaagatgcccagccagatggaggggggcccagaaggaagggggtg

SEQ ID NO: 225624 - DNA, 631 bp, Homo sapiens
aggagtgtgggcccctggccaaaggaagagcaggctgaagagataaaaatggagagaggcaggcagcagacagtctcagaagggcattctcttcctgggcagtgtttgtccccttttttaaagcagcaagatcctttcttctcacccacagcactgagacagggctgctctggctgaagcagatgaagggggtctgagccctgattgctgggacatgagagctaagagagaggggaaagagtccaaggcctgggccctcagactggacagcaccaattatgaggaaaggggaggtggaaaacatgaagggttcacctacgatgacgacaggggacccgaaagaggccagtccaatcagggaaagcaaatcctcctagagacatcatgacctcgagaagccactgaggatttaaaggggccgttcagggcaatagctgggtctccttctaactcgaaggacagtcctctaagcccctggcagcggagggagggcgggcattgtggctgcgtgggcctgctgaggcggccagccaggcagctcttacaggattagcttgctgctttcaggaaaggtgccaggtgaggctaagatgcccagccagatggaggggggcccagaaggaagggggtg

SEQ ID NO: 225625 - DNA, 527 bp, Homo sapiens
ccatgaactttaatattttaaagagatgttttaaattgaatttatacatgtataataacccattctactaaaaatgaagttcataatttttttcaagaaacattgtgtctgtgtggatgcaaaaagagtaactcacttatgttgaggttggtgagtaagctcatgtgccctgttagcgtttaatgtttatatatatatttttaaattactgaatttcaaaatatatgttctttgttatcttaataaaaagacctttgtaaaatcagagatatttgttcctcctaatgtagaacacataatttctctttaaattggccttttgggatcagtcatatgataaaacatggctgcttttctagctgtctgggcttttggcagactggtttccagacccagagactgagtagtaaccaatggctggcatgattatggtatttaacttgagtctgagtgtgggtaacctgaacttctttggagttctcttttcacacttgctgatatgtacaatgaccttttatacttagcat

SEQ ID NO: 225626 - DNA, 507 bp, Homo sapiens
ctccacagcctgccctttgctctcctgctcacactgaccaagaatgccgcgtgcttggcctactgaggtgaaaggacaattgaatgacaggtgggcaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttcttt

SEQ ID NO: 225627 - DNA, 519 bp, Homo sapiens
ctgattcactagactggagttgtctgattgtggagcctgtgttgtattataaatatatgtttagtgcctaggatattgccagccacataagagaaagaatgaataaaaaagagaacaagtatatgggctgtatttacttggggctgtattaatacttctgatagtaatagtctccaatataggatggctttacacaaacttgcttctttcttaagatattctgtaataatttgtagttatcaattttgggaagaatcacacctgtaatcccagtacttcgggaggccaaggcaggtggatctttagcccaagagttcaagaccagcctgggcaacatagcgaaaccccatctctacagaaaaatacaaaaattagttgggtgtagtggtgaacacctaagtcccaactactggggaggctgaggagggagaatcagttgagcccaggaggttgaggctgcagtgagccatgatcataccactacagtccagcctgggagacaaagtgagtccctgtcta

SEQ ID NO: 225628 - DNA, 528 bp, Homo sapiens
gggaatgcttatacgcttttggtggaaatgtgataaattagttcagcccctgtgaaaagcagttatggagatttctgaaagagtagaaaataaaagcaccaattgacaggaatcccatcaatgggtatatacccagaggaaaataaataactctaccaaaaaagacacctgcattcatttgtttattgcagcattatccacaattgcaaagacatagaaatagcctagtttgcatcaacaatggactggatgaagagaatgtggtatatatacaccacagaatattatgcagccataacaaaataacaaaatcatgtcctttgctacaacactgatgcagctggaggccattatcttaagcacattaatgcagaaacagaacaccaagtatcacattttctcatttataaatgggagctaaactcccataaaatttataatagagtgagataatctaaaatatgtttaatgttcattcaataaaaatataacagaattataaaatgaattaaaagcagataatagaaa

SEQ ID NO: 225629 - DNA, 407 bp, Homo sapiens
tgcaggtaccttgatgtgtcaaacacatttgcattcatagtaggtttaaagtactttccttgtctcgaaagtatgcatctaataaagtttaacaggatagtcaagaaagtagaagaaataaaaatttcccataattctactggttgtagcagcttttaaattgttgacgtgtatgtctttccaacttttccttatttttatttaaaagaaagacttctaggatcatctgacttggcgtgtaccgactatggcttgtgcttactctacctgtctgaatgcaaaaattgtgacttgcatcaggcctgtcactgcaggagaatcgcttgtacccaggaggcagaggttgcattgagctgagacagtgccattgcactccagcctgggcaagaagagcaaaacttcatctc

SEQ ID NO: 225630 - DNA, 421 bp, Homo sapiens
ctggcacagaacaattacttgggaatattccatccatggagtgagggagctggggtatttatccaccagctcccatcagtcattggttgagggctgctcccagggagcattaaccccctggcaccttctgcttgacagagaaggctcaagtggtcagaaacaggctccaggcacagggatacaggtgctggcagctgtgtgcacagaaatggtaagcacaaggtgacatgggtgaggcatcaatagtgtctactgcacatgtgactgaaaggggacaaagaggatatggacctgtggcctccataaagacaccaggacaaagtttccaaaacactcatcggaagatccttggggttcaaaatgctgagagccggggctggggaagtagtacatcatttcaaataaaaggaacattgtgaac

SEQ ID NO: 225631 - DNA, 755 bp, Homo sapiens
gaggttgcagtgagtcaagattgcaccgttgcactccagcctgggtgacagagtgagactctgcctcaaaataaaattaaaaagatcttttgaagggcagaaagtaagagagggattgggctatttatcttgcgaagttgggaagttgatgaggtgacagaaaacaactctaactcctgttgaatgattttcagatgggaaacaatgggaaagataaagccacctttagataagacaaggtcaggcctaagaccgtttattcctttctagtaatgtctggtttacctctagcactacccttatcccagaggaagtggtatatgtaagttggttgtatccaaacttgcatctaactttgtatcagttctgaagtagtggaacctaaataatgaaatttgctttatcaagatcagtggtccccagcctttttggcaccagggactggttttgtggaagacagtttttcaatggaccagggttagggaggatagttttgggatgagtcaagtgcactacatttattgtgcactttatttctattattattactctgtaatgtataatgaaattattatataactcaccataatgtagaaccagtggtatccctgagcttgttttcctgcaactggaccatcacatctgggggtgatggtcgacagtgacagatcatcaggccttagattctcataaagaatgcgcaaccttggctaggcgcggtggctcatgcctgtaatccgagcactttgggaggc

SEQ ID NO: 225632 - DNA, 428 bp, Homo sapiens
catctgtacactttaaaaggctgaattttatggtaggtgaatcacaacgcactttgttaaaatgcagtccaccgggataaaaataactaagaggatgggcgtcccgtgaaggcttctgagttggggaacactgctgagaagctcgagacatcacaccggctcagtcagcagtggggacgcaaggcagagctctgggcccggcgtcctctgcaccctctttattctcagccctttccccagcagcctaagctcgcaggtgtacggccacaccctcagtcctggtgagaggggacagaccaaggggctcgaggtgctgcagagtgccgtctctccccagcctgcctgcagtgccggacggctcacacgggtggcaccaggctccgcaagctccggggacaggcgcctcctgggagtcggggcccagctag

SEQ ID NO: 225633 - DNA, 441 bp, Homo sapiens
tatcaaatgctttctcagcattcattgaaatgattatgtggtttttatcctttattttgttgtatgatttatcacattgattgatgtgtgtatgttgaacccttctcacatcccacttgggcatgatgaatggtttttctaatctattgttgaattctgttttatagtattttgttgaggatttttacatcaataatcatcagagattttggcttgtagtttttttttaatatgcctttatctggttttggtatcagggtaattaatattggcctcatagaaggagtttagaagtgttcccttctcctttacttttcaaaatagtttgaataggattggtattagtagttatttaaatgtttggtagaattccatggcacaggtttacctatgtaacaaacccatacatcctgcacatgtagcctgaaacttaaaattaaa

SEQ ID NO: 225634 - DNA, 612 bp, Homo sapiens
gagcaggaaaatctgatttgctaaattttcttttgttcaaatggcaaggtcaacaaaatttccaaaactttacgatttgaaccacttctgtattggaatgtcaaagtggcaaatacaagagagccagtttttgtgttttaataatattttctaactaataaaataggtccaattaatttcactcacattcattttctgaaaaagtgtttatttaatttccctgaaaaatatacaatacttacgcttaactcggaggtgggcactagatttaacattggcagcttggaaatccaccccacccgtctggtccaggcgacagttgtgcaaaacaagggagtgtattttgccttcttccttaatttcacaatcctgtaccaacaaaacagaaaaactttcatagaaaataattttctttgaaattttgttctaaggatagattatcttaattaaaggaatgcaacaaataaatggtgatgaaactttatataactttgagctctttttttaggaagtaaagcttacaagtactaagaggaaagccacatttattttagctgtataattctgagccaactagcagcatcacagagtatctacaaccttatactcact

SEQ ID NO: 225635 - DNA, 508 bp, Homo sapiens
caggcattccaatatctggatccctcactcagggtctagccaggagcccaggagtcctaggaccatctgggctctggagctcttcagccagccaccagtgcctcgttcccccttcacgaatctcctacacaccctgtctccagggccaatgtcccctcagaacacagaccctctcctccgcccccacccactcactgaagggccgtgagcagcttggcagactgtccctcagtgtcacagtacaaaaacctcgggcgtagtggtacaggcaggagaatcttgcatgtagcagcttctcaataagtatttattgatttgtgatgcagtaaaggtcttagctcaccattttcctctggagttagtctgggtccttctattccttctgcttcctattctcctccttgtccttgcccataccaggtattggttcacattccttgaacgctgggttttacactctcatgttgagctaagaactggggccttttggttacacaaacttgccaga

SEQ ID NO: 225636 - DNA, 984 bp, Homo sapiens
ctcagacaatgtgacacttccctacaactagcctacatatcaacttttaaactttttttttaagttcccaggtaattctgatgtgcaaaaggatataagccactgttaatacacacagttttaaaattctgagatgttagacatgtccttttccttgggcatatgattcaagaactatgtcactcaacaggtgagcgcttgactcacagaataagaactgtcgtgactattaactaagaataaattaaccaatttaatcctagatcttgatttctaactcatgggatgatagtgccatgcttttttttatatattttattaatgtttttaaaaaactatttccgccaggcacggtggctcacgcctgtaatcccagcactctgggaggccgaggcgggcaaatcacctgaggatgggagctcaagatcagcctgaccaacatggagaaacctcctctctgctaaaagtacaaaactaacggggcgtggtggcgcatgcctgtaatcccagctactcaggaggctgaggcaggagaatcgcttaaacccgggtggcggaggttgcagtgagccgagatcacaccattgcactccagcctgggcaacaagagtgaaactccatctcaaaaaaaaaaaaaaaaaaagaaagaaacctatttcaagtttacactcaaagacaatttatactatctgcaaagattactcttcctcaacagaacacaagctcagttctagcattgcctaagtacagatgctctttaacctgtgaccgagttacgtcccaatgaaacaatcgtaaagttgaaaaatcttaaaccatcataaatctggaccatttatacttgctttattcacaaggtaccacagtgcagcaggcaaaaactgacattgctggatctagcataagacattctgaaatgatgttcaaaatccaaccaaggagaactgttgaagactcagcacttcaagaacaaacagtttgaca

SEQ ID NO: 225637 - DNA, 413 bp, Homo sapiens
tagcctgggcaatggagtgagacactgtttcaggaaaaaagaaagaaagaaagaaaatttgggatggaggaagggcaaaatggagatttggaaaggaagagtttagaaagtaatgcatttaggctggacacagtggctcacgcctataatcctagcactttgggaggccaagttgggtgggtcacctcaggtcaggatttagagaccagcctgggcaacatggtgaagtctcatctgtactaaaaatacaaaaattagccaggtgtggtggtgggcacctgtaatcccagctaatggggaggctgaggcaggagaataacttgaatctgggagacggaggttgcagtgaactgagatggagccgttgcactccatcctgggcgacaagagcaaaactttgtctcaaaaaaaaa

SEQ ID NO: 225638 - DNA, 378 bp, Homo sapiens
aggacttttttttttttcaattgtggaagaaaacataagatctatccatttaacacatttttaagtacatgatacagtattattaactacaggcatcatgttggacagcagatctctagaacttactcataattgtgtaactgaaactttataccccttctacaagcaactgcccatttcgccctgtccgcagcccccaacaacctacattctattctgtttctataaatctgatgttaggtatctcacagacgttttatattcctttttagactttagcatactgccacatattttcctatctgaattatcattgtttcactttgaacttttagtcatatattgagtcattaattcaacatagtattggaaattcag

SEQ ID NO: 225639 - DNA, 127 bp, Homo sapiens
taatgatttttcaggtagtattactttaacttcagggcttttttggcatttatggacatgaccatgtggtcctccccactgccacccttttttctgagacaggatctcactttgtcacccaagctgg

SEQ ID NO: 225640 - DNA, 374 bp, Homo sapiens
tgagatggagtcttgccctattgccaggctggagtgcaatggcacaatcttggcttaatgcaccctccacctcctaggttcaagcgattctcctgcttcagcctcccaagtagttgagacaacaggagcacaccaccatgcccagctaattttttttatttttagtaaagatggggtttcaccatgttaaccaagatggtctcgatcttttgaactcatcatccgcctgcctcagcatcccaaagtgctgcgattctttctgtttatttcttgtcattgaaagatttaaatcatttacatttaaagtaaatgctaatagggaataacttacttttgctattttttgtttgtttggtgcatgtctttcagttttg

SEQ ID NO: 225641 - DNA, 474 bp, Homo sapiens
gtccttgaagttgacactcatacttttatctctttcttgaacctctcagatatgcttagaactgaagaagcccgaagttgattgattctgttttttcacctcagccagcaccttcttcttctcctttccaggagaatctgtatttctctgtatttccagaattctctgtatttccagtgaatctgtcagacacaaactaaagaccttttagcactgacaccacccttggagctcccagcacatcagcatcagcctgggatcacattctcatcaaaagctggaaagaaggaaaactcgaaccggcttgggaaggacactatctagtgcttctaactacagaaattgctgtccgcacagctgaaaggggatggacaccccacacacaagtgaaaggagtgattttcacagcgagagaaaaatgggccgtcaccccagggcccacccgcaccaaattaaaaagggctgaataatcat

SEQ ID NO: 225642 - DNA, 461 bp, Homo sapiens
actccccactgaactattacctaggttatctaaatataggctatttacttgattggcatttgctcctgtcagtttcataaactgtaagtaatgatttttgctgatgttagagcattgtggtactgtgtttctaatttaaatcaatgtctacattaatctgggaacatttgatgttactacctgattgtacattctggatgtaattagagtcattatacagaaataagtgtcatcctcttattctctaaatgagaaaagagagcattcttctcttctgaaataatttttctgggtcatgcccccaaaaccatttgtcaaatcaatagcagattctaatcacaaacttttttgactttttaacctttaaaagtcatcttagtgacttataaagaccaagattgtgcagtagaatgtgggcctattaagttatttcttatcaaaataaattatgtacaacatat

SEQ ID NO: 225643 - DNA, 509 bp, Homo sapiens
agggttagaactcaggcttttttaaacccgtggggcccattcctttaaatatcaagacgaagttgcattcccaaaggatccaaatgctgtttttttctgtttatggttcattcttccccaaggaaaggttgccatcagagtcaactccttcactcctggtgatgaccgcaaaccttgggcccaacctcacccttccactataattaaaagaccaccacaggaaacaatctttgttgtgccgaagtagttttcttcattagaaatgcctcccaaatacttttcaacatttgttagtgtaaacacattttattctttaatttgtgcctgtaatcatttatgctggtagattttgtgactttcagcaatatctggcaaataacctggtcagccacggtgtgttattgttttgaagcactgttcagttccaagagttgatatttttgtttaggatttctgcatctatatttgaaagcaaaagtaaactgtattttttgttgtgtttcctagat

SEQ ID NO: 225644 - DNA, 615 bp, Homo sapiens
tctacaaatgttcaacacagacacaaccatcctatttctttttcctgattattatctatccaagtttggttgcatccatgatgtggagcccacagatatagagagccaactgctattagagaggtacccattgtccagagagccaatttagggtacaggaagtgaaaggcagagacaaccatgcacttgctcactgcctctagatgcaagagcattctctgttgggtactataatcagtgaacacaagacctagtctcagatttatgaatgggcagtgtagcctgatgaaaatgttcagagactatgttagaatgtcagttttgcaagatgagagttctggagattggttgcacaacgatgggaatgtacttaacactactgaaccgtatacttaaaaaatggttaagatggtaaattttatgtgtattttatcacaattatttaaaaattttaactcctttgtcatctaagggcttaggagaaaaacaggatggaacctaacaccctttggcaagatgaaagtaaaagttgctgatcaacaaaccctcacatggcatttagagaggtatttaaaaacaaatcattaaagttttaaggacattacttttcagact

SEQ ID NO: 225645 - DNA, 544 bp, Homo sapiens
gaagcaggtacttggactttggataacagccctggtctacaacctgaatctgacactttctggttctgcaacttgggatcagttatctcattttcagagccttgttttcctcatctgtaaaacaagaattatggaggtaccgacttcatagagttacggtcttcacagtattaaaaaataacaaccgccaacatttactaagcccttaactgtgccattatggtgcttgtgtaattctctacaaaatttgcaaaattcagccacatgtgatgtctctcgcctgtaatcccagcactttgggaggccgatgtgggaggatcgcttgagcccaagagttcaagaccagtgtgagcaacatggcaaaactctgtttctacaaaaaaaatacaaaaatcagccgggcatggcagcacatgcctatagtcccagctcctcaggaggctgagatgggagggatctcttgagctcgggaggcagaggttgcagtgaactgtgattgtactactgcactccagcctgggtgacagagtgagactctccaaaa

SEQ ID NO: 225646 - DNA, 185 bp, Homo sapiens
ctggtgtgtggctatttatagtcgtaatttatcctactttatctgaatattcatgtcttgctgcagaaatattaaagttttaactgcagtactgccctagacctcaaaaggagtgttggcatcatttactttttaaaaccccaaatcttctgaactgagaaacacaatccagattctaggtcaag

SEQ ID NO: 225647 - DNA, 217 bp, Homo sapiens
acccgaagttttgacaactatcttcctggtttagcctagagaaacagaagcaatgggaagaaatcacatttgtagtagacccatgaccaggactcagattttaaaacttaaaatgtttccattaccttgaatttcccttcgttgggttttttaaaaagctaaaatgaaatgccattaatgacatagcatggcattacatatagaaggtctttatata

SEQ ID NO: 225648 - DNA, 1287 bp, Homo sapiens
atttggggacaggtggaaaagggctttatcatctattcgtactgatttactttgcagatacaaactgtataaataactttgaatcatttttaccattctttctcatttgtttgccctttctgttgttcattcctgtccagtccattctttacatgatagccggaaatgatttttccatagtagggctttgatcatttatttcctcatcctcccaaagcaaaaaaatatttttcatttaccgtttcctaccaaattgcaaagaatactccagtctgactccattctagtcacactttatttcccacaatagatttcatttcccctactctgcactaaactaaaattctcaatcttcccaaattttttcaaccttttgtttatttcattatccagcttgtatcagcctatttggaataccaccctacttttaaaccttgtttttaatctcttaaaggtaaataatttttcttttcattgaatgcaaagcttttttatgtgtacttgtctcgaagcactctatttgtattacaattatgcatgtacatgactcatctccctttacattgttaagatttttgaggggcttttcagaccatgttttgttctattttgaatcctctacaacattgcttttcaaagtatggtttgttggaccagccattgattggcttcaacagttttgttactggtctgggacaagatagtgagctggcatcagaatataaatcagatgtgtcactaaacacactgcttggttcagctgacttttttttatacaagaagacattggtaaagaagaaaactgtgtgttggtttacattctggcacaagcttcttattttgtagcagattggcaccttaaggagcattacttttaatatccaagaaaaaagtagattcctagtaaattactaatgaatgagttgtaggatatttgttcctgtcaactattatataagtggagtaaatacatatttttcttttgttaaaattcacccattggtactttggcctagaaagggtattatactaaatcttaagaggcagtacacttgtctttattcaacccaaagggatggatggaatttctaagaaaaagcctggggcagtgtcctgaatttatcccattagagttcagatttgggttttcttcaaaaagtgtcctgggctggcacagtggctcacacctgtaatcccaacactttgggagcctgaggtgggaggattgcttgagcctaggagtctgagaccatcctggacagtgtagtcagaccccatctttaaaaa

SEQ ID NO: 225649 - DNA, 787 bp, Homo sapiens
ctttgtttttttgctgtcttgtagctggttgcaaacattgacactccacccttaaattcttcagcttattctccccaagaataaggatattattttacattgccacaatattaagaaatatacctaagaaaaatatcaataattccataaaattgaatatacagccccattcaaatctctttaattgcccctcaaatgttttttattgtagttttaaaattaatccaagattaggtttaagtgttttattatgtctctcttattttcatctacgctggttcctttgacaaattttggtttgtttttttgtttttcctgtcattttttttgaagagtctaagccttgatcaaagtctgttttatacagtgtccaacattctgcattcatctaattggtttcctcacaattcactttagcctaaacattttttggcaataatactttattagttgacatgcatttgttactgcatcacattccataacatcagattgtgcttctcttggtattgccatgtttgatcatgtacttaagttgatgaccaccagatgatttcattgtacacatacatttttccatctgtaattactgtgtaatctggtgagttcaatctcacgtttggattaaaatttttatcgttaagaagtgtctttttaatctagaaaaaaaaacaggttatttaatagcctatgtcacattttgtttttgtctcctttatgtgacatgatgaaaccatagagctaaaaatacaacctttgctgatttctgttcgcctttaaaaaatga

SEQ ID NO: 225650 - DNA, 404 bp, Homo sapiens
gaatgaaagagtaatgcctgataagtattggatgcttagtaatttagttggtcaaatgttttgagtacaggcatttctgttattagacattatgtgcatttcttaaaaacttaacgttttttaaaattttggacttaaaaatgacagtttatgggaaaaatgggactgaaggagattactcaaaacctgtacaacttattagccatggcattaacagtattaataaaaatactagtacaggccaggcgcagtggctcatgcctgtaatccagcactctgggaggcctaggcgagcagagcacctgaggtcaggagttcaagaccagcctggccaacatggcaaaaccctgtctctactaaaaatacaaaaattaactaggcttgttggtgcgctcccgtcatcc

SEQ ID NO: 225651 - DNA, 133 bp, Homo sapiens
ccgcccgcgcgggcacacccgggctttgacccctttgtgatcgaggacacggacgggtttctctccaacaaaagggggccataaattacaaacggaagcagagtgtgtagggaagaacaggaaagcacgtgcg

SEQ ID NO: 225652 - DNA, 475 bp, Homo sapiens
caggctggtacagtgccataaatttgggatggggcccagtccactccccacagttggctccgtcatgaccactgcacattccgacatgctgctgctgaagacatgatccccagcaactaggctgtcagaggaccctcccagctgttcacccactgacgaccaccctgagagagaatgcaccatgtccatctactgttggctttctggaagagctcccccagctcccacctacccaggcacaggtgggaacgaggtctgtgtttctgacagaacacaatctcttaaattcattcctttcctgttctggagaatattcctgtcctttcccttttggcataggctttctttcacaaagccctgtctggatgggaacttttgtaagtaccttgaaacttcaatttattaccctgaaattcacaaaattattaaaaatggagtgtgactcttgctaaggactcaaaaactccaaacataa

SEQ ID NO: 225653 - DNA, 438 bp, Homo sapiens
cagtatagttaggctgagaattttccaaatcatcaagtcctggttcctttttgcttaacaattctgaggcaggagaatagggaattcaggccatcaagggttaaggcagaaacaaaagaacagcaggtgcagccaggtctaggcaaaactgggcagcacacaggccacatccttgctcctgtgataatgagacagaagtttccacatcagcctctgattgtgtgccaagcctccacgtcagcctctggtcacaggccaatccttcatgggctgtggccaattggagtcctctaaagggcactgaggggagttgcttggttcctttagcttaataaaaaccccagttgaagaggctcttgaaccacttgctcaagcctgctcccaccctgtgaattgtacttcggcttcttcaataaatctgtgccttcattagcccgt

SEQ ID NO: 225654 - DNA, 414 bp, Homo sapiens
cttaaaaacaggtggattgctgtctcaaatgaatcaaacaatatgggttgaagagggtgggccttcccaggaccagagacagacctgcaggaataataacagtcagaactattaggttgtgtaagactttgatttggaaggcaatgctgcaatgaacatggtatcttgagaaagcgcagttagcagaagcagcagtgccagaagccctaatagatgccttgcaggcctgaacaggtggtgcaagctgtgaggcccatgccagctgctgcagcaggaagaatctgcaggagaatctggtgatgggatttgagaagcctttctggcttcatggcttccaagctggattccccagccttcctagggattctggtcctcagcatcccttaataaacggctgttgtgcttaaaccaaca

SEQ ID NO: 225655 - DNA, 399 bp, Homo sapiens
ggttatttgaatgtcaaataattttggattatatcctggacattttgaatcttatgctatgagatctgggtcttgtttaaatcctattaaaacataatacttgttggctgggtgtggtggctcacacctataatcccagcactttgagaggccgaggcgggcagatcacctgaggtcaagaattcaagaccagcctaaccaacatggagaaaccctgtctctactaaaaatacaaaattagctgggcatggtggcacatgcttgtaatcacagctactcaggaggctgaggcaggagaatcgctttaacctgggaggtggaggttgcggtgagcagagatagtgccattgcactccagactgggcaacaagaatgaaactccatctcaaaaaaataaaa

SEQ ID NO: 225656 - DNA, 474 bp, Homo sapiens
acttggaccattcacatttaaagtgactattgatatcattggattaatatgtaccatatgtgtaactgtttctattttttgactttcttcattgtttccttttgtgtcttttactctttttctaccttctctggctataattgaacatgttatatgatcccatttttttcttctctcttacaatacaaattccatttcttaaaagaaaaattgtgtttttgttttcaccctattgcttgccatatatacttacaaataatctaagtcaacttaaagtaatgttatgatgcttcatgggtcatgcaggtaccttaaaaacaaaattcctaattcctttcttaccaccttttaaaacattactctcattcatttgatgtattaataacatataatcatccaatcaattattgctgtttttcttattttgacagacggttatatgaattaagaataaacataataaaatattttatt

SEQ ID NO: 225657 - DNA, 517 bp, Homo sapiens
gagtggaccatcataacttctgtgagccaataaactgtcactgtaattgaagatgctggccgtcttcttgctctggatttcccaatggaggtctaccagcccaatagtcttttcctttttatcttcttataagagcattgcattaaattttacttatttatttatttttgagacatggtcttgctctgtcacccaggctggagtacagtggtgcaatctcagctcactctaacctctgcttcctgggatcaagcaatcctcccacctcagcctcctgcatagctgggactgcaggcacacaccagcacaccaggctaatttttgtatttttagcagagacagggtttcgccatgatgcccaggctggtcttgaactcctgggctcaagctatcctcctgcctcagcctcccgcagtggggggatttcaagcatgagccactgcgctcatctaaaccattctaaaaggagtgactaaggatggaaaataatacattaaaagtaaaatctgttggtaat

SEQ ID NO: 225658 - DNA, 592 bp, Homo sapiens
tagctctatatgaggagaaggatttatataggaacaggaggttgagggaattatttgaaagcttgatctttcactgcgaaaaatcagatgagcatgatggtgggaattggaatggagagatgtatgacaagggtagagaaggcttaaaatagcaattttggattatgagaggaaacaggctgctccagtaaatgtaataggattgctggtcaatctgaaagtttcattcagagatagtggccattaatttataatactctatcctgctgcttttgtggatttttccctgcagtggcaatttgtagcccactttccacagatagcagattgacattcagattcatttagtttttgtaatttgccaggtccacttcctatggagtggacactccaaaggtcaagggaatacttgaaagagaatttaaaaatacgtcaagtagaaagattaaaaagaatgatccatgaaccttaaattgagtaattaatatggaagtgataaagagcccactaagtagaaatgaaaaagaatataggctggtagtggtaatagtagacatttcggtagcataatggccttaaactttcaaggaac

SEQ ID NO: 225659 - DNA, 333 bp, Homo sapiens
ctggtcccaagcactttggattagggatactcaacctgtatctcattagtgagtatgggaagaatgaactgagcacaactcagctcttcctccttttttctctttcaaatgtgcctgcccttaagaagcacgattttttgccctcttcctccatgttctattaatacatttcccacagtctagccctcccagagaggactatgattggtcaggcacagtggctcacgcttgtaatcccagcactttgggagactgaggtgggcggatcatttgaggtcaggagttcaagaccagcctagccaacatgatgaaaccccatctctactaaaaata

SEQ ID NO: 225660 - DNA, 447 bp, Homo sapiens
cccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgt

SEQ ID NO: 225661 - DNA, 531 bp, Homo sapiens
atttgctttgaaatgattgagaaaagatgtgtgtgtctctggtcagggataagttccagtgagacccactccaacttgcaaaacattgatattattgggaagcttcagagcagacagtcagacagacttagacccaaattctaggtcatctggttagtagtgaccttgacaaatgactacagttgagcctcagttttctcatctgtaaaataggggcaatgaaatgtttccaatagagcagtgacaattaaagataatatatgaaaagtagtgagcacaatgcctgatacatttctattcaaatacctaattctttgaagaaaagtttctaacagaaacttttgatgttgacagaaaacagtcaaaccacaacagcaagagaggaagaaaggaacagaggatccacaaaataaccaggaaaccattaaaaaaatggcagtagtgagtccttacttatcaataattactttgaatgtaaatgaattaattctcctatcaaaaggctaacgtggctgaatggtttaaaaaaaa

SEQ ID NO: 225662 - DNA, 454 bp, Homo sapiens
ggaagatgactttcagcaacatgagagtcagaaggaagacaattcagaggctgagaccagagggcattattcagggcaagagataagctgagtggcagtagggatgtacaggagttccaattcatgagactgtcatgaggcagaagtgatgggatttggtaatcaattacattatgaaaaggcagggaagaagcagataactcccaagattccagtttgggaggctgggaagttggtgaagtcactaaccaagatcgaaaacacaaaggtggaggaggaacaacagcaggagaaataagttctgcttcaaatgtattgttcatggagcctgcacagcatgttcaggctgcactaacaacataccatgaactgggtaacttataaggaacagaagttgatttctcacagttttgaagactgagaagtctgcgattaggatgccagcatgattggg

SEQ ID NO: 225663 - DNA, 435 bp, Homo sapiens
aacacacgtgtgagctgtcaggcagctcagggcattgcatgaaggtaactagaaacacaatttccacctctttttaaactagtgtagttcaaaccttccctcatttttaagttcttttttattgaggtgtaacttacattcagtaatgtgccaagtcctatgtgttcaggtcaataaatttttacaaacacacacacatgtgcacaaccccctatagccaccacccagatcaaacacccagggggcttcctcaggccacctcttatcaatttcccacaaaggtaaccattattctggcctttaacaccaaaagttcattttcaagccttcactattaaaaaacaacatcaacaacaaaaaacaagcaactaatggcatgggatcgtaggctggataaggaagggcagccaagagtgttttaatcaattttattta

SEQ ID NO: 225664 - DNA, 521 bp, Homo sapiens
agactgcacatgcgtcgcctgcgaagtcccctgtgccgccgccgttttggtgagccatcttctctccctccctccccgccagtcctcaggagtagcccctagttcttctccttcctttgccagggctttccctgtgttttgccgcctgttgaagacttgccgccattcccaattggctcattcaagacattttgcctaataagattctccttcttagaaaaattcttctgtggccaggcatagtggcttatgcctgtaatcccagcactttgggaggctgaggcaggcggatcgcttgagcctaggagttggagaccaacctggccaacatggcaaaacccggtctctgcttaaaatacaaaagttagtctggcgtggtggtgggtgcctgtagtcccagctactagggaggctgaggcaggagaatcgcttgaaccctagaggcagaggtttcagtgagccgagatcgcgccactgcacttcatccagcctgagtgacagagtgaaactgtctcaaaaaa

SEQ ID NO: 225665 - DNA, 249 bp, Homo sapiens
caaggaataagatctaatgttcactagcatgatagggcaactatagttatctctaatttattgtatattttgaaataactgaaagagtggaatttggaatgttcaaaggcttgagctgatggatacctcaattaccctgatatgattatcatacattgtacacatatcaaaatatcacatgtatccaataaataagtacaactattatgtatcaataacaaaattaaaaatgttaaaatctatgttgca

SEQ ID NO: 225666 - DNA, 797 bp, Homo sapiens
ggtgggctccatccttgtttcatgcctgtaccttccgctatgcctgacatagttcatggttgacagcaactgaatgtctgtggctgaatgaatagaagaacctcgttgctaggaactgttatcggggctgtttcaggttcacatgtggagaggtcagtattagggcaaaggtgaggaagcctcatttcagtggtgttgtcctgagttgagacatgaaacatgaattttaactcaaattctttggccccttctttaattcagagccataggccaatcaccgtactttcttcatttacaagatgagtatagcattggtggtttgtactgggagaatttggaattctggatgttggtgagatgctccatatgggatctcatgccggcagctagcatggcattgtgatcgcgacacccagggtgagtcccagctttgccagtaggtacccctgttctacctggatgctacccacctatgtctggcaggtcaaatcagaaaggcaaagcctccagcacataacatggcaaggcttccagatacaaaatagcaaaactattttgccacaggggagatgatagggaatctgaactgtcccctccaagggacacagagcctcaggcagggccacaggtgcacctgttttgtgcagagggctcaagcagccctggagacagtaacaccctccagctgccagctctgccaccttcagcatgaccttaccaagccacctcgcctcgccttcttcagtggtaaaatgaggataactgtaaccaatttatcaaggcaaacatgtattaga

SEQ ID NO: 225667 - DNA, 471 bp, Homo sapiens
ggtgggctccatccttgtttcatgcctgtaccttccgctatgcctgacatagttcatggttgacagcaactgaatgtctgtggctgaatgaatagaagaacctcgttgctaggaactgttatcggggctgtttcaggttcacatgtggagaggtcagtattagggcaaaggtgaggaagcctcatttcagtggtgttgtcctgagttgagacatgaaacatgaattttaactcaaattctttggccccttctttaattcagagccataggccaatcaccgtactttcttcatttacaagatgagtatagcattggtggtttgtactgggagaatttggaattctggatgttggtgagatgctccatatgggatctcatgccggcagctagcatggcattgtgatcgcgacacccaggggtacctactggcaaagctgggctcactgagaattcagtggactagtagtagta

SEQ ID NO: 225668 - DNA, 1282 bp, Homo sapiens
  misc_feature (939)..(939): n is a, c, g, or t
  misc_feature (946)..(946): n is a, c, g, or t
  misc_feature (951)..(951): n is a, c, g, or t
  misc_feature (959)..(959): n is a, c, g, or t
  misc_feature (962)..(962): n is a, c, g, or t
  misc_feature (968)..(968): n is a, c, g, or t
  misc_feature (974)..(974): n is a, c, g, or t
  misc_feature (987)..(987): n is a, c, g, or t
gggaccctctgcgactggtctatcttcctgagtgtctgaaacaagcaatgcccagaagatcgatagagagatcagtgctatcttgaagtatctgaaacaacagtgtcatgcccagaaaattggcatcgcgggattctgcttggggtggaactgctgtccatcatttgatgatgaaatactcagaattcagggcaggggtgtccgtctatggcattgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccggtaccgaggcnctactgnactcnagcctggncancagagngagacnctgtctcaaaaanaaataagtaaataaataaataaataaaataaaaaccaggtcagtacctggagaatttgaatgatagagaatgatagagtaataccctaattattagttaaaacctacaggccgggtgtggtggctcacgcctgtaatcccagcactttgggaggccgaggtgggtggatcacttgaggtccaggagttcaagaccagctggccaacatggtgaaaacccatctctactaaaaatattaaaatcaggcgggcatggtggcattgtgctgtaatcccaggctactcaggagtcctga

SEQ ID NO: 225669 - DNA, 967 bp, Homo sapiens
  misc_feature (638)..(638): n is a, c, g, or t
  misc_feature (645)..(645): n is a, c, g, or t
  misc_feature (650)..(650): n is a, c, g, or t
  misc_feature (658)..(658): n is a, c, g, or t
  misc_feature (661)..(661): n is a, c, g, or t
  misc_feature (667)..(667): n is a, c, g, or t
  misc_feature (673)..(673): n is a, c, g, or t
  misc_feature (686)..(686): n is a, c, g, or t
  misc_feature (698)..(698): n is a, c, g, or t
gggaccctctgcgactggtctatcttcctgagtgtctgaaacaagcaatgcccagaagatcgatagagagatcagtgctatcttgaagtatctgaaacaacagtgtcatgcccagaaaattggcatcgcgggattctgcttggggtggaactgctgtccatcatttgatgatgaaatactcagaattcagggcaggggtgtccgtctatggcattgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaagtgctgggattacaggcgtgagccaccaggcccggccagtgtttttgtttttgtttttgcgatggagattcgctcgtcacccaggcggaggttgcagtgagtcgaggttgcnctactgnactcnagcctggncancagagngagacnctgtctcaaaaanaaaaaaaacctncagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaatttttgaaaaa

SEQ ID NO: 225670 - DNA, 444 bp, Homo sapiens
cctcagaaaatacctcagaaatgaacggaagagatgataccagacagcagcctggtgaggcaggcaagtgtgctgattttttgctgccccaggcctctctccaggtggccttgggaacacatcatcaccctgaagaaggccctggtgatccctcttcctttctctcctcactgggttcctgaattcgacatcagtccttcagatagcagcaacatcctgaatgaatccagctctgttttcttgctctccatctttagatgtggacatttggaaatatgttcgttttcttttttaagtagagcactgttaatcaagatgggaagaagcagtgtttctgctttttttccaagtgagaattagagaaaagctcagaaatcccaatttacttcagaaagacttgaaaaattatacgtaatagacagtacaacagtaaagaaaattctg

SEQ ID NO: 225671 - DNA, 234 bp, Homo sapiens
atgggacaaactgatgtcttgtaccggatggtatgatgaaccgaggacacaacatcacatcagtggcaattctaccaatttagacaaacgccagttgtgggctgtcctacaacataactcagctgcagtcttcaaaaatgtcacagtcaaataaaaaagaaaagctgagattaaagattccaggttaaagaagactaaggagatacaacaagtaaatgcaatgtatgatcatac

SEQ ID NO: 225672 - DNA, 401 bp, Homo sapiens
ggttataatagcaaaagattggaaacaatcattctagactattaaaaatgacaatagtgtaaattacatcaatatctggacttgtgtttatcataccatattaaatgaaaagagtaaaacacaaaatatgtgctcttcaatgacaccaacgtaaaacatgcacacttacactaatcatagctagacaaatttaatttgcaataaagcaaattacatttcatttcatatttttgttgcaatattttctctgtaacatcaaaaagttgacaaaagaaaagagattggaacttgcttgcactgtggagggaaaactggttctgtacatgttttaatttgtctgaggaaacagagaaaagacttaaatatcctgaaataaaggtggcaaagcttctcctattcag

SEQ ID NO: 225673 - DNA, 467 bp, Homo sapiens
tatgtgtgtggcaaatattttcacctcttctgtggcttgtcttttgagctccattttcagtatctttggccttacagaagtttttaatttttatgagatcgtattcgtcagtccttttctttatgcttttatgttccatgcctcacttaaaaaggccctctttcccccaaggtcataaatatattctatacccttttcaatatttttatggttttagtttttatgtttagcacctaactccatctggaatctatttttgggaatcgagtggtatgtagatagatttcatgtctgacaatatatatttttgagcactcaaatttttaaaaagtatgtatgactttggtaagcagaaagagccaagaggagtttgaagagacactcagaaagtggatgtccattctgggtgggcccaggagtttgcaattttagcagatacctccagagaaaagagaaagtgatgagaa

SEQ ID NO: 225674 - DNA, 509 bp, Homo sapiens
atcctccaaccaagtttaaggatcttgaggcatgtcaactgtcatctattttgtggcacagacttatttcccatctctggtgcttgcatcaggacaagcttatttttccagtaactcaactggttacaccgatgagaggggaattttttttttttttaagaaaatctagaagagtttaggtatagagatatgccttagtatacttcacagctcttaacaagaatgcaggccaggcgtggtggcacacgcctgtaatcccagcactttgggaggcagaggtgggtggatcacctgaggtgaggaatttgaggccagcctggccaacatggtgaaacctcatctctactaaaaatacaaaacttagccaggcatggtggcaggcgcctgtaatcacagctactcgggagactgaggcagaagaatcacttgaacctgggaggcagaggctggagtgagccgagatcgcaccactgcactccagcctgggtgacagagcaaggctccatctc

SEQ ID NO: 225675 - DNA, 344 bp, Homo sapiens
gttatgtatttattcaattaaataatccatctatttgccatctctttaatactaatatagactcatgaattctgttgttaaacaatttattattccttgctatccttaattatttggagattaaattatctcagattttacagtgagagctccttcaagatatcccctgtgaccttttgataaactcctataattttttcaacatttattatctgacatcaaaagtttctccaggcttaccttggactcttgttgccccagttctgtaatcagccatttcttggtggaaccctgggtccattcactggggaatggtatttaaaaaaaaaacaggattcagggca

SEQ ID NO: 225676 - DNA, 448 bp, Homo sapiens
aagattgacgtaacacaggagactacatttgttcagaaaagcaaacaatcagtgtggcctacatttgttcagaaaagcaaacaatcagtgtggcctagactagtgaggggcaagtttggaactaacatggcaggatgtagaggattgggagagtgagtgggagggaggtgatcccaggagcctagaacaaccctcatgaaggcccagggtttttcatgggcaggagggttcagggcctgaagtgactgtagtagaaacactgaatgggccaaacagccaagatgagcaggatggcagctccttttgtggggacttgaaagtcagacagaattgggagatagtttggttttcttcacagcatattaatgctctgaaattaaaattgccttttaatacagcatatacttagttataatcctgcttcatgagaagaaaatgctcatttgta

SEQ ID NO: 225677 - DNA, 242 bp, Homo sapiens
caaattctaaccaagcagtttgttctttgtgatccaggcttagttgctgccctgttggccatttttcctttgggtgaatttaggattcagttcctcatcctcaaaagccctaactgaaaaggaactgatgacacattctccatggtaaacccttcttgggaaactctcacgaggacttgggcactgtgtatccagctcctgtcgacgcggccgcgaatttagtagtagtagtaggcggccgc

SEQ ID NO: 225678 - DNA, 347 bp, Homo sapiens
aggtgagtgttgtggtcctgccctgctgggagctgtgtgtgcagtgcggctaccctgccctgttagtgtgagctgggggtgtccgtgggctgtgctcatgccttccatgccctgtaggttagtctcatccagcctccaggttcttctgtttgtatttcataaagaggaaacttgcctgtctttgtataggcagggaaaaaatgtcctttttgttagagatttttgtcctcttttgcagcattgagtgtgcaccgtaaatgtcgggtacacataggtttgtgatgggaatgaatctttgaggcagtctacaagatttagattgttcttttttttgagacaaagtcttg

SEQ ID NO: 225679 - DNA, 344 bp, Homo sapiens
taagtcatggcttatatgatggtggtcccataagatttataatggagctgaagaattcgtatcatttagtatttactatgctatttttttttattattgctttggaatgtactcctacttaattttttaaaaagttaaccttaggcgggtccttgaggaggtattctaaaagaagatcttattatcataggagatgacatctctatgcatgttactgcccctggagaccttctaatgagacaagatgtggaggtggaagacagtgagattgatgatcttgacgctgtataggcctgggctaatgtgtgtttgtgtttcagtatttaacaaaacaatttaaaaag

SEQ ID NO: 225680 - DNA, 269 bp, Homo sapiens
aggttgatttacaattctaacgattgaagctttagggtaacttgatgttattactcctctgctgattttttttttcctttccttcttgctggtaagagcgggtactcaaaggatgggaatcgtgactgcagggtcatcaagatggctgagtccagctcctgcatctgttgtttgaagctcctttcccacatgccaaatgcctacttcaaaccaatgacactggcacatgggagttcacctttgcaagagctgccttctctccaaggatg

SEQ ID NO: 225681 - DNA, 588 bp, Homo sapiens
aatactgaatgtttcagtggatatttagaatctctttaattagatgaatgtcattgtgcaggtggtctactggaagaagggaaataaaagtttgttaatacagacatctgtgaggaacactgactgttctttgagggagtaacctggaaaatttgaaaatgaaacccctcccagtagcctggtctcggctctatgaagactgatttaccaacatgtacagtggacctctgaggaaagaagcagccatttcagagcccttaatgtgaatgcataggctgtgattattaggaagtgttaaaagcactggctggcagcttagataaacaagaatttgaaccatcacaaataaccagggggaagtggcatttgttagtattctggaagatgttaaatccatagcaaatgaaagtcttagcattgactgtttcaggcaacttagccgtaacctcaatgctaaaaaacagaacacatagaggagcgttaccaatatttatcaagcttcccctttatgtctgacattttcaagtggattgactcattttatcatatgaagtagttgtattaaagcattcttcagccccaccccgc

SEQ ID NO: 225682 - DNA, 747 bp, Homo sapiens
ctgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctga

SEQ ID NO: 225683 - DNA, 474 bp, Homo sapiens
gagttggaagcgtcatatttgaaaccatgggcgagtgtgagaaatgactgtcaagactcatttgaagaccccacttgaagagacacacggacccagaggaagtaaaatgcctcttactgtacatgttgtctcatcaaagccaaacaaatctgcatgcatattagtgcaagtgcagaggagagaaatcctacaacatttcaagcaaggggttgaaaatttaaattgtttgtatcgtactcatattactcttttaagatttgtaaaatgttatgaataatccttctcagagccacgtatggtcaggcaggttgtgctctgcagtggggcgcctgtccaattggggctgtaaccacccagagaaagagatgccttttaaattccaaacagagaagttgtatggcctaacagccaccttgaatgtattatctttattgctttaactttgtgaacaacaaaacaaattctatgactttt

SEQ ID NO: 225684 - DNA, 411 bp, Homo sapiens
taagtgggtgctaaatgatgagaacatatagacacatagaggggaacaacacacacagaggcctttcagaggatggagggtggaaggagggagaggatcaggaaaaaataactaatggatactaggcttaatacctgggtgataaaataatctgtacaacaaacctccatgacacaagtttacctgtgtaacaaacctacacttgtacccctgaacttaaaataaaagttaaaaaaaggaaaataaatttaaaaagaatattatgtggtctgaacacttatttctgttaatcaaatttctttgtaatcatataattatttagtaccacccacttgtacaacatttattgcatacatcagtgtttataatcatttctaacaaataaacttttttattaaacattgggtagaa

SEQ ID NO: 225685 - DNA, 728 bp, Homo sapiens
gcagtttgcatgagaagtgattgacttttttccttctccctccccagccaaggacagccagggcttgctgctaggccacaagccccagaggccacactttcttgtaatgggcctgtttgctggagggggtgggtcctgagctgggacttgagatccttttgctcatcagagattttccgcagacacctggagcgctggagcaaagaggagctcagcagtgcctggctcggtcctcatgtgtgttggcacgtccacatccctggggaggagacccgcacggtggcccggaacagtccatggcagagcagagaggcagaagtttgtttgacctcttttctctgtcctactgcccagcctcccttttccatcctgcacactttggccaggtctccctctggtgcttcttccaaagtatggggtaaatctactgcccaagtgttggccaagtatcctttttttcttttaggaagcaggggaggatggtctgtcaaagttaacctaaatctgtgctcctctgtcagccctgaacagatgctcactgtgttttaacaatctattagaaatactataattattttaattgttcacttcagtcctggctgttggaatccttcacgtgatctatgtgattgtttctttcataagtttggacatttttattttgtttttgtttgttttaatgttaagggcctgccttggttttctgcatcactcctgagtatgcttca

SEQ ID NO: 225686 - DNA, 960 bp, Homo sapiens
gtaaatggggaggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccagacccatgtacctgaggctgatttccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcagcctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagtgagtccctaaaa

SEQ ID NO: 225687 - DNA, 1183 bp, Homo sapiens
gtaaatggggaggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagtgagtccctaaaa

SEQ ID NO: 225688 - DNA, 1210 bp, Homo sapiens
gtaaatggggaggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccagacccatgtacctgaggctgatttccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagtgagtccctaaaa

SEQ ID NO: 225689 - DNA, 827 bp, Homo sapiens
gtaaatggggaggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacagtaagtgggcctccttccgggacctgtcgagaaataagtatatataagtatatatagccatgccctgtcacccaggctggagtgcaatggcgcgatctcggctcactgcagcttccacctccc

SEQ ID NO: 225690 - DNA, 510 bp, Homo sapiens
tgcattcctaacatgagtacatgagagttccggttcctccacatccttaccaactcactgtgtatctcactgtggtttcaatttgcatttccatactgactaataatatttagcattttgtaatgtgcttatatgccatctgtatatattctttggtgaagtatctgtacaaatctttcgtccattctggacactagtcttttgtcaaatatatgctttgtggccaggtgccatggcccaagcgtgtaattcctgcactttttgtaggccaaggtgggtggattgcttgagtctaggagctggagaccagcctgggcaacgcggtgacaccctttctccacccagaatacaaaaaattgtcggatgtggtggtgtgtgcctgtggtcccagctacttgggaggctgaggtgggaggattgcttgagcctggaaggtggagcttgcagtgggtggtgatcatgccacggtactccagcctgggcaacagagcaggaccctgttgcaaaaaa

SEQ ID NO: 225691 - DNA, 577 bp, Homo sapiens
cgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacattgtaagtaatgacatttcattgttttctgtttgcctttttttatatatataattggctggtaatatgagaatatgcttataaaggagaaatttatttaaattctgtcccaggctggagtgcagtggcaccatcgtggcttacggcagtctcaacttcctgggctcaagcagtcctctcacctcatcctgcctcagcctcccgagtagctgggactacaggcgcccaccaccatgcctggctaatttttttgtatttttagtagagtcagggtttcaccatgttagccaggatggtctcgatttcctgacctcgtgatccacacgcctcggcctcccgaagtgctggaattataggcgtgagccaccatg

SEQ ID NO: 225692 - DNA, 432 bp, Homo sapiens
cgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccct

SEQ ID NO: 225693 - DNA, 715 bp, Homo sapiens
  misc_feature (595)..(595): n is a, c, g, or t
  misc_feature (604)..(604): n is a, c, g, or t
  misc_feature (627)..(627): n is a, c, g, or t
  misc_feature (630)..(631): n is a, c, g, or t
  misc_feature (654)..(654): n is a, c, g, or t
  misc_feature (661)..(661): n is a, c, g, or t
  misc_feature (672)..(672): n is a, c, g, or t
  misc_feature (689)..(689): n is a, c, g, or t
  misc_feature (694)..(694): n is a, c, g, or t
  misc_feature (703)..(704): n is a, c, g, or t
  misc_feature (710)..(710): n is a, c, g, or t
tctcagctaccaactctgcccgaaatctagatcccagacctgctcctgggaagctctaggatgtgactttaagctggaaagactctcaggagctaggtttgatatggcacaatctcaaggcatcgctaagtctgaagttcttccagcaggtctgtaaaccacaaaggacaagcagctcagagattagcgaatgcgtctcagctgtcctagaaaagtgctgtcagcaagtctgaagagtttcccagaagccctgaaaggacgcaatagcatcatttagcagaaagaaacagccctggattaatgttcttttgggattcatcttctggctttgtgattttgggcaagttacttatcttcctccatttattcacatatataatgagaggagtagtacctaccttacaaacttttctgtgagaagcaaaaaaaataaaaataaaaaataaaagataaaattgttaaatatttgctatgtgtaaaatgcttattcctttaaagttttcatgtcagttaaaacatgttattggcttgaatcctgactcaagaacggaaatagtaattgtgtctgccattcagggtgacacagttatttccnctggttcanggtggtggggtgggagctactanatnnaacaggtggggcaattcttgatncattttngtgttttttgntactactatccaccaantctgntttcactcnnaagcanataaa

SEQ ID NO: 225694 - DNA, 719 bp, Homo sapiens
  misc_feature (599)..(599): n is a, c, g, or t
  misc_feature (608)..(608): n is a, c, g, or t
  misc_feature (631)..(631): n is a, c, g, or t
  misc_feature (634)..(635): n is a, c, g, or t
  misc_feature (658)..(658): n is a, c, g, or t
  misc_feature (665)..(665): n is a, c, g, or t
  misc_feature (676)..(676): n is a, c, g, or t
  misc_feature (693)..(693): n is a, c, g, or t
  misc_feature (698)..(698): n is a, c, g, or t
  misc_feature (707)..(708): n is a, c, g, or t
  misc_feature (714)..(714): n is a, c, g, or t
ttgaggtaggtggcaggagatgaaacaagtatattgaacgagtctgctcctgggaagctctaggatgtgactttaagctggaaagactctcaggagctaggtttgatatggcacaatctcaaggcatcgctaagtctgaagttcttccagcaggtctgtaaaccacaaaggacaagcagctcagagattagcgaatgcgtctcagctgtcctagaaaagtgctgtcagcaagtctgaagagtttcccagaagccctgaaaggacgcaatagcatcatttagcagaaagaaacagccctggattaatgttcttttgggattcatcttctggctttgtgattttgggcaagttacttatcttcctccatttattcacatatataatgagaggagtagtacctaccttacaaacttttctgtgagaagcaaaaaaaataaaaataaaaaataaaagataaaattgttaaatatttgctatgtgtaaaatgcttattcctttaaagttttcatgtcagttaaaacatgttattggcttgaatcctgactcaagaacggaaatagtaattgtgtctgccattcagggtgacacagttatttccnctggttcanggtggtggggtgggagctactanatnnaacaggtggggcaattcttgatncattttngtgttttttgntactactatccaccaantctgntttcactcnnaagcanataaa

SEQ ID NO: 225695 - DNA, 1033 bp, Homo sapiens
acaaaacctgtatcaaattagcacgcatgttagttttgaattaaaaagaaactttttaaacctggcttaagtatgcttgttaacaattggacgatatacagtattaatgaattgccctggatttactagttcccctttacccacccgcctccaccaaaaaaaaaccctcagagatcaatacaaggccaagtgaatgatatgtaggtgcccaaatatggttgattctgctgcatttaaaaaaaaagaggagtgggagttaaacttctaatttttttcttcttaagttccaacatcaacagccttttcttatttagcctccatgataattttattctatgtttgtttcgacttggcgaaggtctcctgaatttgccaaattaccaatgaggatagtattggaaagatgagagaggcacaggcttggagcactgtgaggggaacagcagtaggaggcagataattcagaatacattcctgtagttataaaagaagatttatttattttcacctttttacagatccagacccaacaatgagttattcagtttgaaacccacgtagtggaggcagtctctgtatacctgctgaatgttgagttacaatagagaagcctgggttaccacagggagaggaggatgaggaagtaaaaatatgtgttcaaagagggcatttcaacactgtgagctaactttacaacgggaagtgaaaatcatgaaaaaaaggggaaaatttgttgtgagagactaaaaagagcaaaataaagcaagcccatttttcgggaatagaaaaaaaaaaaaaacagtagcaataaccaaataactgatcagggagatttatttccgtgatatctttttaaaacaaaaagggaattgtcgtatcactgctcttaattaaatggcaacaaacacacttataatgggaactaaatagctaattagagggtgcttggggaataaatagcagagttttaaaatctcctatatggaaaacatgtccaacaattggaatgaaaggattaaaaagagagaaaagg

SEQ ID NO: 225696 - DNA, 444 bp, Homo sapiens
  misc_feature (9)..(9): n is a, c, g, or t
  misc_feature (11)..(11): n is a, c, g, or t
  misc_feature (16)..(16): n is a, c, g, or t
ccttccaananctcanttctccctgggttaccacagggagaggaggatgaggaagtaaaaatatgtgttcaaagagggcatttcaacactgtgagctaactttacaacgggaagtgaaaatcatgaaaaaaaggggaaaatttgttgtgagagactaaaaagagcaaaataaagcaagcccatttttcgggaatagaaaaaaaaaaaaaacagtagcaataaccaaataactgatcagggagatttatttccgtgatatctttttaaaacaaaaagggaattgtcgtatcactgctcttaattaaatggcaacaaacacacttataatgggaactaaatagctaattagagggtgcttggggaataaatagcagagttttaaaatctcctatatggaaaacatgtccaacaattggaatgaaaggattaaaaagagagaaaagg

SEQ ID NO: 225697 - DNA, 438 bp, Homo sapiens
ttaacggtggttaaaatggtgaattttatgtgatgtctattggactagtccgttctcacactgctataaagaaatacctgaaactgggtaatctataacgaaaagaggtttaattggctcacagttccgcaggctgtacaggaagcatggctggagaggcctcaggaaacttttaattatggtggaagaggaagcaggtatgtcttacatgcctggagcaggaggatgagagagaacagggaggcgctacacacttttaaacaactggatgtggtgagaactcactcctatgacgagaccagcgagggggaactccgccccctcccaccaggcccctcttccaacattggggattacaatttgacatgagatttgttcagggacacagacccaaaccatactgtgtatttcaaaaagtaagtttacaatgttctgaaa

SEQ ID NO: 225698 - DNA, 475 bp, Homo sapiens
tttgagagtcaaactataaattacttcccaaggttagttctacctatgcccaggaatgaacaaggacagcttaaaggttagaagcaagatggagtcatttgggtctgatctctttcactgtcataatttcctcagttacaatttttgtaaaggtggtttcaaatgctttgctgacctcccataaacaaggatgtgccaattgtaacttcagttctgcaattcaagtctgctcccaaaactaaagtccattgaattgcatactgattgataatgttcattacgagtttatcttcccatgtgcagagcaaagacaagaggagatcagccattcctccacctacccagagacgttgcattggaaaggagccgtatcttctagtatggttttgcaaatgtaaaatgtaaaatctatgcacgctcacaggaagggagaaagaaaaaaaataaaagaggaagggtaagaaaaaaagtaaaa

SEQ ID NO: 225699 - DNA, 434 bp, Homo sapiens
aatagggtcattgactccagaaattttagctaattcattggataaagcggtaagtctttgcaaggcctttgttatgctctcactgggggcagtgttgtttggaatgaaggtacaacactgggttttaatcataacacaaactccagcctgggtgacagagtgagactccgtctcaaaaaaaaaaaaaaaaagaaactcagagaaatttactgtatgttacaattcctcccttttaattttcttatgattttttctctttaaacttttttaacgtgttttggctttgctgtttgatttgatcttttaaaaggaaaagcttacttgaataaggtggaggagaactaagggaggtttcagtaaatgctgttcgtacaatcctttgtattagcctacggatgcatggtatgacacaacgcctaacaagaataagtaca

SEQ ID NO: 225700 - DNA, 508 bp, Homo sapiens
ccagagatgggaagggaggcaatattgaacgtgtgctaggataaggctttcatataaaaagtgttcagatattaagatatgtgaaatatttggggcccttcattagatagctatttcaatcagtgatgcttttaagttccaaattgtctggtaattatgtaaagatgctccagtgaaacaccatttttggcttagggaaatatttatatacttaccagatagtaagtatataattatgaatatgatagtaagtatatgaattttgaaaatatgcaatgttattacatagctaccatataaaatacaatatatgagggcagatttacatatcccatgtagaaatgtgggtatttatatataggaaaaggaaaataaacaagcattactgaagtatttatgagtttatggcatttaactcatctcaaacatttatgcagtgttttttctatactaatttaatgtttatatatgaatgcataaaaataaataacatggaaaaattaaaaaa

SEQ ID NO: 225701 - DNA, 500 bp, Homo sapiens
cttgaacctgggaggcagaggttgcagttagctgagatcgcaccattgcaccccagcctgggtgacagagcaagactccgtctcaaaaaaaaaaaaaaaaaaaaataggaaaagttatctctgtgctccagaattctctgaaacctgcttgtcagatggactagaggctttcgtagaaaagtcagttgctttttgttttctgaaaatcattttgtcccggggaaaaaaaaagcctcactgcagataatcattctctatgttaggtgttaaaatcctttacacaggagttgcatagagcccctactgcctagaatggttcttctgaaaagctgctatttgcgctgtgtgggtggttactcattgaggggcagagctgctctcggtgagcggtgggtctctttgccctgggtgtgtggctgtgtggttgtgtctaggaagtgtgaatctccagtgtagtgctgtggaagagaggggcagggaaatatgaactcaagaggcgg

SEQ ID NO: 225702 - DNA, 472 bp, Homo sapiens
actgatggccatcagtacctcgtaagacagcagggttctactaaaagccaacacccaaatcaacgggtggactgtaggaagatgccccatttgacagcagtagaagtcacaggtctgcaggagctccaccaagtccatcctgcaggcatattatgtttggcctgcccagtaatttatttttaatctgaactaatatttttattttttttaattatatattaagttctgggatacatgtgcaggacgtgcaggtttgttacatcagtaaacatgtgtcatggtggtttgctgcacccatcaacccatcacctaggtactaagccccacatgcattagctatttatcctgatgctctccctcccgcaccttcctggcaaggccccagtgcttcttgttctcctccctgtgtccatgtcgaactaacatttttaaattgggagatttcacataaaagtccaaaattccaacttct

SEQ ID NO: 225703 - DNA, 727 bp, Homo sapiens
ttccttgaacagcctagctaccagctttctctaaatcacccctacattcacctgatgtaataatcttcacaatcttcatcagtacctgagatcgtgaaagtcagctgtcccatctttcctcccctagaatgctgttagctccatgggcacagggactcttcttctgttccctgaatacaacatctggagcagtagctggtatatccttggcattcaataaatgggatgaatacaaccttaggtaccttaggtagatattattcatgcatcccaatatttttcttcgccaaaaaagtagcaaacgaactactcatatttgtaggacattctataattacaaaatccttcacatatacttttattcaaatatctcagcaattggggggtaagtatcttcattctagaaaataaaaatctgaggcccagacattccctgacatgggtagggcttccagcccagtgcccttcccactgtgcagcattcttcccaccacaattgggagccctcctcctccatctagccacaccctggccatccaccaggagctgcccctcctcctttcacttcccaggcacacaaggactttgacgcctgtgctcacattttcctgccaccttgcccccaaccccataaacactgtcaattaccaagctccagctccaggcctacctacgattttgccttcaagaaccctaactcaagtttcatcatctccaagggcaagta

SEQ ID NO: 225704 - DNA, 440 bp, Homo sapiens
acataccctttgtcatcagtcagtatttattgagcacgtgctgcgtaccctgggctgaacagcatacagggtggtgtaaggaaggacccgtgtctttaataaaataggggtctctctccacctaagtccccttgggttagatggcttttctgcaggctgcactgacgcagggatgtgtgagtgacactcaaggacaagagcaattctcagctccttaattccagtcctccctcctccctgtcctctggggcctgcccaccccaccccaccccagggcccacggggaccagagaggaacttagtacccttggagtccagctatgaagtagaaactggaatgcagtggtttcacttcatcttccaaaagtagcataagttcttgtttctaaaatttaaagtaataaacagttgaagaacatttttaaaatgaaactattaaa

SEQ ID NO: 225705 - DNA, 532 bp, Homo sapiens
tttctctaataatttaaaatttactggaaagaacattagatttgtgccactttgtttcctacttaacccatttattctttgttcttttttcctctttttctgcctgctttgaggcagtttgagtattttttatgattctgtcttatctccacaattgacttattgagtatatctcacttaaaaaaaagtagtagtttccttagggtttaagatacacatctttatcacagtctaaagagctttagaataaagttttcagaaagagctttagaataaagtaaatgcaggtacctaactgacacatagttttaacaaaatatatcttgtttgtgtagtataaattaagatattttgtatattattgacatttatgataactaaataaatttcttatattatccctacttttttttaatgcaaagactgccaagcatgttgtattccttaacccaaatatgtcaagttcttatagtggacaaatgtgaatttcggatctccccattaacaagacatttataagaagactgttttc

SEQ ID NO: 225706 - DNA, 388 bp, Homo sapiens
gctgccagagtagtgtaagcctaaaggaatctaaatccagcccatagaggcaagcctcacccttgggctctcagttcctctctctgctctacagaaatcaaagtcggccgggcacagtggttcatgcctgtaatcccaacactttaggaggccgaggtgggcggatcacctgaggtcgggagttcaagaccagcatgaccaacatggagaaaccccgtctctactaaaaatacaaaattagctgggcgtggtggcacgtgcctgtaatcccagctacccgggaggctgaggcaggagaatcccttgaacccaggaggcagaggttgtggtgagccgagatcatgccattacactccaccctgggcaaaaggagcaaaacttcgcctca

SEQ ID NO: 225707 - DNA, 685 bp, Homo sapiens
ggcactggtcccattaggaattggcattgccacaggagaacgagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagcatatgcacgtcagttctccctcaggatcagctcaagcttgcagacttgtagctcgctatagaggactcacccagcataacttgactgtagcgtggcagctcctctgaatgcctaa

SEQ ID NO: 225708 - DNA, 737 bp, Homo sapiens
ggcactggtcccattaggaattggcattgccacaggagaacgagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaaccctaaagactgacaatatccttcaagctcctttgaaagcaccctaaacagccatttccattttaatagttggatgcggattgtacccttcaatctgaac

SEQ ID NO: 225709 - DNA, 618 bp, Homo sapiens
ggcactggtcccattaggaattggcattgccacaggagaacgagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccacccccgaaaccagacgagctgctagacagcctat

SEQ ID NO: 225710 - DNA, 270 bp, Homo sapiens
tcctgtcacacacaaacatgtatgatctcatggcaagttttagagacaggacaggtatagtcataaccactggacacatgagggaactgagtctctaagtgtcgaatgaacttttccaagttacacagctagtaagcaaagtgggggattgaacttcaggtgttacggtttggtggtggtcattgtggcctttgcagtgtgtattttgactgcaccacatgatatcaggaggtggcatagctaagaagttacaactgcaggaatctggag

SEQ ID NO: 225711 - DNA, 403 bp, Homo sapiens
cttaataatgctcaggcagtggtggggggctggcatcacccctcaggctcctgtggcttaagcggggcctctgcctggtgaggtcaggtaacacgggtgttggtgatcatgcgggcagcacagagccggagctcctgctgttctgcctcggctgcacgttttcggacacgagagttatgttctaatagaccgatcagcttggggcaaggcagagacactccaaggaagtaaaaattcccaaagctccttccttcagctcatccctgcagacctcctatacagaacgagaggtgccacttgtctttccgtgagacaggttgtattagtccattctcacattgctacaaagaactacgtgacactgtgctccagcctgggcgacagagggagacgttgtctcaaa

SEQ ID NO: 225712 - DNA, 454 bp, Homo sapiens
agagagcatgtatagggaaactctcatttttaaaaccatcagatcttttgagacatattcagtatcacgagaacagcacaagacagacccacccccatgattcagttacctcctacgtggttctttccataatatgtgaaaattgtgggagttacaattcaagatgagatttgggtggggacacggccaaagcgtatcacttactgttttattaaaacttaaatttttggctcaagttgcacctttatttacaagactcatctattgaaaagaaaacatggataaatacaaatttgtgtcaagctgtgtaataacatcatgatgctaaactactgctaacatataacacatactatccctaagcactggaatgggacttgtgtgcaattcttagccgtagagtgtacaaccatgagttaaatgaaatatattttacttggatttataggccata

SEQ ID NO: 225713 - DNA, 309 bp, Homo sapiens
ttaaaacaaatgaaaatagagacacaatataccaaagcctctgggatacagcaaagggaatgtttataccactaagtgcctacatcaagaaaacagaaaaatctcaagttaacaactaattgttggacctaaaggaactagaaaaaacagaacacactaaacccagagctagcagaagagaagaaataactaaaatcagaggagaactaaatgaaattgagaccaaaaaaaaaaaagagtcagtgaaacaaaaagttggttctttgaaaggataaacaagattgatagactactcgctagattaacaaa

SEQ ID NO: 225714 - DNA, 2479 bp, Homo sapiens
ggggactcgtcccagagtttgctgccgccgccgccgctgccattagagcggttttaattagctgcaggatttttaatgagctgaaatcaagaagagccccatctcagaagtaagcgagagccgcgcgcagggaagaactagtctgacaaaacagaaggaggtggtgctctcgggggactgggctgtaggctcccaccgatcgatcggcgacgagcagatgagttcccgaggccaggaggctgaggagggaagccagggctcagagaccagcgcccggtgcagagtccccgctgctgccaccgcggcagaaggcacggtgccggattcaaggtgacggcagtgcctggctccattctcctcaagttgccatagcagcctctctcccaacaagcagcttctccgggagccctcagccgggagggacgtcattgttctctcctgcccgtgtggtgcaaggagacccaccggacagagaactttcccgagcccggggtccgctgaccacgtgggtgcacccatgctgcctggagccaggcacagggacaggtccccacggccacagggaatcctctgggcagctgaggggagcgtccaggcccagaagcagctgcagccaagcgtgtccttggagccgtccatgcgtctgtccgcctgctgccggtcgccactggagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagc

SEQ ID NO: 225715 - DNA, 2141 bp, Homo sapiens
  misc_feature (3)..(3): n is a, c, g, or t
  misc_feature (6)..(9): n is a, c, g, or t
ggnacnnnnccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagc

SEQ ID NO: 225716 - DNA, 705 bp, Homo sapiens
  misc_feature (3)..(3): n is a, c, g, or t
  misc_feature (6)..(9): n is a, c, g, or t
ggnacnnnnccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggacagagacctctgcggtgtcttcaattaatggaagaccaccagcctgtattgcagagggtggcgtgcttctgcagcccagaagattagaggaaatctgggaattcaagactttcacaggcatcgacctacagtccccaacgcatttctcaggg

SEQ ID NO: 225717 - DNA, 522 bp, Homo sapiens
aattatttagactttgctttccttccatgggttccaatgatccctgctcagccgtttctgtcatgacctcagctgtaaagtatgccatcgcttttggctggttgacatcagacttcaggattagcttcaagaaggggacctggctggaacatcgtgtgagccccatacagtgcagaatacctcccagttgctccactgtctctgggatttaatgcttcagaggagtcagagagtggcctggtttttgcatctctatgggaagtttgtttttttcctggcctagatatttgtaagattttctccactaagtatgtcaaaattttggcaaaacctgtctaagtatgactctcttttcaccagttctgctagaatgcagaagctggctagtttgctcatatagtctgtacatttccatataaaattgttgtagttcaaaaactgtagaataatggaaattttgtatggcccaatctacagtactaggtctgtcttgagcccgcttaagtttgtttcctagtaaaa

SEQ ID NO: 225718 - DNA, 250 bp, Homo sapiens
cttttttttttcaaatcagacactctgtgtgtccccaggaagggataaatcatgtgcttatatattggcatactcttcagtggatcatagttggatgtttaatcccaataaaacttctgttctatgaccttccttttgtttgttcttttgctgaccaactcacatccttttcaagataaaaccatgttttttaagataggttatatcattctatcgaagtacaaataaattttggttccctggaaaactc

SEQ ID NO: 225719 - DNA, 264 bp, Homo sapiens
ttatcatttttctcacactgttttgcgtatggctcctattgcactcaaaatgtttttgagattcatccatgttgttttgtgtgtcaaaagtttgttcctttagccattccatggaatgaatgtatcacattcttgtattgatagatatttgaatgtatattgatagatatttgaatacaagaatgtatccattcttgtattgatagatatttgaatgtttccagtttttcctattacgaataaaactgctatggacattcttgt

SEQ ID NO: 225720 - DNA, 218 bp, Homo sapiens
gagcatatgctaaactcctcagaatgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaagagaatatattaacaaatcagggatatggaatttcaaaaacactatg

SEQ ID NO: 225721 - DNA, 129 bp, Homo sapiens
gtacacaccgtcagcagcagccagggtcaggagaaaggcgagatgtgaagagaggccgggaggtatcagatgacgtttccagcactagaccagaagaggtgcacacagcctagaccccctgaggggtac

SEQ ID NO: 225722 - DNA, 532 bp, Homo sapiens
gggggcttccaggtcagaggtagataagagacaaatggttgcattattttgcatttcttattagcccttccaaagtgggcaatcagatatgctcttatctcagtgagcacagggatgagtttgagttgtttgtcctttgtccacaaggaaactccttgtgagggaggtaagtagatagcttttttttcttagtagctatctttttttaggaatagaatgggaggcagttttgccctaagcagctcccagcttgacttttccctttgacttagtgattggggggttccaaaattcattttcctttcacaactcttacagtgtggtagtgcttgaagtttcataacagtcagagcagaatctcactgcttgcttcctgctggagagaggaatctctgtccttcagtggatgatgttttctgtggtcttgttcaggaatttacaaactagaggaagccttatctcaccaagggaaaaaaagacaaataattggcctctgagaattgcggcagggagcagggagtattagtggggg

SEQ ID NO: 225723 - DNA, 248 bp, Homo sapiens
ctgcctacaagcgtttgctgcatgacatactgttcatatagatgtaatgtttcatgacaaagcaaaatgtatcctgtataaatgatctatttaagtgtgaaatagaaaacacactctccttgtttgttttaacatttgctgatggtaccacttctcctttgcctctttctactgctttcctatgtgccttttcagctttgcagcagcagcagcaacagcaacagcatctaataaaaataataacaaca

SEQ ID NO: 225724 - DNA, 403 bp, Homo sapiens
cctctgctcacccgcccatctttaggaagccagtcttagaaagacagtggctggccagaggcctccctccccaacactcctttcccccaacactcctttttcaaacttctgtggttatggaagtcaggatttgaaaagagatttagcaatgtttttctcattctgtagtggttttctttttccggttgaagaggctatcctcttggccttcatgaagtaggttttaccacagcgttgaaagtgaagtattaaaatataagctgataagagcaaggaagtttaccagaaatggtaggaaatagaagagagccttggagaagcattttcttacctgactttagttcatctctgtttatctaagaaatttcaaatattccagtctaagagatttgaaattctgtca

SEQ ID NO: 225725 - DNA, 564 bp, Homo sapiens
actgacattgttgtgaaccaactgaagccaatttgatctatcataaccagctttattttagtagaaaatgaaggtctctaatagagatagatgagagctatagatgataccccaaatttagctaccaagtttatattacaatggaagaaactttctgctctaccagacctattgtaaagttacagtagttaacatagtgcagtattagcacaaggatagacagactcttgaaacaaatagaaaacccagaaacagatccatgtgtatttggatgggcactgtgatactgacaaaggcagccttgcagatcattcctcaataaatgggtatccacatgggaaaaaaacaaaaaagataacttatccctgcctcacaccacacatgaaatcatttccaagaaaattaaagacataaatgtaagaggcaatattacaaaatgttttaggagataacattaggaaaatatatttataatctctaggtataggatttctaaagatacaaaaaggataccaagcacaaaaagattggtttatttgaatacattaaatttaagaacttctg

SEQ ID NO: 225726 - DNA, 725 bp, Homo sapiens
tcaactattgcagtggttgtctatgacattacaaacatcaattcttttaaggagacagataagtgggtagaacacgtgcgagcagaaagaggtgacgatgttgtcatcatgttgttgggtaacaagattgatttggataacaaaagacaagtcactgcagaacagggtgaagaaaaatccagaaacctcaatgtgatgtttattgagaccagtgccaaaaccggttacaacgtgaaaaagctgttccggcgtgtggcttctgcccttctttccacaaggacttcacctccaccaaaagaggggacggttgaaatcgaactggaatccttcgaggagtcaggcaacagaagctattgttgacagcttaggctttctctgcctcatttgatggatttcttacatttgggcttgccataccagttctcctccccacctcgttttatgatacatggccacttactctcttccaattcctaggcttggggtaaaaacagaacccctgaaagtgctatcattttttcctgaccgcatctcacagctactgggtggaagcttcttgcagcacctgggaattctaccttaccttctccgacagctaaaagacatctgtagagaatacagttctacagcagctgacatacttcaaaggccaatacaattcattctccactgtttgttgttgtttacctacaccctcaataaatggttctttaacctaaggctgt

SEQ ID NO: 225727 - DNA, 463 bp, Homo sapiens
agttaagaaatctgttgtgctttgagggaaattatagcaaaagcatttcttagaagttcttagacgatgtggttttgtttctgcttgatttcacactaaccttggtgatgcaaacagaaaaatacaatatttgtattgtctcgtgtgtcctttttctgaaaattgtcctttggtttaaatcatgcttctcttcaacttgaatcagcattgttttaggcaaatcatgtgtgggatagatgatgaaggaacaacggtgtgacagaatatatgtaaacatttcatttagttcgactttgtgtcacttctccacggcttcatgttttgccgccttatcttaggaatatatagcgcagtctgcatgaaaagagctttgtgtgagaattcctggccagttgaagggtcagggcctgtgcgttatctgactgccagcaagatcactggtgtgtcctcttatttttaactt

SEQ ID NO: 225728 - DNA, 848 bp, Homo sapiens
atgacttctgaatccctgcttctagcccctccaccagttaactaaatggtgtcaacctgaacctggccaaagcccacctgacggccttcagccctgcggttctgtggggaagcggcctcacgtccaccctggttccctccctgacttctccctcctctggacctcatccttcagccagtcctggcagcccccggacccaccacctgagcactcctccccacccctactgccaccagcccttcccggctgccacgccctggcccccagctcttatatccctgtggccattcgtgccctcgaacccccatctccataccacggtcaactaaaaatgcagagcataccaggccactccccaacctagaagcttctttctcagcagccctttggacgtggattctccccaggccccccgtcattgcactgggctcccagccccctccctgagttcacctccatggtcctgccccactctcttctcttggttctttgaggcatcaggtgtttgccaccactggacttctgtcatcgctgcctccaactcttcccccatctttccggagctcccccacccccatccccttcgaatctcagcttggctgtttcctccttggagagatcactcccaggaccccctctgcaggggtgccacatcacctgttctgaattcttaagagcacccctgctctcagaactccttatttatttgacttgtttgtatccctgaactagaatgtaagctccatgagggcaaggccttcctctgtctcgtttccctgctgtatccccagtgcctggaatagtgcttggtgtgtagcaggcactcaataaactgtggaaagaataaa

SEQ ID NO: 225729 - DNA, 838 bp, Homo sapiens
atgacttctgaatccctgcttctagcccctccaccagttaactaaatggtgtcaacctgaacctggccaaagcccacctgacggccttcagccctgcggttctgtggggaagcggcctcacgtccaccctggttccctccctgacttctccctcctctggacctcatccttcagccagtcctggcagcccccggacccaccacctgagcactcctccccacccctactgccaccagcccttcccggctgccacgccctggcccccagctcttatatccctgtggccattcgtgccctcgaacccccatctccataccacggtcaactaaaaatgcagagcataccaggccactccccaacctagaagcttctttctcagcagccctttggacgtggattctccccaggccccccgtcattgcactgggctcccagccccctccctgagttcacctccatggtcctgccccactctcttctcttggttctttgaggcatcaggtgtttgccaccactggacttctgtcatcgctgcctccaactcttcccccatctttccggagctcccccacccccatccccttcgaatctcagcttggctgtttcctccttggagagatcactcccaggaccccctctgcaggggtgccacatcacctgttctgaattcttaagagcacccctgctctcagaactccttatttatttgacttgtttgtatccctgaactagaatgtaagctccatgagggcaaggccttcctctgtctcgtttccctgctgtatccccagtgcctggaatagtgcttggtgtgtagggtgtatacggggtcctctaa

SEQ ID NO: 225730 - DNA, 698 bp, Homo sapiens
ccagttgtacatttaagcatataacaacatgcttaattattagatgcttacaagctttgcttggcataggtgtaccatgtattattctatgtctttccttcccactgtcctatgatagccattaccttctgaaatctcagtaaatgatgcactaccctattagcattctctcttctgttagccctccttatgagagttattctttccctcatcccactcctaaaaattcatttggcctttgtggagtatttagatcaagtcattattaaactattccccactagaattattaatagttgataaaatatggaaaatatattattcatatgtgagtgaaagaacacttaaagcataaaaaagaactacatggccatatattgcatggcaataactatattagcagcaataataattgtaatagtaataataataatggctaacactttagaagcttctgtgttaggcatttccgggtgcttttcatggtacagaagctcatttgttcctcatactaaccctcttcactactctgccactgcctctcaagccatggatatgtgcactttagagtttttacttaaagtaaaaattcctgtagaatagatggtgttgaccccatcagaccgtgatgcagttagaagtgcatcccgtcttttacgatggccatacaacatcacacaaatcaaggtaaacccttg

SEQ ID NO: 225731 - DNA, 820 bp, Homo sapiens
gggagacttgctgaggataagggtcaggagcccaagagccaggtggaaaggtaggggatcctggcttgggttcagcaggatgggagaagccaaaggcctgcctgacttcatcgggtgactcccggaaggttgctgcccctggtgctccttctccactgagcaaagcaaaagaaatgattttaaaagggaatgcaaagaattccgtggcatcttcttcctcaatgatgtctaaaactggggagagagagtgcagtctgagatgtcggagaaacgctggcaggggatggtgggaaaatccacacttaacctagaataatttcaaaacactttttaaattctctatttcttatcaccctctattaactcaactctgtgaaacaaggtggggcataggaaatggaaaaaccgggctatggaacccgttatggttcctccacaacagaggtaggtcagagcagcatgggaaggaagagaggccattcctgtctttctcacccttccgcagtgaggaggggcgggagcctgtggctgacccattcctggggtctgtgttacttgtagggccttggcaaccttcctcaactctcgcaggggcttaagggcattttatgtggttttaaaatatttttttatttgaccccttttaaataggaagctatatcacaaacataaaacaataccccaatttttttaaaaaagtcaagggatagatgaaaagtgaattaatcaaaaaagagacgttcactgattaaagaattaataaatggtacattcatgaatacttaaaactgaacctgtttaaaaaataataaatttgatc

SEQ ID NO: 225732 - DNA, 502 bp, Homo sapiens
gtaccatgttgtttttgtaagaaaggaatgttgagtcatatcgacatgtattattgtcaaaaagattatgtttttagatagagctaagcttttgatgccaagccattgattacactgattaactttggtatttgaaaaatattaggaagtagtaattatgattaacattctaaaagcagtgtcccacctcaattttaaatttatctgattattgataatttttctgtattggaaaatagtttccatggaattgttattttctatggatgtatcaaagcaacatttgacatatttttttaagtctttaggtttatcagaatgtaggttgccaggtataacttacacaaacaagttgagtatagagagttactgatggaagccagtgttggacttaatcagtttctctgcatccttcctctccccacaatccttgcacagcactaatgcttcatcctgcttaccatcaggaggcagccactcagtaggtaatagtgaaggtact

SEQ ID NO: 225733 - DNA, 411 bp, Homo sapiens
tactcgctctgatttagggcaagataacattctgtactaaaaactcaagtggaaacctacacactgaacttcagatttccagccacaattctctcccactcccaccatgccatgtatctgctcagatcccgttacactggcagccaggcatatactcccaggcaggagctaagacaatgcatcattactggcaaagtaaccagccccctcctccccgattctgtagatactggtatttggagttctcctgcgaaaaggccagggacatctagcaccacccagcgagacctactcattgacaggttccacccaggtaggcagaatttccaatgagcttttagtgcttggaacttaaatatgaataaacaaaatcatcagaaatttgagggaagctttttagcatggaaaaca

SEQ ID NO: 225734 - DNA, 543 bp, Homo sapiens
  misc_feature (508)..(508): n is a, c, g, or t
gaggactgagcccaggagtaaatccaagaccagcctgagcaacataatgtgaccctgtctctgcaaaaaataatttttaaaaatttagccaggcatggtggtgcatgtctgtagtcccagctacttgggaggctgaggtgggaggatgtttgagcctgggaagatgaggcttcagggagctgtgatcaccaactgcattccagcctgggcaacaaagtgagtccctgtctcaaacaagcaaacaaaattcaacacaaagttcagatcccgttacactggcagccaggcatatactcccaggcaggagctaagacaatgcatcattactggcaaagtaaccagccccctcctccccgattctgtagatactggtatttggagttctcctgcgaaaaggccagggacatctagcaccacccagcgagacctactcattgacaggttccacccaggtaggcagaatttccaatgagcttttagtgcttggaacttaaatatgaataaacanaatcatcagaaatttgagggaagcttttagcatgg

SEQ ID NO: 225735 - DNA, 904 bp, Homo sapiens
ccggggggagagtgtggaaagactgagtgcaggcagttcatggcaagtgtgctgctcttggtcgtgagccgctgcctgccctggtagccgtggtgtaaggtaagggacgtgaggccccaggagtacctgacctggctccctgcgcttcttcctgaccgagccttgcccttccctggtggccaaggagcttgtagccaatcagccaaggaccccagagccacctcagactgaactctgaccacttggagtctgcccaaggcctccctctcacttttctgcagctgcctagacttggtggcattcacccccaccccgccccttagctttgctctgccccttccctgggtagactttacccaccaataacatgggcggttttctcctgtcgtgtgggctagcatacccgtgatgctgacttgtgccctctacccgtctcacccgggctagggcccactctttgcacctgcactctgtctctgagcacatgcacagatctgaattcttacactggcagatggagctccgtgggctcctgtgttaccacgcaggcttcaatgtcatataaaacagagcagggagtgaaacttccagtagctctgttttgtcacccacagccctgcaagatggagcagtttacacccagctctgcaggatgtagcctccagtattcacaggctccgcagggggagggaggggcgccaccagaggcttcctgttgctgcccacagggtatcaagtgttgggttcttctgacctgtggctgtgccccttctgaagggcacaggtttgtgggtatagggatgagcacattcgggaggaagaacaagaaaccagagaaccaacagatacctttatgtaattctctaaaataagcagggtaggtggtattcttccttttgtaaaa

SEQ ID NO: 225736 - DNA, 544 bp, Homo sapiens
acatattttccagaacacatccctgtcattaagcaatgcatgactgtattttgaagggtttactaactgattaaatgtgggctaggaaaggaagagacgaagattatttcatttctgccttggtaactgaaagaatagggttattgtgaactgaaatgtaggtgactatagaaaagcagatttgagggggaaatttgaggaactcagttttggagtgttaagtttcaagatgccttttagacatccaagtagatatgtatagtaagcagttggttatgtcttgaggtcggggcagagatctggactagacatataaatttgagagccatcgacaaaaagaagatatttaaagacataagatcgaaggtcttacttagaaaatagttcacataaaaaggaggtttggagactgagtccaaggcaccccaatattaagaagttagcaaattaagagaaacctacaaaggagtcttagaagaagtggccaaagaggtgggggaaaaccatggtttgtattagtgatcttgaaaaagtagtattaatg

SEQ ID NO: 225737 - DNA, 448 bp, Homo sapiens
ggaatgctcaaacctgtaataataatcacaataatgaatatagtttcttctaagttaagtgctaaaattcggtgcaaaagaaaggtgtaaaaccatctgtaaactacctaagaatactgaatgaatgcataagttttgcagaaaatacatgaactaaaaggacagatttgggcactgcagtgtatacttgtagtccccactacccaggaggcggctgaggcaggaggattgcttgagcctaggaatgtgaggctgcagtgagctacagttacgtctgtgaacagctactacattccctcctaggcaatgtagtgaaatgccacttctaaagaaaaataaataaattaaacaataacaagttaaattatagcaccataaaagaaaattcaaatatcagttaaaatgctgtcacccatgttaaagttagacttgaggtcttaatagtaaa

SEQ ID NO: 225738 - DNA, 535 bp, Homo sapiens
ctccagctttgtgctttttgctcagtattgctttgactatttgggaggcttttgtgtttccttatgaattttaggatgaattttccatatgaatttttctgtttctgtgaagaatatcattggtattttgcatggaattgcattgaatctttatttatttatttatttatttgagacagagtctcgctgtgtcgcccaggctggagtgcagtggcacagtctcggctcactgcaacctccgcctcccgagttctagtgattctcctgcctgagcctccagagtagctgggattatagtcatgtgccaccacactcggttaattttaattaattaattaatttttttgagatggagtttcactcttattgcccaggctggagtgcaatggcgtgacctgggctcactgcaacctccacctctcgggttcaagcgattctcctgcctcagcttcccaagtagctgtgactacaggcatgagccatcacgcccagcaaattttgtatttttagtagagacggggtttctccatgttgg

SEQ ID NO: 225739 - DNA, 429 bp, Homo sapiens
aatttctattaagcacccagtctgtgccactttgttatggcagccctagcaaactaatactcatgcccagtatatgctgggcaatattctgaatgcagtgtgtgccaggactgataaaaactctccttcacaaaattctatagaaatggaaatgacttaggatttctagttcttttccatttggaggggaacccttcttgctagtgtaacctgccatccatcatgccagagctgtgcaaaccccgacagctctccaagccactgggaaggctgcctgtagggggagcagggactggcctgagggttgggggcccagctttctctgcggtgccaacatgacatcacttctcctcctgatggctttcgcctctgaacagctggactcccagaaggcacagcaagaggaataaacaagaaagctgactctac

SEQ ID NO: 225740 - DNA, 387 bp, Homo sapiens
ccaaaaatgcttcaatcagcatctttatgcatacatatatatctgtgtacatgttcaagtatttctgtagggtaaatatctggaagtggaataactgatttaaaggggtatacacaatttaaaatgtaatacatactgctaatttgtcctccaaaaatactatcaatctacattccccaccaactgtatgggagagttacctgtttcctcaccttttcaacactgcatatgttcacattttttaatttgggggagggtgggcgtgatggctcaggcctgcgatccccttacaatttgagaggccaaagcaagaggatctcttcaggccaggagttcgagaccagcctgggcaacaaacgagactcctcccaacacccatctctgtca

SEQ ID NO: 225741 - DNA, 453 bp, Homo sapiens
agtctgctgtaactttctttcatatataagtccacttcgagacacagcaaagcagctaccagtacctttgggtatatgtagtgtactttctgcttacttgctttcaaatatttgaattagaagggcttcccgactgagtgcagtggctcacacctgtaatcccagcactttgggaggctgaggcgggaggatcacttgagcccaggagttggagaccagcctgggcaacacagtgagaccctatctctacaaataattttaaacttacccaggcatggtggcatacacctgtaatcccagctgcttggaaggctaagatgggaggatcgcttgagtctgggaggtcaaggctgcagtgagctatgattgtgccactgcactccagcctgggtgacagagtgagaccctgtctccaaataaataagtaaataaataaataaaattttaaaaaga

SEQ ID NO: 225742 - DNA, 414 bp, Homo sapiens
caagaatgatataaggcaaggattgaattgtagctgctaccgaatgataactttaaaataaatccgtgcagaattctaaaaagagcagatgttgatgccacttcaaaaagaggcaacttcgattatatcagcagctgtttctctatgcctcagttattcagaaacaattctgtttcggtttctatgtcctatgattttgaagagaaggctgttgttactacattcctatcaaagcccgtatcacacaggttttccatttctttggctgtattctggattagaaactggtgctctggcatacaaatgtgcccaaagttgagctctctgtttcaacactttgggagtttgcttgcactggtttgctactacatgtttagcttttaataaattggcaaactattttccaaagtgctt

SEQ ID NO: 225743 - DNA, 395 bp, Homo sapiens
caggagaaactcttgagaacaaagattgtatcgctaacacttaaaagtacaagcaacaaaaacagacaaatgggattatattaaactaaataccttctgcgtatcagagagaacaatcaacagagtgaaaagacaacacccctcccttacaccatacacaaaaattaactcaagatgggctacagacttaaatgtgaaacccataactataaaaacgctgaagacaacctaggcaataccatccggtacgtagtgagtgggcaaagagttcatggtgaagatgccaaacgcaattgccacaaaagcaaaaattgacaaatgggatctaattaaatgaaagagcttctgcacaacaaaagaaactatcaaaaaataaacagacatttctcaaaaga

SEQ ID NO: 225744 - DNA, 845 bp, Homo sapiens
gcttagggaaggatggtaaacttctgttgcaagtcccaagcctctcggggcctacaggcaaaccctgactgcccatgaagcagccgcaggtgccaaaggacccactgccaacaaggaaatgagggcagtggatcacacaccctggtgaaactgaggaggagcagagaatgaaacaggaaactggagacagcatgacttcagaccagcaaagaaaagtcaccaccctggaaactaatgctctaccctaaacaaagaaactacacactgctttttgccaaagaggctagtggtatgagtcaggaaaggacaagaatgaccaacttctcacaccctgaaccacattcaaagtctaagccaagagagcacctctggaagtcagagtaaagaattcccttcgaaataaaatatttgctttaacatttactccacaatataacttgcttatatccaacatcctccatcaagcaggtcagtttgtctacttacttaggggtatacttcaacaacagttaataccaacagattcgtggaaacactatgttacttaaaatcaggtttttttttatcttataggtgtattgttccaattgtttaaggggcaaggtgtaaactagcaatcgttgctttggagttacaggctccaaacttagttgccatgttctatggattccaatgaagttataacattcatattagatgtcctaaagagtcccatcaaaatcaataccaaaatatctactggttactaggctggctgtgaggaagcaaatacacaacaaggaaatagactgccttaacttcaagtagcttacaaactacaacttagctttgaaaaggtaaatgtc

SEQ ID NO: 225745 - DNA, 271 bp, Homo sapiens
ccgcctcctggattcaagcaattctcctgcctcagcttcccaagtagctgggactacaggcatgtgccactacgcccagctaatttttgtatttttagtagaggtggggtttcactatatgttggccaggctggtctcgaactcctgacctcaggtgatctgccagcctcggcctcccaaagtgctgggattacaggcgtgagctacctggccatttgtttgtgattactttaatatgaactaagtcatttatcttcagatgtttcacaga

SEQ ID NO: 225746 - DNA, 444 bp, Homo sapiens
ggctgaaactattttttgtaaaattgcaagaaacctatgacgagttgtattttaaaatttattggccattagcattttagaattcaggagttattttccaacagaaacaatattaggtttcccgggcttgtatatttaaaccattgtttagttaaatactgaatatttttattgttagatcttaggttagaccttagaagacaatattgttagatcatagataattaataaacagtaaaatcaaaactaaataagagaaatgtttttagttttaatactagtatttgaaataaagcagattgacctgacaagatgatggctccgttgaagttctgtgtctcctgtctttgagcagttcctcctgtgttagcccttctctctgtcacgtgctgatacatggtgatgcttcactgtttttgtatttgttgcttatgaatgcataaa

SEQ ID NO: 225747 - DNA, 544 bp, Homo sapiens
aatcttctgaggctgggctgtgactcctcttgctttacaaatggggaaattgaggcagagagcgttttagtagcttgcccaagactacacagctaggaggaggcagagccaggatcacaaaggaaaaacttcccaactagtgtgtagcagtattctcaaggtgagtttattcaaatacaggtgattgttcagcctttgatttatattttctaactctggttttaaagaatgaatatttagattgattaaaatacagatttttttgtcctgcctttggttatattagcttgggcactatgttctcaaacccagactttgtgacaattatgggtgtgtttcagtaggtcatgggcgtcacgatgggcttttccagctttgtttgtatcagctattgatttctgtcacatcaaaacaatattagctagtcacggtggttcacatctctaatcccaacactttgggaggctgaggcaggagaatcacttaaggccagaagctggagaccagcctgggcaacatagcaagaccccatctctacagaaga

SEQ ID NO: 225748 - DNA, 371 bp, Homo sapiens
aataaatgagagtaaagtatgcggaagatgctttagcaaagaagatatattaatgtccaatatcacttgaaaatatgttcaatgttgttaacattattgtcagagaaatgcacattaaaaacacatgatacattcaaaataggtaaattaataacgaaaacatactatatatatatatcagctttttctgttatcagtaaagcttccagtcaacagtggttacctttttggaagtcgaaagttatatacagcaggtctgggcgtgatggctcacgcctgtcatctcagcagtttgggaggctgaggcaggatgattgcttgagtacaggagtttgagaccagcctggggaacatagcaagaccttgtgtta

SEQ ID NO: 225749 - DNA, 104 bp, Homo sapiens
ggaatgacgtaagtatttagattataaactttaatgtaaattctgaatcttaactaggcagactcttgcttgattaaacatgtttcatgatttagaaggttcat

SEQ ID NO: 225750 - DNA, 440 bp, Homo sapiens
attcttgtgaactttcatatttttaatccttctttattgaggcttaaaaatatttttaaaaaatagtaaaatgtatttgctacaaaactgagcactaacttttgagaagttgttctaagctttcatttgtttctggtctgaatcatcagccacgaattctgaataaggctgatcttatattattgccacgttcaggtctctagaaataaccattataggacatgacctatcattcttatggattttattgaatgatgagctcagctgcttgtacaaatcattttatttgccttctcctttaatatatttatcagcaaattaggaagcagtatttcgttttgtgttgttactcaaaataagaggattttacatttgtaaaatatgtttttatatcttagcccattatctattaaaaacaaaaccaataaaattttgtcatt

SEQ ID NO: 225751 - DNA, 485 bp, Homo sapiens
aaagagggaatggggagttattgtttaatgggtgtgaggtttcagtggctgatgatggaagggttttagagagatggatgatagtgatggttgggggatgatggaaggggttttagagacggatggtggtgacagttgggggatgatggaagggttttagagatggatggtggtgatggttgtacaacaagtagatatactgaatgccactgaactgtaaattccaaacggttaaaatggtacattttatgttatggatattttaccacaatcgaaatataataatgcccttttcttgaggtagtttcaaacactaagtgagctaatgtatgtcatcacctaccatagttggtattcatagttaaattggtgtgaaactgtaaaaagtgactgtaggcagtggtaaataaggagaatcttctaatcttgaaatatttatcatcagagacattatatgcacataagatgtagtcaaaagcatcctg

SEQ ID NO: 225752 - DNA, 439 bp, Homo sapiens
agaaaaagatcctgggcttctcccatcttgcttggcaaatgaggagtctagggtacttgtcttaaatgttctgacatatttcaattaaagcagtgaacaatattctcaaagacaaggcagcagctgatacttggtaatgtccttaaaactgcatagtaataaccttcagtgagatttgtataatttggagataagctccacttatatctgtaaagttaaagcacagagaaagttagtacagtatttgcctgaggtcagtcacgcagttggtgacaaaagccactattcttagtacttcatgagacttctgttttatataatagattacagaggccaggcacagtggctcttgcctgtaattccagcactttgggagactgagctgggaggatcatttgagcccaggagtttgagaccagcttgggcaacatagcaagac

SEQ ID NO: 225753 - DNA, 943 bp, Homo sapiens
gtgaaaatgtgacaagtcacagaagcttgaaataggctagctaattgggtgaagtggttagatagataagggtttgtttaacatggcttgtttgtacagatttccctctgcctcaacttcctgtccttgatgataagaatgatacttttcttctggtagagggaaggtagctttcacatggaaatgtcatctgcttttaagaagcagaaggaaagtcagactaggcatggtggcttatgcctgtaatcccaccactctgggaggctgaggcaggaggattgcttgagtccaagagttcaagacgagcctgggcaacctagccagaccctatttctctctctcttaaaaaaaaaaaaagggaaagccagagtgatattcttgcacctgctctcttcaagtgccttcaactcaaaatagtcaatatgccagagcagcatattttggggtaatgtgttcttaactccttcatcatgtaaatgggtttaattaacctataagaaatatgaacttgactttccaaggcccctaattaaataatgtgtgacagttttaaacgttatttggtcattaccaaaatagtcagtacaatatgacaactttaactgaggagggtaaatatttcctgggaccaaagccctccatatggtgtatggttggggagagtagcagtctaatgagattgcccaggtaggtgctgagttatcgtgatcttgagtgagtatgcctctgcctctgctgaagttcctagcacagtggaagtggagattgccctagctgaaagcgaaaaggtttatttccaggtacacatctcgttagaagctaggctccaaaaagagatatgcaagaggaggggaagtcatttcaactccatatcttctcatggcctcaggggaacagaagccaccagttattttcctatgaatggaatcctattcttaatttg

SEQ ID NO: 225754 - DNA, 298 bp, Homo sapiens
gggtgtggaagagacgagagagcgagcgagagagagagaaaacacactagctctccctgctggaataataggcttgaaatatgaggaagttgatcaactgccgctgccttccaaaaacagattaatccaccttggtagctttcctttcagagcaagcttttggctctgtcgactttctctatcagcctgaactcaaaaggacacaggccacatgccatctgagcttaagagttattttgtgtgttgatctgagaacttcacattttaaaacaatgaattcatgtttctactgtttgtt

SEQ ID NO: 225755 - DNA, 303 bp, Homo sapiens
ccaagatcaaacaggagaaagagaaattaacagctgtgcccagacagccagtgtggctgaccagaaagactgaatttagcaaaacatggttttaaaaaaattaaatgaatgaaataggtgaagaagtgatggtagcaacatgtgggcctcaattctctgactttttatttgatgatcttaggatattatgcatcagtccatgttgccccatcaaacacctactacgtgccacatatagtgcctaggccggcctgccttcctttccttccttccttccttcctcccttctttctctccctccct

SEQ ID NO: 225756 - DNA, 465 bp, Homo sapiens
tgacaatgggtgggccctgccttcaagttccacactgtctgtttgtgtcattacaacactactggaagtaggtgcagttatagacccgctgttcaaggtcagctgaaatgaaagtcaggtcacacgagtccaaactgtggggccacttaaccaccaactccaagcaggaaggtggacgatcccagactcggtcgaagacaagcatgtctggtttgcttgtcttccttctcaacctgaatggcacgaacatggagaaatgcatacttaccctgccagctggagaaaactggagacgaaggagggagccaggagtttctactttgccttccaccagttgctgacactttctgaaccccgtctgtaaaatgaagtcatgctgcccatcactcaaagttgtgtgaattgagagagtgctcatagtgctctgtgaattgcataacatccattttgctgttgaagatcatt

SEQ ID NO: 225757 - DNA, 239 bp, Homo sapiens
gagattgtgccactgtgctccaacctgggtgacaaagcaagactgtctcaaaaacaaaaaacaaacaaaaatctagcaacctggatgctaagtgaaaaaataaaaacagaatgagatataaattcaaaatatacaaataatacagatcttgtaaaaaacaaatagtattaattagataaacacgaaagaatgattgccttatgagctgggaggaaaatgggagaaaggcaagtgtatag

SEQ ID NO: 225758 - DNA, 386 bp, Homo sapiens
aagagattataggagtggttaatggtatggactaaatatctatgtccttcaaaaatttatatgttgaagccctaaccctcagtgtgactgtatttggagatggagctcttaggaggtaattaggattaggcaaggtcatgagggtagggccttggtttgatgggacaaacccttataacaggaggcactagagaacgcttctctctcctctgtctctctctctctctctgtctttctctactatgtgaagacacagcaagagagtggccaactgcaagccaggaagaaaccttcagcagatcccaaccatgctagtaccctgatccagacattcagccttcagaactgtaaaaagtagaataaaattctgttgtttaagccatcca

SEQ ID NO: 225759 - DNA, 290 bp, Homo sapiens
ccagtccccagcagagacttcctgaagaaggtgacatcagagctgagttttaaagcagggctgggagttacccaggcatcgcaaagccacaagggcacggcaggaagaggggacagccgcagccatggtgtggaagtggaaaacagttcggggtgtgcgtttttccagataactcctgaacatcccattcccaccagactctaagctccatgggggcagaataagaatctgcccagtggctcagggtaggtgagtgagtgactctcaaataaagtgatgagcaaacagca

SEQ ID NO: 225760 - DNA, 620 bp, Homo sapiens
atgaattgcatggttgttttgtcactgtggggacagagcttaattcacttagagtgagcacttgtgcttggtgaacgatgaggctaaggaaatgcatatcatcaccattaatttttgataatttttcatgggtgagaatgaaaacatatcttgaatccaccccttttttccctttctatttctggtgccctagtcaagccatctcatctggcccctggattatcctagtaagcttgtaactgtttttcccacctctcctcacctctctcccgagtttggcttcaaaatttaaacttcttaccacagtcacttgtaccccacaagatctgagtccttgttgacttccccaccatcatcttgcccctgcccctgcattcacgactgtccttccacattggccccccatgggtctcttgctcccgcaagctgctttcccctttaaggtctctgtattgttccttcttttgtctagaatatcctttgtggacttgttctttctcactctgaaggtctcatttctgatgtcgcctttctgagaagtcttccttgactatataaaacagtcctccctggctactctttggattaagccccctcattactctctttactaccccctg

SEQ ID NO: 225761 - DNA, 623 bp, Homo sapiens
ctgtaatcccagcattttgggaggccgacgtgggaggatcacgaggtcaggagttcgagactagcttggccaacacggtgagaccccgtctctactaaaatgcaaaaaattagccgggcacgtggtgcgcgcctgtagtcccaggtactcgggaggctgaggcaggagaattgcttgaaactggcaggcagaagttgcagtgaaccgagctcgcaccattgcactccagcctgagcaacatggtgagactcctgagactctgtctcaaaaaaaaaaaacaaaaaaacaaaagagaggctaggatctggcatgaggccgactgagattcacatatcctggttccagcctttttgtgcaggatttgtcatctataacaagtttctgggtgatgtcaatgctgctgcgctgaggaccccacttgaagacccgctggataaggccactcacagtggatgctctctgacaacacagtcagcagctccaggacagagtgttccaagtccacctgagcctggggtgagtcagagaagcagagctctggctgttttcctctttcccattttctaccctgcctctgtggcttcctgagtccttgagagccagtccttgtgaacaggggccaa

SEQ ID NO: 225762 - DNA, 292 bp, Homo sapiens
acttcctcataatctgctgggagttatggaatatgtgccaagcatctgacaccaggatttgtcatctataacaagtttctgggtgatgtcaatgctgctgcgctgaggaccccacttgaagacccgctggataaggccactcacagtggatgctctctgacaacacagtcagcagctccaggacagagtgttccaagtccacctgagcctgggccacgccagttcctgggcctgcttaggttgaagggattttttttttttgtggtttgaataaactaatttttggctaaaa

SEQ ID NO: 225763 - DNA, 857 bp, Homo sapiens
gaaatatacacataagtaacaaatataacataaaaaatatgctccattctattgcgcttcttgtagaagagcacacatcactagtcactataaagtgacctatacagaagataaaattggggtgttcaaaaaatatccaaaatacatgtgagccctgagaaaaaaaataatttctgcccatcaactgtctgagacaatacaaacgtattactgtcaaacaatattttttcgtatcttgtttttcttatgggcttacttttttgtaaaaaaaaataataataataattcttcaagcaacccattccataatggtagtaatgaatggtaacccacagaataaaacaagaatctatgagtccatactggcataaagaaataaactaacaaatggaggaaaatgaaaagcccttcatcatagaattccaattaataaatgtaaaaggagggactgaattagaaaaccaccttgggtgaccaccacagtaattctagcaagcaaaaaatcatcaagggaggctaaagttggtgggcagaataataaaacaacaggatatttacattgtttgtaagtatcttcccaggtgacacttaattactaaagaatagtaattttacattgaggaaactcgccatacaccacctttaccaaataaatgatcaaagttatcaacagtaataagaaaaactgaaaaactgacatcaagtgccccctgagagtatatactgagaacatatcacttctgtgacactcctgccaaaaattcataggctgaatctaattatcaggaaacaaactaaacttgagggacagcctacaaaataatcagtctgtactcttcaaaagagttagggtcatg

SEQ ID NO: 225764 - DNA, 469 bp, Homo sapiens
ttgtttctgagattctaagaacatgtgcttatggacagaaataggataactgggaaggggcaccagtttatgagaggaatcttcatggagtttgaggaaacagcaaaactttctcatggaagatcacctgtagattttgaaaacactgtatttgctttttaaaaggaagatcataggcagccaggtatgaaaccccttctcttagtgtttctgtgtaacctgtggaatttgcccaggggaacatctagagttaacctggaaatcagatgcttttctttcaggcagcatttggcaacatcaaaacatcagttctagagaatattgtgggtgctagagtctgactataggtgacatgtttttgtcatgttaatcaattattgaaattaaggagaagattattgcaatttctattccaggaaatgaagcatgcgctgagttaatcagattactttcaggtgaaaaaggaaaa

SEQ ID NO: 225765 - DNA, 2408 bp, Homo sapiens
  misc_feature (1210)..(1210): n is a, c, g, or t
  misc_feature (1362)..(1362): n is a, c, g, or t
  misc_feature (2078)..(2078): n is a, c, g, or t
ctgctttggttcaccctcaaactgactaaattttagcaatggataaaataatttttgctaacaaatatgtagaaggtttacacagccctttacaacttgggctagaaacttcagaaggaatatgataaacgcccacccaatctttccaggatacatgtagattaaacaatgtcacatctgtttgtaagttaaaaagcttactctatggcttttacattttatcttcatgtttcctactcttataaataatatacatgtgactacagctaacttgtaacataattgagattattatattcatacaaccatatatcttttataaaacaaacaacatattgttacatatatccctctagatcatatgtggaaaacattcactgtatgttataagaaattagtgctttttatcaaacattagtgacgtgtagaaatcatgacttcagctatacaaagtgcattgtgatccagagggctttttttatgatcccatgttgaagagagatcattacatccatgcttctcaaacacattctattgtttttaaataaatggttaagggatttgcaactaaagaaattgggaaacaaaccaaaactagaagacgaggtgaagcgctacagataagagaaagaatttagcaagaacaggtcagagggtagctacaagaatacaaagagccagtgggaagggaggcttagggagcagaaattggggcaaagtgttaagaagagaccaccgtgttgtactggggtccaaaagacaatgtggaggctttaccctcagtgacaaggtagtctaaagatttctcctgtttaaactataaatatttctctgaaacttgtacatatcttctatggacaaagtaggacttccagaagcccttttgtgctaaagcctagaataactaagagggttttggctcatgtaattcatttgcatcttcacaaaatgaatgtgtactcatttgagtccttcgaactttaaaacagccatattcttcttgttgtttatatattttccttaggcattttttttccacgaaatagacaagttttatccatatgaaaattgtctgatgcagataatgcctctcttgataaggatcacagcaagtctcttccttagcatctagcatgcactgccacacaatttgatgatgtgcagaagggaaaactggcctggagcctgtgaatcaccctggtttttcagnaaaaaaaaatcaccagaagtaatttcatctctaccttcttaaagtcttatcttcacttgagataacattaagtcaatcggcatttcacattgatcctgatcttcttagccatagtgaatattgtttaaaatttcatttataactattccctntcattggctgtacagataacatttgacattttgaataatttgtcctttgtccttctgaattattcctaagtcaaataatttttcacttctgatgagctcattttatgtttttatcataatcataatgcctctgcatgaaactctcccagcttctgtatctgttgatcatattgcacttaataatggtcagcatctcaaaatgacaggcaaacatgacaaaattgtagtaatctagggaatataagatgacaagaatgaaaatgctcgtatctcactcctcatgcccactgttagggcaggcagtgttgagtcactttttctggaccatacattaaaaaatgctgtatacattaagcaaaaaattgtagataatggctttctctctatcccttctgctagattgtgagtcactcaaaggcagcacccatgtttagtgttttcagtatgtctcatcataactgttacataataataattcctaggatatgttttttttaaactcaacggaacaagttgataaaaaatctgttatttcaaagagaaaacataatttccttagaactacattcctacatctgagactgaatagcagaatcatctaggaaagtttgcttaaactcacatatcttaccttttccacactgaatatgtattatttaagaaagtttccagaagatactctggaaactgtgtctccatcttagaaccacagcaanaaaaaaaattgagattgctttctttgttatttttactatgttataaacacaaaggcaatgaagagttaaatatatatatatatatatatatacgtacttatatacataccacacaaacgtatatatttatacgtagattcacatataagtttgtgtgtgtacctaaatatatatagatgatatagatataggagacataagtcatggtggaacacttgatctggccttacattcaagatatataaatgtgaaaggaaataattaagcaatattaaaattttcagatatgagcaaaaatgatttgactatagtagaaagaacaaaaaaaaa

SEQ ID NO: 225766 - DNA, 348 bp, Homo sapiens
ttaaagataccttaacacccacgagagactttctcctcagcctactgggaaggcctaaaaaagaactggaaaaaaaaaagaggattctgctttggcagatccagtggtagcagatccacgtgttgggaaatgcttttgagctggggaacaaagctggggaaatagatctttaagaaagggagccaaggttagaaatatttgcctacaaagtgagtaaattttatgtaactctgttaattctctgtaactgcttcctctgccactgctcgtggcccagggctgactttttggggtgaccccaaatgtatgcagctttcaaatctttcacaaactgcttgaaccacaaaa

SEQ ID NO: 225767 - DNA, 404 bp, Homo sapiens
aagtattatcttaagcatgttatttagaaatatggagataaataaaaataactgaaagtaggtagttgcttctgaggagagaaattgggagttggcaagagagtactgtttttcaaccatgtaaatgtatttgttttattaaaaacagattagaggcaggcgtggtaatcccagcactttgggaggccgaggcgggcagaacatgaggtcaggaccatcctgaccaacatggtaaaaccccgtatctgctaaaaatacaaaaattagctgggcgtggtagcacacgcttgtagtcccagctactcaggaggctgaggcaggagatttgcttgaacctgggaagtggaggttgcagtgagctgagagtgcactccagcttggcagcagagtgggattctgtctca

SEQ ID NO: 225768 - DNA, 309 bp, Homo sapiens
agaatttattaatttatcctctctctcaaataggaatgtacctcattacattgctgatgggtgattctccagtgttggtaaagtttcattccattgcatttctgacaactgcaaaggtcttttttagcctaaactaaaatatctttccttctcactaagaattacctttgtactttgtatttttgttttctggtgaagcttgggataatttattgtttttttctcacatcttcacattttctctgagaatactagtggctttatctactgaatatcaatattaaatattttttcactggatatgcattt

SEQ ID NO: 225769 - DNA, 550 bp, Homo sapiens
gtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctgtaacagctgtggtcttggcctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgacttgctctgcgtgagtcctcggtccacgtgggccgttgcgctggttcccagcctgcccgacacactcactgcgacgcctcccttgcctactgcttgctggcttctgtgttctctgcagtaaacattgatttctgactcgagtgctgt

SEQ ID NO: 225770 - DNA, 269 bp, Homo sapiens
gagccaggtcctggtggaggagggcctcaggtagctggtgcactgggcaggggccccaggacatttccgttttggagcttctgccaccaaagcagatgaaactgagattttcctctctccttatcagactcttccttgaagcctgtaagctttcaatttaaaaataagatggtatatggctgggcgcagtggctcacgcctgtaatcccagcactttgggaggccgaggcaggcggatcacaaggtcaggagatcaagaccatcctggc

SEQ ID NO: 225771 - DNA, 466 bp, Homo sapiens
ttaaaattctatgtttctgatgaactctaacattccaatgttgccttctaagcaaactgaaagctgccttataccgaatgaggaagagcacaaatactcggctgaatgaggtatcgcaaaagactgcatgcactttggagaaagacttaagttattgtcatacaatttccattccttttagctttttcttaaatatatgacaaatacctacacaaagagtggtatttcagtcaatatagtaaatttattttccagactgaccttcagcttaaatatgccagtgtgtgatttaatccataggcacctcatgaacacattattgtcagattggttacagatgctaaacgctatccgaaggtcattcctagtcactgatatttatcagggtaaaagtgaagtgatttcaacgataaaagtacctttgaaataatttatcaatgtattagataaacccagtttcagaatg

SEQ ID NO: 225772 - DNA, 447 bp, Homo sapiens
gaaaggatgtgaccatcacgcttatatcccgggaaagtgatttatcattgcaaattcataaactggcagtctagttcctaaaacgactacatgtgtgtgcacgtgtgtgtgcatgtgtgtgtgttcatgtgcgtgtgtgtgcatgtgtgtgttcatgtgcatgtgtgcacatatgcactgtgtatacattgtgcatgtgtgttcatgtgtgtgtgcccgtgtgtgcatgtgttcgtgtgtgttcgtgtgcgggtatgcgtgtgtgcactgcatgagcatgtgtgtatacgtatgtgcatgtgtgctcatgtgcattgtgcacatgtgtgtgcacgtgtgttgtgtgtgcgtgtgtgaacacatgtgtgtttccatctccattctgtatgtagctcctgtttcttccctcaggcctgggtgacaagagcgaaactccgtctaaaaaaa

SEQ ID NO: 225773 - DNA, 405 bp, Homo sapiens
gcaggtgttcagtagttcagttagtagatgttgatgtcttagaggaggctggtggtgtagagaagttaaatcatgctgggtttggggaggataatgggctggagatattgaatgaagaagaaagagatgttagatgtttgaactgggcaattcgatgaatgatgatgcctctttctgagatggaagagaccagagaggaacattttatggagtaaggtcaagagtttgtttgaaccatgaaaagtttgagaggttattagatatacaaataaagatgtagtatattggcagttggatatatgtatttggactttgggaaagaagtcagtctagttagatgtggcaaattgatgagatgtagagccacaaaactgattgccatcactttggggatgtgtggaaata

SEQ ID NO: 225774 - DNA, 362 bp, Homo sapiens
gtcctctatccgacttgatcgtgcagagttggttcgcaccgcccagtgaggggaagctgttttctcgtcgattgataggctccgggtctgggtaggagaggctgccctgtatgaggtagcttgaagggccgctgacaggaggaaacgcttccgaattttccagacgtgttgacgtttgagggtgctgactacacgttaaggaactttattgtcacgcctttgggaatatactgccaggctcttcctagatatattcattctctttaaaatgagcatgtctacctgggttcaccagaaactaagtttttcttagccttttgtgaggcaactgaaaaataaattgaactgtaggccctttctct

SEQ ID NO: 225775 - DNA, 443 bp, Homo sapiens
taggaataaacttaaccaaagaagtgaaagatcgccacaaagaaaatgataaaagactgatgaaagtaattgaagaggctgggcatggtggctcacacctgtaatcccaacactttgggaggccaaggcagaaggattacttgaggtcaggtgttcaagaccaccctgggcaacacagtaagaccctatctctttttaaaagaaaaaaaattaaattttaaaaacagaaattgtagaagacactctaaaaatggaaagatagcccatgctcatgaattggaaaaattattattgttaaaatgttcatactacccaaagctagctctagacacaatgcaatccctatcaaaataccaatgacattcttcaaagaaatagaaaaaacaatactaaaatttgtatggaaccacaaaagaccccaaataaccaaagcaatcctgaat

SEQ ID NO: 225776 - DNA, 454 bp, Homo sapiens
gatctggagcattggggaacaaagagctacgtggggctccaaggcaaagcccaggcaaaagctgagttgttctctgagctgctgctttgttctaagcccaatgcctaaggctgggttggatctgtcagctgtgggcccctgcagtgccctagactgctctccagagtgcagtgtccttgtgattacttgccagtatctgtcttccctactagaatcaacttctggaacaagggacaggtcagtcttgctcccaactgtatccccagagcttggctgctggctgaagtaggggcttaatcaatatttgtgtaaccagtacatgaacccttagcaaccatgaactccaatcctactgttgtacagataagaaaacagagacactgagaagggacaggacctgcctcaggttgcacagcatggtgggggttgagttaggaataaaactcacggctct

SEQ ID NO: 225777 - DNA, 397 bp, Homo sapiens
ccattgcgcccatccaggggctggatcttgacatggaccgtatgcctccagaattctctccccggtcaaggctgaaatttactcctggctacactcactcacgtttactcatgctcacgcactagaaattaactgcaagattggctgaagttcatttgtaacctggtcaggcccaggatggcactggccccttcaccaaagggaacaataattcaagataagctgttggagtggattgcaccactgacccctcctagcccccttcctctccattccaaacccctctctctttaaaaacccctgcattccccccacaaattgaagggtggaaatttttggaaagaatctcacccactccttcccttattagcatggataataaaatctccttatcaca

SEQ ID NO: 225778 - DNA, 337 bp, Homo sapiens
ggttagaaataaaggtaaagccctttaaccaaaggaaaacattcaaaagaggtagcattaggaagtagacttggggggaaatacctaaactagaagtaatgattgtttgccaaggaaagataggtgtgtttaaatggaacaataccttaaagaaggaattgtctcatgaccttgttaatttctggcctgttgtttcttaatctttattttgagtctcgaacatctttgagaatttaatgaaatctctggactaggtccccagaacagtgtacgtatttacaacattttgcaacacagttttcaggagatcatgggccttgtgaagctcaaccatatt

SEQ ID NO: 225779 - DNA, 298 bp, Homo sapiens
cagacaatacagccaattctggaattgtgcttttctcatgattcaactcacagccagttgtcaggttttcccagacatccccctgatgctccaccaaaccaggaaccagacaaaccgaggaaggggcctccttaactcctctaaccaacagatgagatgttgacagaacctaacatctacttagagatgatgtctcaggggcaacagaagaggcaggtgctgtagggccaggcgggttacctgtgtctgccagaccctccagtagttcagaatagcctcactggcgccgagatgataa

SEQ ID NO: 225780 - DNA, 583 bp, Homo sapiens
ctccaaacacccagagcattttgattgcctgccagattcatctttggtgaaaagtaacattttgaaaaatcaagacttacttggtaatacatattttagggcacgttaagctaataaacagctaattggttctgctctcctgtaatttgcaaagggtcaaaatgatttgtaaatatacatctttattaactgctgtctgccaaaaccaatttctacaggtgacagtagaatgaggtgatggaaggcacctcaacagttaacctcaacatggttttttggatcagtttaatttaacaggtaagtattattgtattccagggcagctatgcatgatgtcaaacagcatatggtacacaatacagagtggtggaaattccacttcctaaatgtgcaggtgaccaaatgtatatatagactcttagccaaaaggaatagaaacagtgtctgtgggatttgtgcacaatatgtccatacaacatatattttcttttttcttttcctcagtttgcacccaggatattgagggaattttaaaatgagactgttaaactactctggataatcttcgtggataaaatggaaa

SEQ ID NO: 225781 - DNA, 714 bp, Homo sapiens
gaaactataacaatttagtggagaatcaatcacttttgtagaagaacttctcatttctttccccaaaataggtcagattacttaaaacaaaaactatttgaggaagtcttcctcacttgtccttgaatataaagactgcttaagacaaaacaaaaatcctaatctggtgatataatttggatatgtgacctcacccaaatctcatgttgaactgtaatccccaatgttggaggtggagtgtgatgggaggtgattggatcatgggggtggatccctcatgaataccatccccttagtgctgttcttgtgatagtgagtgaattctcacaagatctcattgtttacaggtgagtagtgcctcctcccatctctcttgctcctggtctcatcgtgacgggcctggtcctgcctcactttctgccatgactaagagctccctgaggcctctccagaagcaggtatcactatgcttcctacacagcctgcagaaccgtgagccaattaaatatctcttcttataagttacctagtctcaggtatttctttatagcagtgcaacaacagcctaatacatctggcaatgtttttggatgtgattatagataaaaataaatctaaaaagtttaccagctttccagggatctagccatctttatacaaagggcttcaaaaataaactaattaataaaaggacggctaatcattagaacaaca

SEQ ID NO: 225782 - DNA, 561 bp, Homo sapiens
aggtttcctgctttcacagaattattccaggatttatatgtcagggtggtgacttcacatgccataatggcactggtggcaagtccatctgtggggagaaatctgatgatgagaacttcatcctaaagcatacaggtcctggcatcttgtccgtggtaaatgctggacccaacacaaacggttcccagtttgtcatctgcactgccaagactgagtggttggatggcaagcatgtagtctttggcaaggtgaaagaagaaagaaggcatgaagatcgtggaggccatggagcgctttgggtccaggaatggcaagaccagcaagaagatcaccattgctgactgtagacaactccaataagtttgacttgtgttttatcttcaccaccagaccattccttctgtagctcaggagagcacccttccaccccatttgctcccagtatcctagaatctttgtgctctcgctgcagttccctttgggtttcatgttttccttgttcccttccatgcccaggtggattgcagagtttatgattatgaaataaaaactaacaaaaaa

SEQ ID NO: 225783 - DNA, 420 bp, Homo sapiens
aaagtgtttgactcaaaaggctttgttcttcccttaaaggaagcatctaccaaaatgtggcacacaaaccttgcatggtgtctctagggcctcctaccccgcatttcccctgctttttctcttgttctgactgaaaaacaaagtgctttgactgtgctgtgacccagccagctgcatgtttacccagcatgcttgaacccaagctggagccttgaacataaaggtgtttaagttgttgctcaaaatatggaaagaatctagctctggccttgaaccaaatcccttaaactctcctataaaactccataacctgaccccctcagtgcggatatacctaggcatgacattcttgttgcctgttgcgaggatgctttagcctactctaagttctcccaataaatgctttggactgatcaccct

SEQ ID NO: 225784 - DNA, 2712 bp, Homo sapiens
gcgtttgctgggagatgttgtttcataaagactctcagaccttttgtcacagggctacaggactacaatcccaggatgcatcgggatcaaagcagtatgcgacacggggaaaagatgcggagctgtgtgcgtctccctaggtcttctgggagatgtggtctcttggccctttggtcacagggctgcaggactacaatgccagcatgcagcgggttcatggacagtgtgtatcactggaggaagacgtggagctgtgcgtgcctcgctgggcttgcagggagatgcagtctcataactaccccagtcgtttggtcgcagggctgcagcagtacaatttcagcatatctctggctcagggagagtgcactagtcactgaaggaagaggtaggtctgtgcgcacctctctgggcttgctgggagaggtagtctcataaacactaccagccctttcatcacatcgctgtaggactacaattccagcatgcacggggcgccggggccgtccgcctcactggaggaagagaaaggcgtgtgagcgccttgctgggctttctgggagatgttgtctctttatttctcccagccctttggtcacagggcttcaagactacaatcccagcatgcatcctgctcagggacaacgcgcgtcactgtaggaagaggtggacctgtgctgttctcgctatgctttttgggatacgtattctcgtaaacactcccagccctttggtcactgggctgcatcactacaatcccagcatacatcgggatcagggagagtgcgctaatcagtggagaaaggggccaggctctgcacacctcgctggtcttgctgggagatgcagtctcataaacactcccagccctttggtcactgggctgcagcgctacaatcctagcatggaccgggcgcagggaatgtgcgcgtcactggaggaagaggcagggttgtgcaagcctctctgggcttggtgggagttgcagtctcataaacactcccagacctctcatcaccgggctgcaggactacaatcccagcatgcacccggctcagggagagtgcgcattactggaggaaaagtctaggctgtggatgcctccttctgcttgctgggagatgtagtttcataaagactcccagaacttgtgtcacagggctgcaggactaccatcccattatgcactggggttagggacacggcccgtcagtggagaaagaggcggggctgtgtgcgtctccttcggcttgctgggagatgtattcttataaacactcccagccctttggtcaaagggctacaggactacaatcccagcatgtgccagtctcgggggcgaggtacaggcctggaagaaggggcagagtggtacacgccccacctaatatgctgggagctgtagtctgttaactgctctcagcctgtttgtcggtaggcttcagaactataatcacagcatgtaccgggacccggggtgcatagccctggagggaggggcagagcggtgtggacttcccggtgtacaaagcactgctgagttcttatgctatgccgactctttgccaaggagaatgagtacataggtggacctagaggacaggtctgcgctgagcattgaggagggtattaccctacataggcaccttacctttgcccaaatcgggcgggttgtcctcaactgattggccctatccttctcaagttcctctttcagctgcacccagggttctttccagagcattgcgccttctgcagcccagggcgctgccttctttcctaaactgctgtggaaactgtcctgatgtctgagacactgtccattgtgccgcagccctctttttttctctagccaagcctcatgctcaacagcttttgagagaaatcttccacgtggcctgcttatgaacagcttcagaattctgtagggggtgacaaggtctgtggcttcctggaaatgtcactctcaatggcgcctttttcacgaatgtgaaagttgaggcatcaggaaggttaattattgggttgcacaaaatctgctaagagcaaaggagaaaacctcatttccgaggcatgagtcttgtgagccattttcatcaacccatttaagtggacaagctccaaaatgaaacctgaagctgctgactatttaggcattttacacttgaaatcatcggtctcatctcaagtcactcctgacttgccagtgtctcagaaacacaaatgggaccggatccctcaggagcagatagtgttccagctttgttggagcgacatttaagatgtggagcacttggggtcgtttgaaacccgctatcttcagtagggacttttacttctagagaacatgtgcattttgattttatctgtcctcaaactgaacttttgctcattttaatagtaaaaacacattcctaggtggagacttaagatgctaacgagacatgcaatgtatgcacaaatatgtacagttagtgcacatgtgcacccagaagaccactcaaaacatgcttacactaacacttctttccaccttcttatgaataatcgtgcaaaacccccagaaggagggtttctccagtaacaattaatggtgtctcactcttatgagcagcctgccctggaatctctttctcagaatgtaccgtctattctgcacttaattttcaaagtagtcttttctttttttgtgtgcaataaattactctatgctgt

SEQ ID NO: 225785 - DNA, 582 bp, Homo sapiens
gcaaggtttatgttagaatggctaaggacagacagcaaagaattcacagaatttatagtaacaggcttcttggcttctttcatgtctcatagctaacaagtctttgaatatgtggtaagggaaaaaaagttagatcatgtcgttcctctgtccccaagccctccagctgttatgcagagcaaatccaaagcccttatcatagtctacaagatcctaaatgtgcacctctccaccccactcctgattaaagaattttgctcctaatggcccactatgggaatactctttccccagatagccacatgcttcaattgcccacttcctgtctctgccctccctgtcatctgtaaaatagtcccaccactatctccctctctccccttactccctctctccccttactgctacgttctacatatttatttatcattgtctccttgacttgaatgtaaactcaatggggcagagagttcattttcttcactactgtatccgcagcgcctggaacagtgagtgacatagtaggcacccaaaacgtcttttcatatgctgccaataaaccatagctgatcctggctttga

SEQ ID NO: 225786 - DNA, 788 bp, Homo sapiens
ggacctgtaggatttaaatgtggcaaacagtaggaagagtattctagacagaggaaaggaaaggattcactgcagggatcagatgtgtgtgtgggtgtgcatgtgtgtgtttgatgtgtgtgtgtgtaccctgtgtatggcggaacgggtaatgctgagccttcccaggccatagctttgaagtatttatttgtggagaacaccacttttccatttctagcttttcgtttccccttgttcaatctttgtggggcccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatacttgtggagagaggtaccatttctgtttagttccccattttatacacagtcatctaatacaagtgctcaatggctcataagcactcagtgaaaacgtgtgctatggccgggcgtggtggctcacgcctgtaatcccagcactttgggaggccgaggcgggtagatcacaaggtcaggagttcaagaccagcctggccaagacagtgaaactccgtctctactaaaaatacaaaaaattagccgggcatggtggtgggtgcctgtaatcccagctattcgggaggctgacgcagagaattgcttgaacccaggaggtggagtttgcagtgagccaagattgcgccactgcactccagcc

SEQ ID NO: 225787 - DNA, 358 bp, Homo sapiens
gcagccgcctactactactaaattcgcggccgcgtcgacttatacacagtcatctaatacaagtgctcaatggctcataagcactcagtgaaaacgtgtgctatggccgggcgtggtggctcacgcctgtaatcccagcactttgggaggccgaggcgggtagatcacaaggtcaggagttcaagaccagcctggccaagacagtgaaactccgtctctactaaaaatacaaaaaattagccgggcatggtggtgggtgcctgtaatcccagctattcgggaggctgacgcagagaattgcttgaacccaggaggtggagtttgcagtgagccaagattgcgccactgcactccagcc

SEQ ID NO: 225788 - DNA, 759 bp, Homo sapiens
gggtattattaccaaaagagcggattccaacagatatttagaactagacttagatatcgagttatacaatggggccaaatagttgatctggtaagaacaaatgaacccatgtcttgtctgtttcttcaaaaggatattactgctgttacagatctttaagattcacagtttctctatcactgcctactgctgaatgtgataacattaagtcagtatgtgcttactggtagatatatcaataagaacctaagttttaaatgcaagaggattttcatctaaaaggaaagtctgttgtcaagcatctggaagtcattttaagatatctgaattagtcattatgtttaattatagtcatcaagagctcaaagtcagatgattcccatgaccttaccagactcctctcacctttccctcaagtagttatcacatatcaagcacaactaagagctaatcatttcctcccaaggtacaattaactccctaagaaaaagagcacagaccaaaatttctcattcccacatttttgcagctctgtctgtccacttacattcagccacgggcatgagcccatgtttaaaaactggataaaacattctgatgaaaaatattccaaacactgttctttcataggctgttatctgtggtatcatccagggcatcatcatcggtacaaacatacatagcaatcagtgtctgtctgcacactgtggaaggcagagcagccatttagttactattcataaaagacacacaatccaa

SEQ ID NO: 225789 - DNA, 856 bp, Homo sapiens
acatgaaagacagctgcaaaatgcaagccccagtagagttggagagtttttcaaggtgagaagtcgctgttctctgcattgaacatggattgaattttccttgtctgatggtaacccatggcccccgccctgcggggataacattctcaggagcttctcttgtcctagccccttctcatttcaaaaatattagtcttttattttcctttttcattcagtttttgttttacagcttttgtagagaccaacccaagtagatgcaggtgggtgttagataaaaacacacatccccaggggacaagccatccagcggtgaggaatctctgccatgttctcttccctgctgcccacaaacgttacggagactcccttagcctccccctcctcttccccactgaggggcagcttgtggagatggaggactcgggcccatagatgcagaccccctaccaaatctagcaatagttctcacccttccaaagctcgagtgccattttgagatgacctaccaatgacatgcagtaaaggacataacctcacagcctttttagaagcatttcgaatatctacagttgcctcaattcacggggcatttcactcctctgatccaggttagaattttgctaaatctgtagcatcctgaatagcacactaatttttttttttagcacactaactttaactacattagttgagtgtagttgatacatctgtggcctcgtgtctataaagagcacactagattgtacccagcacttttggatatgacatgctaattagatgtatttaactattcataggaaagtgtatgataaatgactgtaatatttctaataaatatatttgtttctaatta

SEQ ID NO: 225790 - DNA, 1192 bp, Homo sapiens
acatgaaagacagctgcaaaatgcaagccccagtagagttggagagtttttcaaggtgagaagtcgctgttctctgcattgaacatggattgaattttccttgtctgatggtaacccatggcccccgccctgcggggataacattctcaggagcttctcttgtcctagccccttctcatttcaaaaatattagtcttttattttcctttttcattcagtttttgttttacagcttttgtagagaccaacccaagtagatgcaggtgggtgttagataaaaacacacatccccaggggacaagccatccagcggtgaggaatctctgccatgttctcttccctgctgcccacaaacgttacggagactcccttagcctccccctcctcttccccactgaggggcagcttgtggagatggaggactcgggcccatagatgcagaccccctaccaaatctagcaatagttctcacccttccaaagctcgagtgccattttgagatgacctaccaatgacatgcagtaaaggacataacctcacagcctttttagaagcatttcgaatatctacagttgcctcaattcacggggcatttcactcctctgatccaggttagaattttgctaaatctgtagcatcctgaatagcacactaatttttttttttagcacactaactttaactacattagttgagtgtagttgatacatctgtggcctcgtgtctataaagagcacactagattgtacccagcacttttggatatgacatgctaattagatgtatttaactattcataggaaagtgtatgataaatgactgtaatatttctaataaatatatttgtttctaattaaaagaaagaaaaaaaaaaaaaacaaagggggcggaaaaatacccagagggcccaaatacgcacacagattttgacaagggccccaaaggaagccgcataatacacagcacagcgcgcggataaaacgcgccgagggcacagacacgaggacactgtagagaaccacaaccggggaggaagacgatggagacaccacaagagaccgcgcaagaccaataagtatggtaaaccacgactgtgcgaagattagttaactgatgagaagacagagcaagtagcatgaagaagaacagtagaagatccagccgaacacaagatcatacactcagcgacgag

SEQ ID NO: 225791 - DNA, 471 bp, Homo sapiens
catggagtggaaggcgagccgcggagtgacagaagctgtttgcaacacaaaaaatcaaagcacttgtctctaaaacacacacagcccccaggaaccaacaaaaaagacggaccccccaatgacattgttctttgacagcccaattttgaaatggggcaaaagactggaacaggcacctttaaaaggagggtccccaataacccgggagcctcggagaagcagctcacctcagccgtcgcgaggccacagcctagtgcctttcagatctgctgtgctggcgacaacgcagggctctgacagtccatgtgctggaaggaggtgcatcgggaattcccacacgacccagagtgactgtgccatcaacacagattcagcctttgtctcagtttcccggcgcgcagcccctctgaccctaggaatcctggagtgtggtaagagtgtctttttgcatgctaatgagatgacggggag

SEQ ID NO: 225792 - DNA, 491 bp, Homo sapiens
cagagatacgaagaatgagagggatttgatgcacagtcactagcttgaagattggaggggccatatggcaggtctgcaggtgtcctccaggagttgaaagtatcctcttactgacagtggcatggaaatagtgacctcagtcttacaaccacggggaactgaattttgtcaacaacaagaatgggtttataagcagatttttacccaacctccccgccaagacaagaactaagctcagatgacaacttgatttcaacctatgaaaccccaagcagaaaactcagccacactgtgtcattctgacctagaggactaagaacaagttcaccattcaattgaagtaatttgttacatggcaagagcagaccaacatgaataccatctatgtgctgatgacttaaatgtgtatatttagctcagcttcactcttgacctccagtcttatgaatcttcattagtatgaataaaacagaaattttgactctctccac

SEQ ID NO: 225793 - DNA, 290 bp, Homo sapiens
tgtttgaccaaacaactaggcaccatagcctagccacataaaattactatcattatactttttcttatcacatacttctaccttggaagggatatttcccagttggtatagctacaaaacagaggcagatcatttagcctgcatttgatttgtagtgaaaaataagcctttggtgtgtttaaccactgaaatgttgcggtttattagtatagcacaacttatcctatactggccaacatagatgctttcggttgcaagtaacagatccccttacagtttacaaaaattta

SEQ ID NO: 225794 - DNA, 301 bp, Homo sapiens
gctgttattttgcatgtttatatctcagtgggtatttatccaacagaaatactcttagaagcacatgatatagatacaataatattcactgcagcattgttttcgttggttgtcaaacatcatcagtaaggagttagatattttcatctgtcaaagtgatagaatactatgcaactctgcagctgttaaagattgagatagctatgtgtactgataaatcaataggtccaagatagagtgaaaacaaatggactattgtatttatattaaatatacatttatgtttgtatttgcatagcaa

SEQ ID NO: 225795 - DNA, 459 bp, Homo sapiens
ctgcctccatgatatcttagttttctttttacccttagagttatctagttaacaatttattcctagttaactattctaaccattctttatattaaattctctctgtcagtgactgatgtggtttctctctcattgcctggaccctgactgatacagaaattggtactaggagtggccccaggaaaaagaccccaaaagatgggattaggaaatcagcttggctgtgtcattgggtttgaatgtgctgagctccttgccaatgagaatgtgatccatagcatgctgtggcctcataattaatgaaatcatcgcctgtggttatttgtgatgaagtgccaaccaaaggaagtgtctcgggggcccaaatggtggttgcactaactgttatggcagtgataatgactatagggactatgatatgggaccgattcttccagttgcatcatgggccttgcagga

SEQ ID NO: 225796 - DNA, 1582 bp, Homo sapiens
gagggcgccatgaggagcctgtgctgcgccccactcctgctcctcttgctgctgccgccgctgctgctcacgccccgcgctggggacgccgccgtgatcaccggggcttgtgacaaggactcccaatgtggtggaggcatgtgctgtgctgtcagtatctgggtcaagagcataaggatttgcacacctatgggcaaactgggagacagctgccatccactgactcgtaaagttccattttttgggcggaggatgcatcacacttgcccatgtctgccaggcttggcctgtttacggacttcatttaaccgatttatttgtttagcccaaaagtaatcgctctggagtagaaaccaaatgtgaatagccacatcttacctgtaaagtcttacttgtgattgtgccaaacaaaaaatgtgccagaaagaaatgctcttgcttcctcaactttccaagtaacatttttatctttgatttgtaaatgatttttttttttttttatcgaaagagaattttacttttggatagaaatatgaagtgtaaggcattatggaactggttcttatttccctgtttgtgttttggtttgatttggcttttttcttaaatgtcaaaaacgtacccattttcacaaaaatgaggaaaataagaatttgatattttgttagaaaaacttttttttttttttctcaccaccccaagccccatttgtgccctgccgcacaaatacacctacagcttttggtcccttgcctcttccacctcaaagaatttcaaggctcttaccttactttatttttgtccatttctcttccctcctcttgcattttaaagtggagggtttgtctctttgagtttgatggcagaatcactgatgggaatccagctttttgctggcatttaaatagtgaaaagagtgtatatgtgaacttgacactccaaactcctgtcatggcacggaagctaggagtgctgctggacccttcctaaacctgtcactcaagaggacttcagctctgctgttgggctggtgtgtggacagaaggaatggaaagccaaattaatttagtccagatttctaggtttgggtttttctaaaaataaaagattacatttacttcttttactttttataaagttttttttccttagtctcctacttagagatattctagaaaatgtcacttgaagaggaagtatttattttaatctggcacaacactaattaccatttttaaagcggtattaagttgtaatttaaaccttgtttgtaactgaaaggtcgattgtaatggattgccgtttgtacctgtatcagtattgctgtgtaaaaattctgtatcagaataataacagtactgtatatcatttgatttattttaatattatatccttatttttgtcacggttgttgtcagtttttattataagcaaatttctaaataggctacgtcccaacatggataaagaccccaaggttggtaaaatagccccaaagatatgtgcattttcattttacatacagcagagttgtgtttgcatggattttaaggtagttcaaaaaataaacgatgcataaatc

SEQ ID NO: 225797 - DNA, 1645 bp, Homo sapiens
gagggcgccatgaggagcctgtgctgcgccccactcctgctcctcttgctgctgccgccgctgctgctcacgccccgcgctggggacgccgccgtgatcaccggggcttgtgacaaggactcccaatgtggtggaggcatgtgctgtgctgtcagtatctgggtcaagagcataaggatttgcacacctatgggcaaactgggagacagctgccatccactgactcgtaaaaacaattttggaaatggaaggcaggaaagaagaaagaggaagagaagcaaaaggaaaaaggaggttccattttttgggcggaggatgcatcacacttgcccatgtctgccaggcttggcctgtttacggacttcatttaaccgatttatttgtttagcccaaaagtaatcgctctggagtagaaaccaaatgtgaatagccacatcttacctgtaaagtcttacttgtgattgtgccaaacaaaaaatgtgccagaaagaaatgctcttgcttcctcaactttccaagtaacatttttatctttgatttgtaaatgatttttttttttttttatcgaaagagaattttacttttggatagaaatatgaagtgtaaggcattatggaactggttcttatttccctgtttgtgttttggtttgatttggcttttttcttaaatgtcaaaaacgtacccattttcacaaaaatgaggaaaataagaatttgatattttgttagaaaaacttttttttttttttctcaccaccccaagccccatttgtgccctgccgcacaaatacacctacagcttttggtcccttgcctcttccacctcaaagaatttcaaggctcttaccttactttatttttgtccatttctcttccctcctcttgcattttaaagtggagggtttgtctctttgagtttgatggcagaatcactgatgggaatccagctttttgctggcatttaaatagtgaaaagagtgtatatgtgaacttgacactccaaactcctgtcatggcacggaagctaggagtgctgctggacccttcctaaacctgtcactcaagaggacttcagctctgctgttgggctggtgtgtggacagaaggaatggaaagccaaattaatttagtccagatttctaggtttgggtttttctaaaaataaaagattacatttacttcttttactttttataaagttttttttccttagtctcctacttagagatattctagaaaatgtcacttgaagaggaagtatttattttaatctggcacaacactaattaccatttttaaagcggtattaagttgtaatttaaaccttgtttgtaactgaaaggtcgattgtaatggattgccgtttgtacctgtatcagtattgctgtgtaaaaattctgtatcagaataataacagtactgtatatcatttgatttattttaatattatatccttatttttgtcacggttgttgtcagtttttattataagcaaatttctaaataggctacgtcccaacatggataaagaccccaaggttggtaaaatagccccaaagatatgtgcattttcattttacatacagcagagttgtgtttgcatggattttaaggtagttcaaaaaataaacgatgcataaatc

SEQ ID NO: 225798 - DNA, 440 bp, Homo sapiens
agaatcactggcccatgcagcagttttaggcttggcagaaaggaaacttatggtctcagggtcagaatgggctataaaggtcgttgatgatcacttctcatgctatccacttataactgtctaagccagtctagctgtactcacctcctctgatgtgttcttggtggcagcaaaagagccggctctcagtgttccctttgacacacagtgacagaaccattctgagcacaagtctctattaatccagtggtgaacatgactgcatgtagatgctgtcattagaacctgggaagtcatgacatagcaaaaggacagaggaactgggatggcttggctgtatcttgctccgccagttcactacatgcataccctgccctcccattgcctctttttcttccctttgtatttattgatctcaatcgtctccctggcccttccag

SEQ ID NO: 225799 - DNA, 361 bp, Homo sapiens
caaacacccctcaccccatcatccctggcttgcctctccctttggctcctagaacagtcctgtgactttcacttgaccagaattcggagaaaatcctgatatggattttaaacctcacacatggacagagctctctccactgcgatgccaaacatccacttctctgtccttccaactctcatcctgcctcacttcctctgctctccaattccacaagcaagtggtccctgctttcggcccccatttctgccacagtatgactcctacttgctggaagttaaaaggcctctcccaacacctctccaaggcaacggcaccacagccttcagactacctgtgctcaatgcctgcgggagaacac

SEQ ID NO: 225800 - DNA, 624 bp, Homo sapiens
ccttccacctgggaccaggcaggggccacttggtgatctctgtcctgagggatgcattacagtgtggtagagtatgggctagaagtcaacttagccagctgtgccacctattagctttataaacttaggcatttgacttaatctcagtgtccacatgcataaaatgaggataatctctctgcaaagtaatgccatttattgtgaggatcaaatgaaatagcaaaaagaaagcatcagtctggtgcctagcatttgattcacactcactaaatggttgcaattattgtttttctcacttagcaaagcagtgttacaccactgccctgcttaatctttgaatccttgagaatctttgaaaaactttcaatacttctcttgctgtcctacgttttgggtttggagtgcacaagtagcatagtgcaaaaaaattccctaaatgatctgtaggatagtccaggtgcaatttgaaaaattagcattgatgactaaggtagaagcaggtactgtgtttcacataaatatttgacttaaaatacaattcatggtgtttcatggagtagggaagggtagcccctgtgtctgtctgataatagaagtacaataaatttaattgagaagatttga

SEQ ID NO: 225801 - DNA, 551 bp, Homo sapiens
cattcatggcctgtgaaattcagatgaagtacttatttagataactccatcaaaacactaactctttctgatctcagaaatttaaatgagtctaaggaacatgcggtgagcccagtaattttggcataaacatttcacttaaaatcatgagttaagatacaagcttgatttgttacttcaaataactattaatcctcttgctatgtgaatgagctatttttttaaaattcagtgttcagtgtttataatcagacaagatcccattatcagtaggtaatccctaactaactgcatgcttttggttatcaaaaagcatcatagttgaaaaaaaaagtctgcttttgtcaaaatcaaaatctcatagataaaagcagttagtggagaaaattattaagtggtattaaatatactttttaaacacaataaataaaaattctagaacgtattcttttctgaagatgatattcattagtataataatccttccccagatttaactttcttttgctatctccttcagtagttcaatattgtactggtttcataagctg

SEQ ID NO: 225802 - DNA, 451 bp, Homo sapiens
agagaaagctgtgaaagacatctttagggaagaaccattgaagaatgattttatttgtatttgtatccattaatgcttaaactgtaataggtgaccagtgggtgattgctgaatgaatgaatgatttagagactgaaagtgttggggagtggagaaagaggaaaaggaaaaagtattccaatatagtttctaagctttagtcacagtgtagtctgagattgaattctgttaacagaagtacgaaagtaggcttgggacattaaccatcaatttaaaaggcagatttggaacttgggaaagagaaagtggtacacgagttaatatttgtgatttattcccgggggcgtgatatttgaaggtttggaagaaggtgagttttcagagagaatattgagagaagaggccaaagaagaaactttggagaatactcatatttggactgggaagaaaa

SEQ ID NO: 225803 - DNA, 481 bp, Homo sapiens
agaaatggctgtgtgacatgtcagacaaggtcatagagttttccatggccctgcactgcccgtggctcatgtggcatgactgtaggtgaaacccagaatggactctcaaggtgccctgggctcccttcctcaatggctgaagaaggcttctcttgacctaatggagtttaaagagacttggggatatagtgaactagaccccagaagcctttcaaacaggaactagggggcgcccaccaggaccttgtggactgacagtggaggctcaatgagacaaaatgtgtcatggagatgccttcaggacagacagcattcgggaacagataccagctccttacagtcttggcctccagattagacatggccctggaaaaaggtgatgggggacctggaattaccagacagcaattccgttcccccacttagtggaatgggagcacaacatgtaaattaaaggaattagagaaaaacatttaaagtt

SEQ ID NO: 225804 - DNA, 392 bp, Homo sapiens
gcccaggcggccgggagcgccggcgccgagccgcgctctgattggctggcgcgaccgtccctatctgctccggggagagtggaatcttctctccatcttctgcgccccgagcctggggtgagagggagatccgcggtgctttctcctatcttcttgggggagggggaggaggaaattgtcaagggaagtaacaatcgcggccagcaaccctgctctcccaaagccaccccctcgcgcgacagcgtccccagcaccagttcttactgcttacacagcgcaattccacctgtttgcacaaagcccgaagcaacatgcctggccccttggatacgaggcttgcttcaagttttgggacaacggtgaataccaaagaaattgcatcatggctttaa

SEQ ID NO: 225805 - DNA, 218 bp, Homo sapiens
tatgctggctgcccttcctcctgaccttgaccggtagattgaagactgctgtgaaggacttggtcctggtcatttctcctcgttgtccatattctgtttctgcagaagaccttggtgccatgaatgtatatatttctagatgtcttaaattcataaatcgtaagtttctttttcatattccagacctaaataaataactgcctccttgatgtcttaat

SEQ ID NO: 225806 - DNA, 411 bp, Homo sapiens
actccgggcctcccgccgggatccgacgcgcccggtggggtaagcggagtgacgtgacttgatggacacacgccattcacagcccccgtcacgatgcctcccttccagcgcttcgtgtgcagcgcgtgctgcaccctcatttcgtctcctccacggcctcactggcagtagcctgagccgcagtaactgacctgggggctcccaccaggttggcctggctccagagctgtcagagattttgggattgcctttcccccatgctatcctgtcctcatccatcaccacctgaatctcccttgccgtctcttgtcataggatccccagatggacccagatccagttcgtggctattggttctggaagggggccatcctcacctggatcctccagtaccaaacataacagagtcta

SEQ ID NO: 225807 - DNA, 370 bp, Homo sapiens
cactaaaggaaatgttaaaggaggtctttcagacagcaggaatacagtaagtcaatctggctgtacacaagtaaaaggcaccgaaaatggtaactacagggtaaatatataacattttaaaaatttcaaatacttttaaaaggtaatttactgtttaaataaaaacaaaaatttattgagatttctatatcacgtttaagtaaaatgtatgacaacatgaaataaatttaaaaatgtactttatcaaaatatgtgggatgttgataaagcagtactttgagaaaagtttatagcactaaacacctgtgtttaaaaacaaaaaacaaaaaacaagaaaggtctcaagtcaatgaccttgctttataccttt

SEQ ID NO: 225808 - DNA, 420 bp, Homo sapiens
aaatgccctgaattctccctgcacccatgtgtggcaatgcatgtgaaatgctgccaagcaggggagcccaccagagcctgggcgtccagggttttcaatggggtcagctacataggtgtgacctcagactgtagaggaaaagcaggtgttccccatccatcactgttggtatgaactacccagaccaactggtactggtgactcaaggcctcaggcaggcaaaaacactcttaataggtggagccttccatgagcttggttcccaggagctgcacaagggccagtcttgaaaacaggcgttggccgggcacagtggcttacgccagtgatcccagcactttgggaggcccaggcgggtggatcgcctgaactcaggtgttagagaccagcctgggcggcatggcaaaacaccgtctttac

SEQ ID NO: 225809 - DNA, 429 bp, Homo sapiens
tctctgcctgctttgtaaatcagtgttttctctgtggggttagctgagagcaggtgctgctctccaccacaagaaggaacccttaattcctgagcagggtgaggaccagcataggcaagatgtagatttgggccaggcgaggtgtctcaggcctgtaatcccagcacattgggaggctgggctgggtggatcacttgaggtcaggagttcgagaccagcccgggcaacatggcgagaccctgtccctgctaaaaatacaaaaattagccgggcatggtgactcatgcctgtagccccagctacctgggaggctgaagtgagaggattgcttaaccccaggaggcagaagttgcagtgaactgagatcctgccactgccctctagcctgggtgacagggagaccctgtctcaaaaaaacaaaacaaagca

SEQ ID NO: 225810 - DNA, 574 bp, Homo sapiens
agaccctgtcccttgactaccaagcctccaaacacttgggaacactgcactattcagttctgtgctgtggtggttttaaactaggcccacaaattctttgatactccttttatactctttccttcaagaggaacccagttcctctcctcttaagtgtgggctacacagagtgacttgcttctaatgaatggaacatagcagaagtgatgtgtattacttctgaggttaagtcgtagaagacatggtggcttccatcttgctctctcttggacactcattctgagtgaagccggctgccatgttgtaaggacacccaagcaatcctgtggagagggccacatggcaagaaactgaggcctcctgccaatagccatttgagtgagccatttgaccaggaagtgaatcctccagccccagtagagccttcagatgatggcaaccctggctgacctcttgcctgcaactgcctgagaagatcctgagccagaaccactcggttaagcttctcctagacacctggcctgcagcaaccatgaaataataaatgcttgttgtttttaagttgctaagtctt

SEQ ID NO: 225811 - DNA, 371 bp, Homo sapiens
tttaccattttaaccattattaagcatagtcagtgtcaagtatagttcattatcattaagtacattcatattgttgtgcagctgtgactactgttcattttcagaatgtttttctcatcccatactgaaattctgtatccactaagcaacaattcccccatttctaagctaatgatccattcttaaatatgaaaatatatataattttttattttaaagtaaaatattctaaaatcagttttatttctaattaaatttttttaagtttttgaagaaaattcttaaatattgtaaaataaatcttcatggtatacgtattcttgtgtttccatgtaggtgtgagcacaattctaaataacccatgggtaaaa

SEQ ID NO: 225812 - DNA, 700 bp, Homo sapiens
ctgggattataggcatgagccaccatgcccagccaatcagtcttgttctttatcccactgccccatttccatgtgtgcccactgtcaggccccacgcccccttcctcctccagtcccagcatgcagatcccccaacagtcctgttgcccctgaacccaaatagcagccctacccctactagccatgtcaacttgcatgagatcctcaaacctcagtttcctcctctgtggcatgagtgccttaagagagcctaccaagggaatgtagtgaggatgaaattagctacaacacgtaaaacccttagcaggtgcctgttctaaccactcatgtgataactgctggtgacgtttattcccacggatgatttagtggattatcccaacaaaaagtatttggattttaaagaaggacactgttggccaggcacagtggctcatgcctataatccagcactttgggaggccgaggcaggtggatcacttgaggtcaggagtttgagaccagcctggcaaacatggtgaaaccccatctctactaaatacacaaaaaactagccgggcgtggtggtgggcgcctgtaatcccagctactctggaggctgaggcaggagaatcgcttgaacccgggaggtggaggttgcagtgagctgagattgtaccactgcacttccgcctgggtggtagaacaagactcagtctca

SEQ ID NO: 225813 - DNA, 561 bp, Homo sapiens
acttcctttcattcaagggacattcacagagcaaagtgcgtggtcacttgtaagtttgtagagttggttcacgaatccacaccacatccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttg

SEQ ID NO: 225814 - DNA, 480 bp, Homo sapiens
cagccacaaattttctaatggctaattgtgttagaatcatgtactcctttttaaaaagttattcactgataatggccttctaaagtatagtaaattggaacgaacactccggaaaacaatatggtgttagtaacactaaacacacgcaatttatacaacccagcaattccacctgagggagacactcaggagaaactttcatgagtaggctgggtgtggtggatcatgcttctaatcccaccactttgggaggcctaggtgggaggatcgcttgagcccaggatttcaagaccaccctgggcaacatattgagacctaatcgctacaaaaaataaacaacattagtgggacgtggtggcacacacctcaagtcccagctacttggctgagttgggaggatggcttgagcctggaggttaaggctgcactaagatcacgccactgcactccagcctgggtggcagagtgagactctgtcta

SEQ ID NO: 225815 - DNA, 395 bp, Homo sapiens
tcaaagatgaatatgtcagcttaccagatttttgctaaaatccaaaaacatataacttggttttttcagagggcagtagtgttaggctatttctccaattaagctagctacagaaatctgtttaaagacttgccaaggtcacttagcacaaaggtcatgaggcatacagacagcataggctttggcctcaagctacctgggttcaaacccctgctcttttgtttttgctatgtggcttcttaacttctctgtgcctgtttctcatttgtaaaatgggctatcaatagtaccgccttcttaagattgtttggaattaagtctgttaatagtaaaaataaagtacttatacactgcttgctctgtgccagacactgttctaaaccatattagtcaaa

SEQ ID NO: 225816 - DNA, 424 bp, Homo sapiens
gtgctacagtgagagtggcagagaacagacagtctgcagaccaagaagttaaaaaaaaaaaacagttggcaagtcactcctgaaagctaaagacttctttactctgctacagtatttctcacacaggtgaagcttagacataaaagacatgaaagtctcctaatatataatatattggctgaaaatgtgatgatgtggagattcttgtattcttgactgtgactctctatgtgttccatgttttgtgaaagattgttacttttgtgtcattgtcaactatcaatcgctgtgttcatgtattgggttcatgttacccacctatcttctgtgaggagaataaactatgtttttttaatttataaaaaaggaagatgcggccgggcccccttcatattatatttgtgttgttttgtttataaattag

SEQ ID NO: 225817 - DNA, 225 bp, Homo sapiens
gctgcactgacctatggccccaccatgaaagcatcagatgcagccaccgcgcccggccacacacacctttttctaagccagctttgtgtagaagtacagtatacacaccaataaaaggagcacaggcccttggcatccagcctgggggagttttgggagggaacaccctgtatatccagcacccaggagccccccatgtcccttcccaccaccagcaccccctca

SEQ ID NO: 225818 - DNA, 796 bp, Homo sapiens
atcccagaaaaacatttcatgatagtcctgagagatttgttagtgataagtaatactatttacattttattggcaacttgataatgatacatgtattgaattcaatatgcaaaaatattccctgactcctagtccagtccaattttagtattacatgctattatctgattttacacacacagacacaaacacaaattatataatcaccataataagatatttaggaaaatgaatggagccaaatgatagaattcattaaaaatgcttcacgcgtacctcacaaaaaatgtgtgtggcattttaaaagtggcatgtatttgaagaaaagcatacaacatttctctaaatatcccgttatggtgctcacagaattttaaaacctagttactctgcataatgaactgtaaaaatactcataggctatataagtaatatattttagaggcaggaaagaccaaaaagctacgtttaaatatattggctttttaataaatcctgttgtttggaagttataaatacaaatacttggggaaaatctttttaaatcttttatttcactgtatttaaaaaatcctctggattatggtagattggactttgttgctgttttttgtttttgcttcctaaacagtatgtgtatggtgtggcatggccatgggggtggaatcacaggcactctcacacccttgataagaatgcatcatctatgtgaagggcagttaaatcttacatgtcaggccttttagcaaataatcagagaagggctcccagccttttctttatcccagcattattt

SEQ ID NO: 225819 - DNA, 466 bp, Homo sapiens
cggcgcctacctcctgggctgttgtggggattgaatcagcatgccgcacaccggctgtggaatagacagtgggagtcattttaaaaaggggtctttcagtccttggggagttgtcttttctcttctttgtatacaaagagcttcaggctgtcaccaggctggtgacagagtgagactccgtccaaaaaaaaaggaaacgagtatatcaaagggataactgcactcccatgtttattgcagcattattcgtgatagccaagttatagtatcaacataagtgtacatcagttgatgaagggataaagaaaatgtaaatatgttccatggaatattagtcaaccataaaaaataatgaaatcctgtcatttgcaacaacataaatgagactggaggacattacgttaaatgaaataagccaggcacagaaagacgaataccacattttctcactcgtgggaactaaaaa

SEQ ID NO: 225820 - DNA, 450 bp, Homo sapiens
agtagtatttctgccttgcctgactgaggcatgccctttgtgggccaactgagtatgttttaagtagggaagcagacgactatgtggctatttggaacacttgtaatcttgtgagagcttcattccctttgttacttaattaaattgaaacaatttatttcagccaggcgcagtggttcacgcctgtaatcccagcactttgggtggccgaggtgggtggatcatgaggtcaggagttcgagaccaatctggccaacgtggtgaaaccccgtctctactaaaaatacaaaaattagctgggcgtggtggcgtgcacctataatcccagctgctcgggaggccgaggcaggagaattgcttgaacagaggagatggaggttgtggtgtgctgagatcgcgccactgcactccagcctgggcgacagaacaagactccgtctcggaaaagaa

SEQ ID NO: 225821 - DNA, 334 bp, Homo sapiens
gggggctccccggtcctggcgtgcaggtgggtttaagggacgcccagggaccacctccccacgcaagcctgaggacctctgaactttgctacaagtacaaccaactttagccactcttggttggacctgactagaaagggtggtgggaaggcaagaagggtctgaatttaggatctggaagttgagggctctaaggacaggtctgctactaacccaagcaagtctccgcctggtgtggggactcagtttccctatgtctagtgaggtgtgggccaagaccagtgggtttcaccttttttgactgtggcccacaatacaacccatgctgtaacac

SEQ ID NO: 225822 - DNA, 369 bp, Homo sapiens
tggtagttaacgaactactagagaaaaaactatgtctgtctttcaaagcaaggccacaaatgacactttagatttttctttgctctctgtcatatcactcactctgggaaagccaacttccaaccttacagggaggtcgacttagagaggaatggaagtgtcttgtccacaaccacgtgagtgagccttctggatagtgggtcctccagtcctattcaagccttcacatgggacattttgactgaaacttcgtggctgacattttgactgaaactttgtgggacaccctaagagagaagcactcacctcctgaatttttgactaacagaacagtgaaagataatacatggttattgttcaattttaaca

SEQ ID NO: 225823 - DNA, 520 bp, Homo sapiens
aatgcagtcaaatctaggtgcactttcaatattttaacttttaatgtctttgcaaagcaatgcaatctacttttatattatgccagtagtaatgttataatttctcagctggacaattataaacatcaggtaggtttttcaaaacctatctccctcccaaaaccaaaataatagaaatttggagcaaatgacttattttcttcaagtctcatggatttaatagataatttttccccctaaataagataatttagaagtttattatgtatcatcaaatagttgttacttttaactttttatttagaaataattatagatttcaacatgtagttgcaaagatagtacagagaagtcccatgtacagtacacccagttcccccaatggttacatcttacataactatagtataatatcaaaaccaggaatttcatataggtacagtgtacatgtagttctgttgccattttatggtgtagatttgtttaaccattactgtaattagaaatgtttcattaccaa

SEQ ID NO: 225824 - DNA, 489 bp, Homo sapiens
cgagatggagtcttgctctgttacctggctggagtgcagtggcgttatcttggctcattgcaacctccacctcccaagttcaagcaattctcttgcctcagcctcctgagtagctgggactacagacatgcaccaccacgtctggctaatttttgtatttttagtagagatggggtttcatcatgttggtcaggctggtctcgaactcctgacctcatgatccgcccgcctcggccttggtacattttaaactcccaaaatgaccaatatatagtcagggttgaaaacagtggagatgacaaagaactgagactgaggttaagttagaatgaagtagtataaggaacagtctactgccatgaccctattaaaagacagggaggaccatcccaacacagaaactgggagggtggagaggaaaggctcattttggtagacgtttctaagacagaatcaatgagacctacaaaaccaagaatatgagcaata

SEQ ID NO: 225825 - DNA, 476 bp, Homo sapiens
tcatagggattgtgtggggtttaaatgagaaaagacaggtaaggtgctggtaccttataagtgattaagttgccattaaggtattggggacttagtgcttgtccttgaagagctttcggtctcgtgaggagacagcctgatcgttataaactattatagaaaatgggaagaaataagggttgaggtgtgataaagatgtgctaggccaggcaagatggctcacgtctgtaatcccagcactttgggattacaggtgggcagatcacttgaggccaggagttcaagatcagcctgaccaacatggcaaaaccctgtttctactaaaaatacaaaagttagctgggtgtggcggcacccatctgtcatcccagctacttgggaggctgaggcaggagaattgcttgaatctgagaggcagaggttgcagtgagccaaaattgcacaactgtactccagcaagactctgtcaaaaaaag

SEQ ID NO: 225826 - DNA, 596 bp, Homo sapiens
aatgagtaagacacatttcctgctgcagaggaattcagtccattcagggagcctgagcctgacacacaaaccaataattgctaaatactaagagatgttattatagaggtatgaacaaaggattcaatgtgctgaaggaaaatagtggctaataaatcctacagagcagtagatagggacctaggtagaacaaagaggaagattaaaaaataaagacataatacagaaaataggttataagttcaccaaaaggaatggtgaagtttggttgagtgcaggtacatgggtatagctgaaggcctgaatcggaaatgcactgaggactgagaggaaaagagatgaaaaatggtaaagtagcagcactgttagaatgtactgacaaatcgaattggctagcatgtgaaggcaagcacctaccatgatttcttaatttctggcacagacagatggtaatgagccatataaaagaaagaatagaggaggaagagcaacttctaggagtaggaaggaaaaggagactcaatttacacatgctgagtctgaagggagtagacaaacttttagcataccccacattttgtaggccactgagctgg

SEQ ID NO: 225827 - DNA, 1222 bp, Homo sapiens
tatatcacatcacaaattcctgaaataaaactaattctatagattaggaacttagagatttattctgcacttagtcacataatggatgttaaaattaacgagaaactcagattgaggcaaacatgacaagcatgctttactcaaacatcatacagcacagcaacagttcaaaccttgtttcttaaaaaaagagaaagagagaaatagaaaaatgtttttatgtcctactggatttcaggaagagctgaaaaacactcttattcatatagtaaagagggctttgtttggttttgctcattagaattctgtaattctgttagtttcaagtatggtgagcttgagtatacgcagaataacagtgactgaataaagaaaagtaagccttggcttactttaattgtcatagataatgaaatggaattttttattttctgactcaatggcacgtaacataaaaccccaaaatattaatttctctgattctggataaagaatttattgtattgcacatagttgagtttagacaattaatagctgctaccacaacatgtaattttttaaactatgcctttcaagtttcagcacatttgaatttcatttactatcctttttatggctaataataccatggcttgaagtaaaatatttgcaaatagttcaacatagtagtgagtaagggtattttaactgtattcacattcactccctttacagatattttgtgagttcaagtgaagggaaaggtaacgcgaattatgtattgtagattaaatgcgaagttaagtgatcaccattaatatgtaaaattatcaatggttttatggtttacttaaaataataaatacctgaatatgtattctgcatgctatagatgagtttctccagtatttttacagccagcagacacttgagtcctgtcttctaatgcttatatgctagaacagaaaggaattaaggtgtaagtctatttcatgtgatgcaagtgaagtcaccaaataaaatcataaaactgccttttgctaaggcaataaaactactaataacaggcctgttctacatagctaagaggtttaataaaaaatcgaattccttgtttaaaattacatgtctttcatcctgtcatccaggatactgtttaaagagtctctgttatgcactgctttgtttcttgctcagtggttctgtataggttttcttatacaataaaatacaatgaactttt

SEQ ID NO: 225828 - DNA, 407 bp, Homo sapiens
agagccaggcacacacacacatacccacaggcacacatggacacacatacacacacagactcagagacacgcacatgcatactcagacacgcacagacacacacatgcactcacacagacacacacacacacacctatagtgaattgctctgaggtttctaaatccctttgaaaagcaagggcattgttctcaatggcagtcatgccacttgcacgcacagcctctcagaggccacgtggggagctgccttgtgaaactctgaattagcgatttaaaggctgggattacaggtgcgagccaccatgactggcctacactagatctttattaaattaaataatcaaatatcaacatagttatgctgtattttctcaactccctgctgaaattattttacaaagttaag

SEQ ID NO: 225829 - DNA, 323 bp, Homo sapiens
gaatgaaaagataaagccatgtcattcctcatgtgtatactatatatttggggtcaggtgaagaaataaattattataagaagatgaccagcttccatatttcaggaatgaaaatgcttccagactattgaatatacaatagccttcaaattgagaggataaattcaccctcctcaaatagttgtaaatagtccattgctcactaggaatgagcaaaaagaaaaataaacaggcatgatcaagtaccgaggttttgaatagttaggaattagatactttcacgtagtgttagaattaggtactgaaacctcctgagttatgag

SEQ ID NO: 225830 - DNA, 696 bp, Homo sapiens
gaggcttgcatcaatcaagtaatacacaagtaagtggcttagatataatttaaacccaggttgatatgactagataagaccaagtaaaggtctttgctctattgcactaagttgagcaaagatacctcgggaaatggagataaaaaagcaaataaacaatatggtcccacctgttggaggactttacgagtaagttgatttgtttgcattcaattctaagaacaatagaagatctttacactattcatacctgtaaaatatttagaaaattctgtgggtaataagaaagagtattaaaatgaaaagtaggctgggcgcggtggctgaagcttgtaatcccaggactttggaaggccaaggcaggcggatcacgaagtcaggagttcgagaccagcttgaccaatatggtgaaactccgtctctactaaaaatacaaaaattagctgggtgtggtggtatgcatctgtaatcccagctacttaggaggctgaggcaggagaatcacttgaacctgggaggtggaggtagcactccagcctgggcaacagagcgagactctgtctcaaaaaaaaaaaaagtaaatgtcttcttttttcttctagtccccatattccctttttcaggggttacttatttctcgtgaccctttccagagattatctatgcctatatatttgtgtgtgtgtgtgtgtgtgt

SEQ ID NO: 225831 - DNA, 383 bp, Homo sapiens
agctgatggtggctttgtaaggtgtattaaagggacttgcgtcccagtctgtaggccgtgggagccagcggaggatttgtgtactagaaacggtggggccgggcgcgatggctcacgactgtaatcccagcactttgggaagccgaggcaggtggatcacttgaggccaggagtttgagaccagcctggccaacatggtgaaaccccatctcttctcaaaatacaaaaattaactgggcgaggtggcgcctgcctgtggaatcccagctacttaggaggctgaggcaggagaatcgcttgaacctaggaggtggaggttgcagtgagccaggatcgtgccactgccctccagcctgggcgacggagcgagactcagtctcata

SEQ ID NO: 225832 - DNA, 360 bp, Homo sapiens
tactgtcctgaatccaggaaccccagttccacaccacctgtcatgatctaaatgtttgtgttcccccaaaatgcataggtcaaaatcctcacctccaaggtgatggtatcaggaggtcaggcctctggaggcgatgaagttatgagggtggggccctcacgaatggaattggtgccattataagagaggcccatgagagctccctcaccccttcctccctgtgaggacaccaagggaaggcagggctgtctatgatgcagaaagcaggccctcaccagacacctgatctgctggagccttgatctctaacttacaggccccagaatggcaagaaataaatgtgtgttgtttaagctgaaa

SEQ ID NO: 225833 - DNA, 352 bp, Homo sapiens
ccctccctcgtgtgtccccagctcctcagccttcaggcctccgctctggtgtcctcctccaggcagccttcactgaatgcctctgcctaggtcaccctgcccagcactcagcacgattgcagttgaatgcacattgtgcaaggatttgctgacggacggtctgtctccttcaccagactgccttgcgtgaggtcagacttaaaatgtccgagattgaactctctacccgccccccaaaccacagtcttcctgtctcaataaaagtggccttcatccttgccagtggtacaggccagaaaccagggagacggcctcgacttccctctctctcgtccctcacatcccatctctc

SEQ ID NO: 225834 - DNA, 341 bp, Homo sapiens
tagcagctgggattacagacacccgccaccacacctggctaatttttgtatttttaatagagacagggtttcgctatgttgatcaggctggtcctgaactcctgacctcaggtgatccgcctgcctcagcctcccaaagtgctgggattataggcgtgagccactgcacccagccaggtgggtctttaatatcagcaaccctttgcttccatgtaatttccagccagaggtcccagttcccaagagccaggctgttcctcttccacttgagtgccctcctctccctccaggccacctcctttccacactgctcatctgcacttctcccttctgactctcgc

SEQ ID NO: 225835 - DNA, 561 bp, Homo sapiens
ttggtaaagtttcttttcagggggcaaagttgagtttatatttttggttgttgcaaacctgatttttgtgttttctttccatctttagttacttgtaaaggaatttaaaggtaacagaaaccactgtcagattattgtgcagttcgaaaatgcacagtaatgatttagtccactgtgcttaatttctgtctactaagatgaggtaattatgtaatttgaggaaccccaaagaaaagcagatgttcatatgtctcgctgaacgtgtaattatgtttttgcattttcctaccttctcttgccttttccatttcttggagcacttttcccatcctattggaccacccatcacactgtaatagtgcagctccgtattgttatctctttcatctgctgagctctggagtagaaaagcctgacctctaaagtcaggtagacttgagtttatactatctgtgctacttagtagtttgtgaatctctttgagcctcagttttcttatccttaaaatagcctataccaggtggctgtgaggaataaggcatgtctataatatctccagtg

SEQ ID NO: 225836 - DNA, 324 bp, Homo sapiens
acactcagtcagtcatgctccccctgcaggatggaaagccggatggcagggattgcctggtgaacaaccaggtcaaaaaatataaactgtgcctttcccaatgccagcctcgggtccgagggctctacgtgcattatctcttttagttcactcgacagccctaagagatgggcgttattattagccacggccaggattagggtgaggtcattcctctaggttcgaatttcagggggtgatcctccagaacccttcagtaatcaaaataaataatagttcaatgcaatatatcttatctcgattataagataatcaagccattta

SEQ ID NO: 225837 - DNA, 206 bp, Homo sapiens
agcagaagacagccagaacaaaactggtttctacctactccagaaggtgttctccatctccccatctcagtggaggccagcaccatgccttgcgcagccccaagcctgggcactaccttcacctccttctcccttcctcccacggcaaatcctgacacttctgccttcaagacagctatggaatctgcccccttcttcttctccac

SEQ ID NO: 225838 - DNA, 1162 bp, Homo sapiens
acattgattcagataatggaactcgtttcagtgcaaatattgttaaagggcttactcaaactctaggaataaattgggaatatcatactccatggcatccaccttcatcaaggaaggtagaaaaaaatgaaccaaactttaaagaatcatttaaatcgattttgaaaacttcattgccttggaccaagtgtctccccattgccctgctcagaattcaaactgcccctcaaaaagacattacgtacttggtctatcttctattcgaactgcccctcaaaaagacattacatacttggtctatcttctactttgtcttctcttaggacccaaggtctcttagcacaaacactgcctcttgagttcccagtgcatctgtatcaatctggagattacgtcctcatcaaaagctggaaagaagaaaaactcgaaccaacctgggagaccttatctagtgcccctaaccactgagacagcagtctggaccgttaagaaagggtagacccatcacactcagctacccaggaacattttattttatcaatgtaacctgatcatcgtttcctcaaacaattacatttgatgcttgtcttgttatgccctgtggggacctacaaacccaaaggcaactagcctcttcaggcaataacatacaggacataggaatgggcaaagacttcatgactaaaacaccaaaagcaacagcaacaaaagccaaaattgacaaatgggatctaattaaactaaagagattctgcgcagcaaaggaaactatcatcagagtgaacaggcaacctacagaatgggagaaaatttttgcaatctatccatttgacaaagggctaatatccagaatctataaagaacttaaatttacaagaaaaaaacaaccccatcaaaaagcgggcgaaggatatgaacagacacttctccaaagaagacatttatgcagccaacaaacatgaaaaatagcggatcatcactggtcattatagaaatgcaaatcaaaaccacagtaagatactaactcatgccagttagaatggcgatcattaaaaagtcaggaaacaacagatgctggagaggatgtgcagaaataggaatgctttttatactgttggtgaaagtgtaaattagtcaagcattgtggagacagtgtggcgat

SEQ ID NO: 225839 - DNA, 1180 bp, Homo sapiens
acattgattcagataatggaactcgtttcagtgcaaatattgttaaagggcttactcaaactctaggaataaattgggaatatcatactccatggcatccaccttcatcaaggaaggtagaaaaaaatgaaccaaactttaaagaatcatttaaatcgattttgaaaacttcattgccttggaccaagtgtctccccattgccctgctcagaattcaaactgcccctcaaaaagacattacgtacttggtctatcttctattcgaactgcccctcaaaaagacattacatacttggtctatcttctactttgtcttctcttaggacccaaggtctcttagcacaaacactgcctcttgagttcccagtgcatctgtatcaatctggagattacgtcctcatcaaaagctggaaagaagaaaaactcgaaccaacctgggagaccttatctagtgcccctaaccactgagacagcagtctggaccgttaagaaagggtagacccatcacactcagctacccaggaacattttattttatcaatgtaacctgatcatcgtttcctcaaacaattacatttgatgcttgtcttgttatgccctgtggggacctacaaacccaaaggcaactagcctcttcagctcttgtttctaacataggcaataacatacaggacataggaatgggcaaagacttcatgactaaaacaccaaaagcaacagcaacaaaagccaaaattgacaaatgggatctaattaaactaaagagattctgcgcagcaaaggaaactatcatcagagtgaacaggcaacctacagaatgggagaaaatttttgcaatctatccatttgacaaagggctaatatccagaatctataaagaacttaaatttacaagaaaaaaacaaccccatcaaaaagcgggcgaaggatatgaacagacacttctccaaagaagacatttatgcagccaacaaacatgaaaaatagcggatcatcactggtcattatagaaatgcaaatcaaaaccacagtaagatactaactcatgccagttagaatggcgatcattaaaaagtcaggaaacaacagatgctggagaggatgtgcagaaataggaatgctttttatactgttggtgaaagtgtaaattagtcaagcattgtggagacagtgtggcgat

SEQ ID NO: 225840 - DNA, 1752 bp, Homo sapiens
ggtgcctgtgaggaggcgcccgggccgcaaccgctttccgagatccccagtcgcgcactcgctccccgcgctcctgaggggccgcccggccggaggaggccgtcgcggggctcggcgttcagcatgaaccgcagccaccggcacggggcgggcagcggctgcctgggcactatggaggtgaagagcaagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaaggaagaagcagactacagtgcctttggtacagacacgctaataaagaagaagaatgttttaaccaacgtattgcgtcctgacaaccatagaaaaaagccacatatagtcattagtatgccccaagactttagacctgtgtcttctattatagacgtggatattctcccagaaacgcatcgtagggtacgtctttacaaatacggcacggagaaacccctaggattctacatccgggatggctccagtgtcagggtaacaccacatggcttagaaaaggttccagggatctttatatccaggcttgtcccaggaggtctggctcaaagtacaggactattagctgttaatgatgaagttttagaagttaatggcatagaagtttcagggaagagccttgatcaagtaacagacatgatgattgcaaatagccgtaacctcatcataacagtgagaccggcaaaccagaggaataatgttgtgaggaacagtcggacttctggcagttccggtcagtctactgataacagccttcttggctacccacagcagattgaaccaagctttgagccagaggatgaagacagcgaagaagatgacattatcattgaagacaatggagtgccacagcagattccaaaagctgttcctaatactgagagcctggagtcattaacacagatagagctaagctttgagtctggacagaatggctttattccctctaatgaagtgagcttagcagccatagcaagcagctcaaacacggaatttgaaacacatgctccagatcaaaaactcttagaagaagatggaacaatcataacattatgaaaccgtggtttgaatgttttcagagtgaggatgccatgaggacttgtacatttggctagtttaaaagcatatatacctctgaccagtgacgtggaataggcatgagacgagtaacgttgcaagcttacaatattattaaagtagtagtttgataattgttaatataaactttggtggatcagaggtgaatttaagtccaaaacaaaggggcctttgctgatgaagttacgtgcttttgctgttttgtctgtggagaatcagatgttaaagcacattcttggaactatgtgagaagactagatcatttctgttggaagtggttgcatatttaacctgctgtgcagagcccagttaatttttcctttaactgtatttttaaaattctaatgtgaagtctgattctctcttgtggtacattggggacctcagctcttaaaggtctcatgttcccaatattttattttgattttttttttttttttttttttttttttttttagtgactgggtc

SEQ ID NO: 225841 - DNA, 489 bp, Homo sapiens
gcaccccagcctaccgcgaccctccacacaacaaaccagactctcgcgtagtgccttggacattggaacattccaaaaacaatgtcaggatgccctgtttgaaaacactgtgaagtgctttacttttcacttgagatatttgccatgggaaagactatcatatttttccctaaaggagaataaaggccaaggacgcggaggagatcatccagggcctgctcctcacgctggaagactcttgcgcctgcctgacctgagtaggagtgatacttcacacaccctggaggacgcactcccaccccctaacgcccccctggcagaaatgcgcggcctctatcgccaatgtcggaccggtttcaatgtcttctctcacaatcctctccacaccactccgcccttcctgcatcgcccacctccttgagtgctgaccggcaccatcggtgcttcctcttatccatgaatcccgacctcagcgcatacctcctcccc

SEQ ID NO: 225842 - DNA, 326 bp, Homo sapiens
cagattcagctgcaagtgaatagatatttttacagcatttctataattattttgttttatttttaaacagaagaagcagactacagtgcctttggtacagacacgctaataaagaagaagaatgttttaaccaacgtattgcgtcctgacaaccatagaaaaaagccacatatagtcattagtatgccccaagactttagacctgtgtcttctattatagacgtggatattctcccagaaacgcatcgtagggtacgtctttacaaatacggcacggagaaacccctaggattctacatccgggatggctccagtgtcagggtaac

SEQ ID NO: 225843 - DNA, 840 bp, Homo sapiens
ggtgcctgtgaggaggcgcccgggccgcaaccgctttccgagatccccagtcgcgcactcgctccccgcgctcctgaggggccgcccggccggaggaggccgtcgcggggctcggcgttcagcatgaaccgcagccaccggcacggggcgggcagcggctgcctgggcactatggaggtgaagagcaagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaaggattggaacattccaaaaacaatgtcaggatgccctgtttgaaaacactgtgaagtgctttacttttcacttgagatatttgccatgggaaagactatcatatttttccctaaaggagaataaaggccaaggacgcggaggagatcatccagggcctgctcctcacgctggaagactcttgcgcctgcctgacctgagtaggagtgatacttcacacaccctggaggacgcactcccaccccctaacgcccccctggcagaaatgcgcggcctctatcgccaatgtcggaccggtttcaatgtcttctctcacaatcctctccacaccactccgcccttcctgcatcgcccacctccttgagtgctgaccggcaccatcggtgcttcctcttatccatgaatcccgacctcagcgcatacctcctcccc

SEQ ID NO: 225844 - DNA, 651 bp, Homo sapiens
tgatcgatcgagcggaccggagatatcagctagcaagtagattccttctcattttccagattttctacagtgagcattattaattttataatcagaaaaaaaaagaataactttcattttaaagaaagtaacactgatctgtgtggtgaccattctggggatatgtgtccagcctgaagaccaccaagcaggccccttttcattagcaagtgttgttggaaataatggagaggcaaagcacaggtcaaagcattaaccctggagtggtcagcttgcctgtgcttaactccagaaagatgcaaaatatacattcatcacaagaacaactgagctcttacaaggaaagattttccagaaactcaaggaaaaaaaaaaatcttttctaggcaatttcctagctaggtgcaattttcttataggtctatctaaaaacttttgaaccgggtgactcaaatttgtcagtttccaatattcccatgccatcatcttcatcagactgaattcattacacttgtactatcctgactgtgcatttaggaataaatgaccccattgggtaaagaatgagctgaggtcttattaaagctggcatctttatttccctaaatgtcatactcactttgaaatccactgatagaatgaatgggggtg

SEQ ID NO: 225845 - DNA, 1651 bp, Homo sapiens
aagacagtgtcttgcactccagcctggggcgacagagcgagactccaaaaagaaaaaaaaagcttactataggaaggcaatacttacagatctgatgggataggcttacactttgttgaatgagcaaagatctttattcaacaaagtcttgaagtgcttgaaagtttcacattttcttttttgtacctatttctgtaccttgctaattcttcagagtgatgtggaatatcatttatccaatgttacctgaaaacatccccctaggggagaaagtgagagtcacctttgtacaggagtgtgttcaaaagaatgagaaaggtttttttctagacccttcaaccagcatcttttctagtctgcctgagttaggtcctgcacctgttcctaaccaatacagtctgtccaggctgatctcaaactcctggcctcaagccgtcctctaccttggcctcctaaagtactaggactacgtgtgtgtgccaccatgcctggcttgataatacaaatttaaaaaacagcgtagcaactgtttacacagcatttacactgttttaggttattataagtaatgtagagatgatttaggtatatggaaggatatgcatagattatatgcaaatactataccattttatataagggacttcagtgtcctcggattttagtgtccacagaggtcttgaaagcaatgcccttcagatgctgtgggacaactgtatatgttattttgattttctagtctattacagtgaaaaaagaagtacttttttacttcttaaaatctgaattaatttagtaacctactagtgtttgaaaagcagccctttaagagaactgcttgaaatttcctgagaaaatctgagttgtattattattaataaaattgccagttttgaacacattcaaggagtgtgttaaacacgtgtgtttaagttggtttgatctttcttcagtatctattttgtctattttatttttagcttgattaagataaatagtaaaatacttggtgaattttatggtgtattagtataagctggtattcagatgattttttatttttaacttctttttaaattgttttcctgtcttattccaggccctgaatattttcctcctctttatattagcaattaccaacttgtattccttctaatcagtgttttttctttgtattttactgctccctcttatctaaatccaccatcaattagtgtcttaaaagattttgctgctttagccactgtaatggggtttggagactggcagaagaataaaaccaaaataagtatgttttagataaatgttaatatgtatatattgagtcacaaggtattaatctgatattagcaaatcatgacttcataccatgccattatattaatatagtaaatcttaggtttagcattgacttctgatttctagaacctcactctatctgtaaattgttcattccagttataaaagtaatgaagtatatgaaaatgtttctgttgtcatttgtctatatcagaatgcataagttatgagaaaagcgtgctttttgttttttagtgtgtatcatttaacctcttgacagtcattaggttgacagtgttcacatctgagagaacctgatttaggttcttgaaagaattttgtgaaggccaaa

SEQ ID NO: 225846 - DNA, 1259 bp, Homo sapiens
atattaactaatttagaaaacgttgctttcgcagacttcgccgggtgcctttcactgccaaactaaatactccactttaaaatacgcccctgcgtactcatgtgatttctccttttaggctaggaatgtaatgttgacataaatgtcaaataaaattaatgagagaatgggccctcaaatggtgctcctgtgaagggaatttgttagactgggacctttgagcccaaatgtatatataattatataacactcagacaaggaaggaatctgaatgttaagctttagcaaatgtatcacctttgtcagaaatgctgttacctacaaaaaaaaaaaaacccaaaacaaaacaaaacaggttgcaagtaaattaagatgaaaataccatcagattagaagtctgtcacggcaagctactgcagaattagaagggtggcccatctgctgggtatccaatccttcccttatctgtatagaattcggatcagatgtcttctgttccccgaacacttccgctgttgactttgcaaatggacctcctcccgcccaacccagctccttccctccctcctccgtctctcccaactggccacttaggaagagtaaaaatggcaattagaacaggagcagctattttcactcagtagtcaaagaattggatactagcacagtggctgcctccatccgtatgctgatacataactactttgtcttgtatttgtagtctcaaaaatcttccctaagtatagtagaatcagagaaaatcgctctaatcattgaaaagcgccctgtgctgagtaaagcagccagtcttctcttgtcacagtaaaaggctgggagtaaaatttcccataaacacaggggaaacctacatttactcacatgccaaggaaaatggcacggaagacccacgtgtagccacagcagagtctatgcagagggcctgcaaatgcctggggtgcgagtgaatgcctggaggggcggagtttccaagataacagctattgtgttttctttttcacacttcagaagagaatcctaaggactagactccgctcagtgcattcctttttcatacactgatctcaagtacaatcacataattttgaaaatccatgtagtcctccctaaataaaattataaggataggtttctatttccttccgattacctagatacctccgtcttctggaaaaccccaaaaagaccagtagacgaatcaggaaggtcctaggagtgattcctccaatggcaggaatcat

SEQ ID NO: 225847 - DNA, 656 bp, Homo sapiens
aaatggatttttctagctcctccaagttacagatagttccacgcacacacagaactcaccactctcaaatattttccccactagtatactattaaatttttcaaacatgcaaaagatgaaagaattgctcagtgaacaccatgtacccaccacctagattctacaattaacattttaccctactttctttatcacatatatgtacctatccatctatccattcttccatgaatccatcaattcatctaattttttatatatttcaagttaagttgcagatatgtagcttatgtttcaccttaaatgtttctgcctggctattattaactggagtgcaatatgtttttggttcttctttatggtaaaatctatgttcagtgaaatgcacaagacttaggtatgccattaataggttttgacgaatagacaaaccttgtgtctgaaactgtaataaaaaaatcaaacactaccttgctttcaaaaagtttcctcacttcttttcttggtcaaaacccctccccacctcagcccacccctcagcaaccattgttctcaatttttttttttgcattcctagattgattttgcttgttccataacctcgtataaatgaaagtgtacagtgtgcaaggtttgtgtctggtttttccaccaag

SEQ ID NO: 225848 - DNA, 429 bp, Homo sapiens
catattccctgtgggtaaagggggactactgtatttttctaactgaactgtgatacgctgtaaccttttcttcatgacctccctcccctctacacagcttcttgctccccatagaaagctaggcagtgatgctagttaaaacacaaaacctattttagctgttagcctttcattgctagggttaattcccctgatagcagggccatttcagatcctagggtaatgtaaaattaaagttgtgtggcggatagtcacttggaacattttttaatgggagcttcaaacaatatggcatagtatgtacttttggccggattaatacagccacaagaaacctgtcttcagtacaggataatgattatttttcatgtcataacctgtgcaatctttgcttttactttgagtcagtaaatgagataccctatgcta

SEQ ID NO: 225849 - DNA, 189 bp, Homo sapiens
cttacaaaaagagttagttatgacagtaaaacttttggtaaataccataggatgaaatcttctgaaatttgggttaggcaatgaagtgttagctatgacaccaaagcaaagttaatgtaagaaagaaaaggtgataaagtagagttcatcaaaattcaatacatctgtacttcaaaagacatcattaag

SEQ ID NO: 225850 - DNA, 505 bp, Homo sapiens
agaaaatggatacatgctctgagggaatgaatgtggagagatcagaaggtcaagaacaaagccctacaacatgtctgcagtaaagggatagagaaaagaaaggctataaaagaaggaatgaaacagagttagagtaaaattataaaatcaaagctaaggagaatttccagaaagggtaatatcatttaatatcatagaagtttaggagcacaagatgggaaaaaggcctttgggtaactgacactgaggcagtctttagggaagctccatttccgatagaggagtagacagaaagtcagcttgaagcagggactaggtgaagaagctgttggctggtcgcatggggaaataaataagggatggcatatgccatttttctggatttctttctttcttgcccagcctctatatatgcacagagttttgcgaaaacttacaaaaaataaaaatgaaaccaatttcgtttgcagactcaaatacaatgctttgtgttagaatcaagata

SEQ ID NO: 225851 - DNA, 413 bp, Homo sapiens
tggttgcacataaaaagaatgagtattctgcagtttaggggtgtagtagttctataaatgtcagatcagtggttggtaatgccattgaatatcccttacatcctttctgattttgtctactcagtctccaactatgattgtaactttgtctcaccttagttctccattgtcttttatgtatcttaaaactcagtaattaggtgcatatacatttagaattgataagttctccattaactaaacattgttataaaatatctatctctaatacttgtcttgaagtattttattaatgttttcatggtatgtctttttccatttttacttataacctattggtatctttatatttggataaagctcttgtaaacctttttgaagctttttattgaatctgatgatctttgctttta

SEQ ID NO: 225852 - DNA, 448 bp, Homo sapiens
agcccttcaggaaccaacaaagtcagctggagaaaatccgtgcagagtagacaagagggaagctagtggtggaccttagattgatctgaaacaaccaccagagagagaacgtcggcgctaagtttgaaaatactgaaaagcacactggtagatcaggctacttactactgggaagggacttaaccatatgtgctgcatgcgaggagatggtcttgtcccactttttgtgagaggagatggtcttggaaggataagtaaggcatcctggtaaaaagggtcaaagggaccctcttttagaggcgagctctggaaatcttgcagtgagagggaaattgaagaacctgcaagaatctcttcccttgcaaaactgaaggtagcccagccccttctcccatcattccccttccaaataataataataaataataataataagttcaattttaaa

SEQ ID NO: 225853 - DNA, 703 bp, Homo sapiens
ctggtaaatattcagaaaataactggaacacaagtactttaaaaactaatccagcactgaaagaatagacaacactgtgccagtgcattctacaaggcaactcacactatatgtgatgccaaatgttaacggctcattttactttttccagaaaataatctgagctggttctcaacccaggcatatttcctatgctccctctatataatatacttttcccacacttaataaaattcttgtgactgccagctgggttaaacttgtgagctttccttctgctttcttggcttgtctctgttctacttgatattatcttcctgagacttctttgatgtcatcctaacttttccctgattatttcaatcctactatggctaaaacagtgcaccaactataaaactggaattacattcttcttttccatgcttaatgggttcttcctaactttgttctctattattaataagtctctctttttcaaacccaaatttttcattttgtactaacaaaatttttttactaattttaaaacttatatatgatattgtggaaaataacataaaagtaaaaagataaaaatataaattacccatattctcactaatcaaagatgaggtaaaatttgattgctttttttgtttcctatactgaatgtttaattaatgattttgaattttttcttattaatagcaaaagtattcaa

SEQ ID NO: 225854 - DNA, 363 bp, Homo sapiens
gtagcataattttttaagtcataaagatctgtgaatatcttggaaatcagctcttgaatatttatttttatgctttcctgctccatttttagaaaaggatgataattttgtattacggtggtgattttttgtgtcatagtacagaagattacagagtatataaaaatatagagacatattttgtcaaaaaagattagggatcaaatcctgagtagtattctcacatcgtcttggtactgaggctttctgcttgtgtacacgctagtgtagaaagcactttcctcctggattacaccaagatgacggagatgaatggcgcaagtatgttgtatcaatattgaaaatgaacatgagcctggaaaa

SEQ ID NO: 225855 - DNA, 785 bp, Homo sapiens
ggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctact

SEQ ID NO: 225856 - DNA, 367 bp, Homo sapiens
aagtgcactgtttttacttaaagtgtgtgttgtgttttgttttgtgttgtgttttggaggggctggtagaatttgggaagtctaactccatccttgctccctccctaaccacatagaattactaaatttcagaatttaaatactgtatgttccctacaaagctgaatttgaaaacggctctcattgagaggcagtgtgtttagttaagagcctggactttggtgtcaagacctgagttctggtctgcctggggcaagttaccttacctcgctgatcctcagttttctcatctttaaaatggagatacggctgggattacaggcgagagccaccatgcctggccgaaaagcaggatttctgcaagaat

SEQ ID NO: 225857 - DNA, 150 bp, Homo sapiens
agtctgtgtatgcttgtccttatacaacaaacttctacaagcaactatacaacaaactatacaagcaacttcactaggctcaaatgtaaattttaatgttaataaaaacagcttccagtcttggtaacacagtgagatcccatctctaca

SEQ ID NO: 225858 - DNA, 480 bp, Homo sapiens
aggtgtctcgcttccccatttatcttttgaaagagaatgggcacctataaacctgactgtcaggattcctgactgcctaggagaggtggggaagaagtggcagatttggggacctgaggcagcagtggggttggtaggcttgtccaggtcgtggcgtattcccctccgtccctgttaggagctgaacccttagaatgttgctggggagatctggaaagtttactattctactaatgttttgtacaagtgagaaagttgaaagagagagcgagaacccaaatgcagactgtcctgccatcatgtcatttaagtaatgtggcatcaatgtaagattcccttccaaggcccacttcatgtgagtaatgtttaatactagcattttccaaagcggcctggctgccagcagggtcacggccaagggtacatttgaacagtctgaagaaaaaaacaaaaacgaaaaccaaaaccaaaaccaaaaca

SEQ ID NO: 225859 - DNA, 420 bp, Homo sapiens
actcatgtggggtattctcctctagggctaaaatcaaaaatggggcaaagctgaagatgccaagtggtccccaggaacattactgctcacaggagggacaccccaagatgagcatatctgctctgaccacataccttctagccaggcctatctacccagggcccctcagaaccgaccatgattaaaggacagccttggtgtgatctgctccatccagggaaatcattcagagttaattttgcttccttttccctccattccggttctgtccacatcctgacttctgatatgtcctcccttctggatccttctcccatcctttagacttcacattgatctgggtttccctggctttgacactcagtaagggctttgggcaaaacccaccttttggttccagcagctcctgtttgccccaag

SEQ ID NO: 225860 - DNA, 452 bp, Homo sapiens
tcagtgagtggtcctgggcacctgagcttgtgcactgaagatttgtgctgatctgcagtgagatgggtggagatttggagggcaaccacttagagactttgataccaattaagcagggtaactttaggtctgttaaatctaataataattttaggcttgaattttagtgtatatttttatttcattttcttagtaattcattgtcattgcattgtatttttatttttattgttttagagacagagtcactctgtagcccatgctgaagtgcagggttgccatcacagctcactgcagcctcaaactcctgggctcaagtgatcctccctccttggcctccaaagcactgggattacaggagtaagccaccacacccagcctgttattgtattttatgaaaatgctcacctatggtggattgaaaatgcacttaaacatctatttttaagtca

SEQ ID NO: 225861 - DNA, 241 bp, Homo sapiens
aagcacgactgtgacaggggaatgggaaatggagaaccagcgtaatgtctccattgcaggtaaatttcatacggaaattaggtatctggaaaaagattcccttaaaactgattctttatacccttatatccttaaaaggcctcatgtacctcaggaggtctgtgtatctcagtttgagggccaatattctcgtacagacaaaaatgtataaaaatatatacaatgtgatacttcttgatac

SEQ ID NO: 225862 - DNA, 631 bp, Homo sapiens
ctttcccagagacagattgaacttcaaggtaaaagtgaattttcagatgcggacaagctaacttctaaggattatgagtaattcgactcatcttttaaatatccagaaaacctcatttttagtgaaagagtggagataaaagaatattaagagtccagaaactggtgttctggctgtggccctgccttagactgtctcactttgtagtcactttatgcaggaaacgtgcccgggcatcttgaaatggatgagttctcttctggagatatgtctcatgtgtacgcatatctggagatatgcctcttgtgggtgctgctgcagctgctgtgcccatctcatatcaatacccaagcttttctcatgacgaaccagatgactcttggtaaccaggtttgctccccagcttctaatttcaatatgatgagaagttacataacatttactcctttgtaaaggtttctctgtcatcagacaaaactctgaatagaaaccggtgggtaatccagtgtactggtttttcctaatgtatttggtactatagtgtatgaaccgagaataatcgagtcaagtgaaacccccttttccagtcataaaatgtctcattcattatactaaaaggagctgttctttt

SEQ ID NO: 225863 - DNA, 177 bp, Homo sapiens
ctctagcccagcccaggcctcagggagagctccccacccccatacacactgtgcctgcccgctcagcactgatacctccttcccagggtatcagttccagaagcgctccccacccctgacaggagagggtagaggctctgggaaacgagtcttctagtggaagaagtgaactacaaa

SEQ ID NO: 225864 - DNA, 319 bp, Homo sapiens
tagagcagtgagtctattttatatgatactaataatagtgaatacatgtcactatacatttgtaaaacccatagaatgttcaacaccaatagccgtaatgtaaactgtggattttgggtgatagtgatgtgtcagcataggttcatttttgttgcaataaatgtaccactttgtaggagggtattgatatgaaagagggtttatgtgtataggggcagagcatgtatgggaactctctgtacttcatgctcaacttttctgtgaacctaaaattgctctaaaaatagtctatttaaaaagtaaatataccataaaatct

SEQ ID NO: 225865 - DNA, 361 bp, Homo sapiens
tgtaagttttctgccttggccctaccaaaagaaagcattgggacatattggtggacccagaaccaaggtgctgtgagtctcctacctggatcctggctgcaggaagcattgtgccatatctctgcactcatcaactatttggtggagtgctcttctcttgcttgggcttatcccattggagatattgtgatgtatctctgggcccatcgcctagattacatggcactcgttttcttcctgggacctatccacagtgaagattgtgacatatcggtagacccagcacctacatgatgtgactttcttctcatactggggtcatgcccactgtggtgattgtgacatataactgggcccaaac

SEQ ID NO: 225866 - DNA, 373 bp, Homo sapiens
cattttcatatttattaataggggtaagaagaaccaaaatgtgctgttaaagtgggtcagtgcatgtctggaaatagtcccttttgatgtttccaaagtctcaaatttctacctgtactattcaatatttttatcaatgatttggattgaggacatagagattccagggataacatatttgtatgacatcatgtaaatgtattaaaagtattgtgtaacataatcagaatccctcaaaattctaacagcacaaaatgaatagccattcaaatagtagccaacatatttagcttaccacccttaggcaatggaaagcataggcattaacaacctccattaaattatgacattaaatatttatagaaatctatga

SEQ ID NO: 225867 - DNA, 954 bp, Homo sapiens
cggacacgaggtttttctctacctcaaagagggagacaaacatatgtactcaacacatatgtgtaagtataagtgccgggaagaggagtcctccaaaagaggcctgttgagagtgacactgtgctgtgacagaaacttctgtaatgtcttctaatggagcttaggaacttgcagaggatcatctgatcaagatccagaatcaagaccaaccaacatgaactgttttatttcccacaccaaattccacactggcctaagatcccagagagagctgcaggggctgtcctcattgcaatgaaggggctccccacaccccacctccaccactagattcctaaaatcatgagcattgaaacaaaatcctccatgagctatgcttattcttttgtcttctactcctgatttctgatttctatcccttgtaggctaaataatggacccccaaatatttctacatcctaatctctggaacctgtgaatgttaccttacatggcaaaagggactttgaaaatgtgattaaggatcttgagaaggggaggttatcttgcattatctgggggggccctaagtggaatcaaaatgcaaaatgcaataagatgcaagtaaagggagatatgacaaagaagaggaaaagatgatgtgataatggaagcagagattggagccatgtgctttgaagatggaggaataggccataagctaaaactaggaggccactagaagctgaaaaagtcaaggaaataggttctcccctcagagcctccagaaaccagccctgctgacaccttgatttaagccctgtaagactcattttggatgtctggcctccagaactctaagcgggtgtggttttcagccacaaagtgtgtattgttttaagccactaagtttgcaataatttattatagcagcaatgggaaactaatacaatccaaataaacttctaggaattc

SEQ ID NO: 225868 - DNA, 575 bp, Homo sapiens
cattatccatgttttcttcttcttatggttcctcaacttgtctttcagtagtaacaggatcttctacactgtagctgcttccagtgtgagccagacaaatgtactgaatataggtaagtactgctcagttttctccatgagcttcatcctcagggccacgtttcttattctgacaacacttagggatgctttcctggtaggaatactgctgttcttaattgcatacatggtgactctcttattcaggcctcagaggtgatcccaccaccttcacagcaatggtccttccccaggagcttcccctgagaaacgggccatccagaccatactgctgctggtaagtttctctgtggtcctctgttgggtggatttcatcatctccttctcctcagcaatgttgtgggcatatggcccaatcaaccagcaagttcagagtcttgtagtcaatgtctatgccgtgatcagtcctctggtgctcctcacttcagataaaagaagaaccaatattctgaaaaatacacaacagaagtgtcatagatttaatatcaattaataataaaaataattcttggaaa

SEQ ID NO: 225869 - DNA, 440 bp, Homo sapiens
gggttgttttttttaatgtagacattatctgttgacttcatcctagcagatgaggatttcgttcccatacacactggtaaacatggcgctatgctgcccatacttaattcatatttccttagtttttagttaatgccctttttctattctaggattccacctaggataccacactgcatttagtagacatgtttccttagccttctcttggttgtgacaattaatcagacctccttgttctaatgacctcgacggttttgtggagtggtggtcaggtattttgtaaaatgttcctcagttggaaatctttggtttgggggtagttttgtttttggttttgtttttttgtttgtttttttgacacggagttaccctgtcatctaggccgagactgtgccactgcactccagcctggcgacagagtgagactccatctcaaa

SEQ ID NO: 225870 - DNA, 462 bp, Homo sapiens
aatgtatcattgctttcccgaaggccgaagcaggctccaagaatccctgaaaatacatatttctgtactttaggattttttgatgttttgatagaaactatgtatggcttagggtcttttctcaaagagaaagagaggtttctttacctgccaaagagaaacctgggcgggagtttgcttccttgagacctgtaatttccagggggtgtgcatttgtgctggacagatgttgctgcttttagaagctcagaggagtggggttagggaaggacagtgtccttcaggcaaaatgaccattatcccctgcttaaagcatgattttctcctgttcagagtggtttttaaaaaacatttctgaaaatgccagaaaaattttagtgtaatacttaatagcagatattttacttatattaattttctggaggcaaatgtgaaatcataaaagaccatttcttatgcttc

SEQ ID NO: 225871 - DNA, 381 bp, Homo sapiens
tgacaaatcaaacctttgcagaatttataagtaggcacaagagagggataagaagaggaatgtaaaagtgacgatttttagtcagaaaaagccacaatcctgtcctcccctactcctcacacacacaacatccctctcacccagcttccttcgattaggaggacgttgtcttaccactctggcctcctacataaatgagaaccgcttgtttaaaatgtaactaattttaaaaggactttaaattcagaaaatgtcattgtagttgcccctgtgatcaataaaaacaggcttaataactaaattcattgagaaaaagcttaatagttctaatgagaatgttaagtattcaagccaggtttttcaactttctagaactaaata

SEQ ID NO: 225872 - DNA, 263 bp, Homo sapiens
ctggaagaactgttatttttaacttcaaagaatttattagaaaataatattttttaaaagcgcacatagtgacgagcccacgaggatggagcctgcagtttgtacagagaaaacaaaggatgtttttgcattaataaattgagaaataacgctgtaaatttactaaaatgtatttttgaatattttgtaatagttttatagaaataaaatgtgccatgcacagaacgcttagtatctaataactaagaattcctgttgcagcc

SEQ ID NO: 225873 - DNA, 609 bp, Homo sapiens
gggaatccaagtgtagttagccagacagttcccctgccattctgtgctccaggggtctaaggctgacacctagtttcacctgaaaaggtgattcaggtttcttaattctttacagaacagcttagtactcagggcaggtgtctacttgtgggctgatctccatctggtatctaggaattaacactgtcatccttgtgagagtctggagtagaagttcagttcctcttggtgtggtcttttgccacggcaggtatgatttatccattaggaatgtcatcccaagtgcaagggagaaaatgattttgttctcctaccctattaaggcagtgtctgaggggcagactgatcatgtcagcaaacttgtctagttctgcttcctcccgggcctgttgtgaggacctgacatacctgaccatgaaatgatgtgctcttgaatctgaggaagtgttgggggtcagcaagctttgagaggagggttaggcccttctcatgttaacctctactggccagaaccagactgaccagtagtcttctgagttagttaagtagctcttggatgtgatttccttccacccaaaaaatatgggcaaagccccccagagggaaggt

SEQ ID NO: 225874 - DNA, 982 bp, Homo sapiens
cctgatgtagacaccatggtctttttctgggttctagttttatggggcccagaatttaatggcttattaacaatttaatagatatcttcttcactcatttcatatacagccacattcctttagtcaatttttgtgctgttctcatccatttaaaaacaccccaaagtctcattagaagcttcatgtcatcatctaattcatgtgaaatatagcccatggtgtcttcaggagggtccagttaaaataatttacatcagcacagggcagtatagctgtcactttggaggtagtggataaggtagttgtagctgtcttcttggagatggaccacgtaattgttatctaggaatgctcgaagcttgaagttagataggatgtcctggatggtttgagtggtctgtagctgctcaatgacgcccttctggctagctttctgcagaaacattccatggaagcggctgtaaaaactttccactgtactttttggactgttctggaccaggctgagatggaggcagacaaagagaggataaaggagaggcatcacttcgtggctatgcggggaatcagaatcgatgagaaaattccgcagtcgtccaaactgtacttcatattgctggggctctgcctggcaagggactgcagacactatgtcggcacaatgagattctctgtgtaccgtgagattggccgccaactcttcagcagtctgtggcagccgcagtccttgcttcaggggaccgtctgagtccacgtactgccagcgtttgaggtagcaggacactgccatctggatctcctcggtacgcactcatttcatgactgaacatcccaggcggccccggctccccacgccgccgcctcccggatcgagatgcttccgcctccgtcgtctctgctgcaggtctcgctctgaccgccggctcagctgtgtcctggagccccgcgccccgccgccctcgccgccgctctgggcggccgc

SEQ ID NO: 225875 - DNA, 312 bp, Homo sapiens
gtagtgagggagggacacccatccttgacttgcttaatgcgctcctgtaagacctccagggcagcatcgttctgcagaatagggctgggcatatcaggggcctccaagtaattgttctcactgcgggaggagctgccacttgcatacagctgttagtctgttgtcttggcaggctgcacatcaagatgaataagtaagataaacattttgcacagggcagtatagctgtcactttgggaggccgaggcaggcggatcacaaggtcaggaaatccaggccatcctggctaacacagtgaaaccccgtctgtac

SEQ ID NO: 225876 - DNA, 865 bp, Homo sapiens
tctggtcttagtctccccatctgaaaatggcataaccaacctacctgcctcaaatacaagaccctgcttgtgaaggtgagctatttaggagactaccatctttcctttgaactccaacagctctttatgcgtccccctcctgggacacatctcactgacttatctccccattagtcagtgaggagcaattggaaaggcgggttctgggtccagttcagagcaggcctcctgacccctagggctgagaagctgagaccctgccagagcactgaggctatgggccagcccaggtcggtgcattcattcccattcgctcatctccttcccggcgttctgctctgagcccatcaccagaggcaagggagtttctagcttgaggatcagacgtcatcctccgcagactgccttccccacctcatctgcacccagcgtatcccagaccctggccagctccacgggcgccacagaggtggagagggacccaaccccgactggccaaggcagggccacggaagtctggggagaccgtgcggccgcgggctggcggcggaggagcgaggcgctgacgccgattcccgggaaaggctcttagagctgccgcccaggtcacaacgctaaaaatacccagggcccctggagcctgtgctccagcagcgaggagggggagggagaggccaaggtgggggagctgacgggggccaggggctctgggacaccccctctcttttcccctccccctaaccccaccgatctcacgagactgaaggagctgtcccccggggggccgcggagcccagagctggagaaagggagttgtttacgcgacctataggtactggaaagggggtgaagagatttgggggca

SEQ ID NO: 225877 - DNA, 392 bp, Homo sapiens
aaattttgtcacacctgatctgagaatataaaatttgttcatttgcaaaacatgcttctgaaatattttgtttccattatttatttagccagctagtttcttatgggtactaaagaaggtctcccaaattacctaaattccacaatagggcttagatttatgaagttttatattttttcctccttataaaaagctctttttataaagaatatccatgtaatactaaaacggggaaatctcctaaataatatattttttaatattacttttttaaaaagctagggtgagcacctcacaatcaaaatttaatgtatttgtcatattgaaatgcagggttttttgaaggaaacatggtaggtaaacattttagttcccaactcctgatcgttaaa

SEQ ID NO: 225878 - DNA, 487 bp, Homo sapiens
gagaagaattattggaaattttagtcaggtctgtggcactaaggaaatctgtcaaaggggcaggaccctagccacggagttagattcagaagtaaaactggactttctgagcagggaaaaaagagaaggtgctgacagcggcaaagcgaggcctcaggtcatttcttaccagtttaggcttatgggaccaaagcagaaattcaagctacagacccgaggtacaaatacaaagtgagcagatggtcttggaaacaggtcagaagccttatgactctaaggggtctatatgatcatgcatgagccaggaggaaggccactttgcgccggttccctgagcttagaagagttaagttcgcagagctgtgggcaacacaggcgaggcaggaggagtgcctcaaagaaccagctggtacatgcacagtcctggccttcttcacggcacatttgacagtttctgttgattaaaaataaagtttctgatcctcat

SEQ ID NO: 225879 - DNA, 485 bp, Homo sapiens
catatatggaagcttgctgggtaacagaggcatataaagaactgttcaacaaattgtgcccagtaagttgaaatccctggggatcagaaggaaattggattctgtcttatcctctatacaaaaaatcaactcccagttgattaaatacagttgacccttgaacaacacagatttgagatttgcgatacttaaactcacagatgaactgtgtagcctagaaaaaaattttttagtttttaatttttattttttgtggatacatagtaggtgtagcctagaaatagtcaaaaaaattaaaaagtatgtcatgaacggataaaatatttgtagatgttaatccattttattgtttgcagaaagacataagatatacacaaatctattataaaaagttaaaatttcactgggagtctgatgtgggcagatcacctgaggtcagaagttcgagactatcctggccaacatggtgaaaccctatctctatt

SEQ ID NO: 225880 - DNA, 461 bp, Homo sapiens
taggctgggatggggcttcttggtctccacaggttcactctccaccagccagctcttcttcctgactcccctgtgtctgtgctgggcacctcctcctgctgcccaccaggcttggagtttgggaatcatctccaatacttttctctccctgtcctgcagctacctgtttgtttggtcttaacgggtcccccttccctttcctccctaccccagtgcccacagagaatatctaacagcaaaacgtacttttcctccactggactccaccctggcttggagcagatatggaattcccagttctgcccacagcctcctcccttagctcccgtccccagctgctcacccccaaacacccccatcctcctgccacagttttaaaaagtgttgcttggattgggccatcgcctgcttagaaacttaaatgtcttttgtggcttctcaaataaacatttaggccctta

SEQ ID NO: 225881 - DNA, 381 bp, Homo sapiens
tacagaaccaagcaagttctataacctctttcagtggattttaaaatgtttgtatagacatatgttcccagctgtgggttttgtattctctctaggacacaaggaagcagttcccaatatgccaactaaggtagctaccttcttggtgttcctcagtgacccatactgagcccctttcattcaatacagacacattcttcctgaggtgatcttctgcacgataaggtgatcttctgcacgatgaggtgatcttctgcacgataaggtgatcttctgcacgatgaggtgatcttctgcacgatacggtgatcttctgcacgataaggtgatcttctgcacgataggtgatcttctgcacgataaggtgatcttctgcacgat

SEQ ID NO: 225882 - DNA, 1185 bp, Homo sapiens
caccaacatgtatacaagtggcatgtcttagtctgttttgtgcttctataacagaataccacaggctgggtaatttacaaagaagagacatttattggctcgtagtttggaggctgggaagtccaataccaagatactagcatctggtgagggccttctcgctgcatcataacatgacagaagccatcaaatggtagaagagcaaagagacagcaagagggaataagaacccattcttgcgatgatagcattagtccacctatgagggtggagccctcatgatctgaagcctcttaaaggttccacctcttaatattgttacagtggcaattagatttcagcatgagtttggagaagacaaaggtttaaaccataacatggtgtaagtcacataactctgggtcatatgcatatgaaagaattcgaaatttctctatgaacacatgctagtcttatttgggtttagagaaatctttagttgcagctgttaattcatcctgggtccaaggtttacatctgacagttgcctacatacttggctcttgaaagcatagatctttagaggtaattggcattttggaattttaggatattttttgggaaaataaagggggcctgggcaaaggatagaagagggaggaggtgcagaaggagaaagattaggcagggtacggtggctcacgcctgtaatcccagcactttgggaggccaaggtgggcagatcacgaggtcaggagattgagaccatcctggccaacatggtgaaaccccgtctttactaaaatacaaaaaattagctgggcgtgatggtgcgtgcctgtagtccctgctactcaggaggctgaggcaggggaaccacttgaacccgggaggcagagattgcagtgagccgaaattgtgccactgcactccagcctgatgacagagcaggactctgtctcaaaaaaaaaaaaaaaaaaagagaaagattagaagggtaaaggggaagtagaagagttagatataaggcagcaactagaggaataggagggggaggatattgcttaagtttgccaaattgttcaatggctttattcaaggaaatttttactgaaacaattttttattcagaaccttggagattgtacaaatacgattcattccaataaaaaactactgcttactgggcctgagaaattttgtttt

SEQ ID NO: 225883 - DNA, 339 bp, Homo sapiens
ggaactcaggtggatgctgtatgttggcttcagtgtatcaacactgataattgtgctgggactgcactgtggtaactggggggaagctggctgaaaggtatgtaggaactccctccactatctttgcaacctttctgtaagcctcagattatttcaagttaagtagttttttaaggtcacaatggagtcactaaataatcattctcattagattttcgctaatttatagaggaagattctgcatttgcaaatcttagaacagagtaatgcaggggcattcttttcatcaagactatttcttgagctattttctaatccttctcatacacactcccatcc

SEQ ID NO: 225884 - DNA, 395 bp, Homo sapiens
tacaaatgtgcaacacaaactatggattctaatgtaaactatgaattttagttaatgtaccaatattgctcatcaattgtagcaaatgtaccacactaatgcaagatgttaatatcagggaaaatcgtgaggacaggcagagataatgggatatgtgggatttctccgtactttctgctcaacttttctgtaaactctaaacttctcaacataaagcctggccagatgctgtggctcacacctgtaatatcagaacttttggaggctgaggtgaagggatcgcttgaggccaggagtttgagaccaggcagggctaacacagtaagacctcgtctctatcaaaaattaaaaattagttgggcatggtggcacacaccggtagtcccagctactca

SEQ ID NO: 225885 - DNA, 273 bp, Homo sapiens
accttccgtcctggggaggaggcaagcccgcccttttctgcgcccagagggagccaggcatcctaaggctcccggcgcgctccaaacaatcttgggctcgtgagtcctgagatccccgcgttccctcggagagttggagtgcggacgaggtcctgggtctccgggccagaggagtaggccggggccctacgccgcgtccccctccctcggtcccaccctatcccgggcctggcccgccgccctcgctgcgcggggcaggccggattctctgca

SEQ ID NO: 225886 - DNA, 233 bp, Homo sapiens
gtggcatccatcacctctcttatgatgaggcagtcaagagataagcctgcccaactcagaacatgggagatgtcagtttcagattggacatacattccctgaagtacttctcacctttctctctactcctttgctgtccttggcattcagtatgttaacccttatgctgagctgcgctactctgttcagttgcctggaattcaggaatctactctactattagaaactccaat

SEQ ID NO: 225887 - DNA, 433 bp, Homo sapiens
atagctcaaaaaccaagcctccaaaatatcccagatgttatctacattcaacagcaataattccaaatattattgagctcatgtacctggcactctgatgacttgaaaatagtattatttcatttacaacatattgctgccttgattttttctaactaggttaaataattactagaactgagactgggattcagttttgcctgacactacattgcctctttagtatgatgcacatccatggattgttagccttgatttggctgatgtgaccggctaggcaactggtatcttctctcacccacctgtgtggattcctgaaagctgtgcactcagatgaagaaattgataagagccattatttcatcaagggttattgagatgctgaactcctctggtgggaagcacaccataggatgctttaactctacaaagc

SEQ ID NO: 225888 - DNA, 222 bp, Homo sapiens
gcagcacagcttcaggtccaccactgtcttggccaatcagtgggaaggaggtgaactctctgccccatgtctttgaccccttcaggtggttgtccctgacaatggccaggccaggctggagctctggatcccacccttcccctcacctcatcatctgaagcctttattagcatgcaactgaattgatctctttcctttttcatagaatccaattaacatttg

SEQ ID NO: 225889 - DNA, 206 bp, Homo sapiens
tcaggggcaactgactttccaccctacagtgaaaattattccttactctttcttcaagaaaaaatgggctgagcacggtagctcaagcttgcggtcccagtactttgggaggccaaggcaggcagatcctttgagcacgggagttcgagaccagcctgggcaacatggtgaaaatacaaaattttctctgcaaaaaaatataaaga

SEQ ID NO: 225890 - DNA, 545 bp, Homo sapiens
gtcaggtctacagaggagcttccctccctgggagtaggagggctccaggtgcctccttggggtctgtgtgtcccccttcctccctggtatgtcagagcccatgcctctacttgctctatgctgttgtaaaacaaggaatgaccaactgctacaatctttataggactgctctgtaccaaaggcctttactgggggaatgtgagaagaagagggaaatggtttaaaaggatgatccatggggaggatttgatcatgcaggcagttaggcctttatactataaaacttcatcactccttagaattgagcaccatacattgcacacttttccctagttgaaaagaattctgaaatatactcttattggcaatagagttctatgacaaagtggatggctaggctcagaaatcagagacctgtgaaaaatattctgtttctgcccttttttcgggggtggggtggggaagggaataaaagtctccccttttctctcagagatgttatgaggattttaaaaaatacctgaaataaagacatatctacattc

SEQ ID NO: 225891 - DNA, 553 bp, Homo sapiens
tgctttttctggattgtgcaggtaaaagtaagtaaaaatgagaggatgataatgctttttttgcctcaaattattatacttcttaatgtctattagtctaatttatgttgctaagtgttctggaattattttgatttctgtggtccaacaatttggaatgtttttaaattttgaagtgcttgagtttattgtttgtttacatttttcttaatgatatctaattttatttccttctgaacatagaataagactttatcagattctgctttggtctatattgagattttctttgtatattaatttatagttcattttttgaaatgccctttggattcttgggaagggaaaaagtgtatctttgtagtctgtttatatatgtattttcaatctttcatatatattctcatcgtttaatattattcatactttctggattcctttttattttttacttagagacagtatctcattgacttagtataattgtgtctctgtcaaatttttcttttatttttcagtttgtacaataaaaatttatgaccactaaaaaaaa

SEQ ID NO: 225892 - DNA, 479 bp, Homo sapiens
caagacccctccccatcaacaaagaattatctagcccaaaatgctgtgtaaaatgtctggtatataataagtataatatttgatgaaaatcagtacctttgcccccaggtgtgatatttaagaaggtcaacttactaaatcagtgatggagttagtcctaacatctgggtgttctgactgctgctaggccagtattctttatatgataataagaactttgtccacagaagatatccctaataacaaaaaaggtttatttgaagaggactcatgtgttctttggctgattgtgaaagtgttgctttgaacttctgttagaaaaggttgaagatgttttccgtaagtgtttttaatactgtacgtagtattcagaaggatgtttaattttttttttaattttgctagtagtttttaaagtaatcctttttcctttaattatgtagttgttgaactgttgggagttacttttctcttactat

SEQ ID NO: 225893 - DNA, 443 bp, Homo sapiens
ttccacccgacgcggaggacacagacaagctggcatggcctgttgtcagggggtggacagcaaagccatttcctccacctccaaagtcccttcctacccagaatcttccttctgattcagaatcagtcatgtgggaaccagagctccttggcccaaagtgtgactgtgactctcctccacattctcggtctgggagatttcaggcattagtccgcgctctgtgactgcaattttgaactcctgagcgggcctccctcccctgccccccaggaggtgtagaagagaactggacaagcctctcccaagcctctgacaatggtgtccacccttaagtcaatgctttacagttccaggatgattttccccttttttaaggatgtgagttatacagttatatgtgcacaaagtttttaaaaattacaccatgcagaagatacaaaagg

SEQ ID NO: 225894 - DNA, 249 bp, Homo sapiens
  misc_feature (15)..(15): n is a, c, g, or t
ggggagagcgaagcngaggagtccagcgctcgccgacaggggcctgggctgtcccgagccggaatccagatcttacataagatggaagtctctcacactagatactgaacattaaatagaaaatctatttagtaaaatctaagttgccaaggaagaaataccagtaaaagttgctgtaagaattagacctctgctttgcaaagaagttcttcataatcaccaagtttgtgtgagagttattccaaacag

SEQ ID NO: 225895 - DNA, 570 bp, Homo sapiens
caggaatcactatctggggtagacagaatagtggcccacaaagaggcccacatcctaatccccggaactgagaatatgttaccttccgtggcaaaaggggattcagcagctgtgattaagaaccttgtgatggggagggattcctggattacccaggtgagtttaatgtaaccacaaagatcctttcaagagggaggcaggaaggtctgaggcagacgaaagagctgtgccaagggaagcaggcggcagtgggatgcaggtggcctctagaagctggaaaaggcaagtccatgggttctttcctggagccttcagaaggagcacggccttgctgacccatcttagaacggcaggataatcaatgtgtgttgtttgaggccactaagtttgtggcaatttgttacagcagcaataggaaactactacactgtgtctgattagatcaggccaatgaatggagaaagtattggatttcagttgagtgctaaaacctggtctgtttaaaggttcaaattgtttgaaacagtttttacatctttaaataaataaattaccatctatacttaaaaa

SEQ ID NO: 225896 - DNA, 451 bp, Homo sapiens
tactctgaatgtaaatagatcactgttgcagatgggagttctctgaacctcttctggctctgagtgctacctggttcatgacttattctttgctcaagaagtggaggatcacatctcaccctgcaagtgcgagctatgcagagtgctgttctgctgaggaatgcgtatggaaaggtgaggaaagcaaccacacagcggataaagttgagaaacactacctcagccctgtggccaaggtcagcatcaacagcgacacattatgttggtggtatatactcacatgatgtggtcatgtgatgtggtgatgagaagagcatttcctcctcaaagcccataaccccattctaataatgagaaaactatcagcaaaccccaaattgaggcacagagtgcaaagtgcctggccggtactcctcagaactgtcaaggtcaccaaaaacatggacagacc

SEQ ID NO: 225897 - DNA, 470 bp, Homo sapiens
actgttttgggttttccttttcccctggcagccaaagcttgggcttagggttattggagcttccacatgtgcatgtggggaaatgaacctgagtcacaggacagaaagtggagtctcaacactgtgatgctttcctacaaggcacacatggccccaggcagagccaggctgcatgccttgaaggaccttttgcttcacacactggggccactgctatgacactgcctttttgccaatagtgatgacaggcaatctaaagccccatcatcacctctccacaggagagcccacagaggccacaagaatcgtcttgtaacaattgtttgctgcaaagcagagagggtgcacaagaaccgagggctttggcatttaaggatctttcttcccttttattttgttcttttgttttcattctatttttttaagctcagaaacctgaaaatgaaataaatgagccacaggtagaaata

SEQ ID NO: 225898 - DNA, 123 bp, Homo sapiens
aattggctggaaatgtgtcatgtagaggaaaaggaatagagataatttatggcagagaaaagtatgctaaatttagtattggctagtatataaaagctaaaactggtgaaaagtttatggagt

SEQ ID NO: 225899 - DNA, 359 bp, Homo sapiens
cggcttagggcaaacctgtctcccgttctattcaaagtcacccctctgcttactgagatagatgcatatctaattgcctcctttggagaggcttatcagaaactcaaaagaatgcaaccatttgtctctcacccacctgtgacctggaagccccctccctgcttgagttgtcccaccttaccagactgaaccaatgttcgtcttacatatgttgattgatgtctcatgtctccctcaaacgtgtaaaaccaaactatgctctgaccacctcggcacatgtcaccaggaccttctgaggctgtgtcatggacgcgagtcctcaaacttcgcaaaataaactctctaaatgaactgagacc

SEQ ID NO: 225900 - DNA, 347 bp, Homo sapiens
tggctgacatggtcctctcacttttttaagacttggcctggactcagcttagatgtgtcttgggtcaggacggggagggcatgccaagcatgggaaatggtgtgagccaagggctgggtagaggaatgactctggtgtttccagggaaaagtaacggatccagttggccaacaccacaaggttcgtgcaaaaggcgaagtgatcaggaatcagtcaagtgagtctttgatccctgggacaattaggtagtgtattatctattgcttatctattatctattgctgcattacagattgcagcaataaaataagcatgtgttatttcacaaagtttctgaaggtcaaaaa

SEQ ID NO: 225901 - DNA, 535 bp, Homo sapiens
gtaaacatagttttgcaaacctacattataaagatgtttcaacctcatacattggcctttaccatcacgttgaatacagaaatactgttctctctggaatttattgtgagtcctgggttcatttacattttatcagtgacccaacatgaaacataacatttactttttgtttagtactttcctgaagcagacaggagaaagtcattgaaattgcttcaaattacctgagaaattgccataatttgcaacttcacaatgcaagcctggatttcccaagttagctctgatctcaatgatgagtttaaatgccaggatgatattttaactatgcagagtcataggcatacatgaaactccattagtttagaatctaatgaagacttatgttgacatatcattctatgtatttcagcatattatctactaagacattataagaacaaaaccccccaaaattccattcttttttgaggtagggtggctttttctcttttaatatttttttacatttgagttcttcatgtttcctgaaggt

SEQ ID NO: 225902 - DNA, 551 bp, Homo sapiens
gacatacttgcctttttcttgatgtttgggagaaagcattcagtgtagatcgttaaatataatacctgtagacttttatgtacatgttctttagaaagtttcccttctgagttgctgagggcttttattgtgaatgggcatgtaatttgccaaatgcttttcccccttcaattgatatgatcatgtaatttttcttctttagcctgttatgatggatggctttaactgattttagaatgttttgttgtttttttgagaccaagtctcactctttcgccaaggctggagtgcagcagtggagcaatctcagctcactgcaacctccgcctcccaggttcaagcaattctcttgcctcagcctcccaagtagctgggactacaggcgtgcaccaccatgcccagctaatttttgtatttttagtagagatggggtttcaccatgttggccaggctagtctcgaactcccaacctcaagggatccgcccacctcggcctcccaaagtactggaattacaggcatgagctaccatgcctggccgctttttgaatg

SEQ ID NO: 225903 - DNA, 468 bp, Homo sapiens
agcccaaggttaaggcaccagcagatttggtgtctgatgaccactggccttctggttcatagatagcaccttcttaactgtgttctcacatggtagaaggggcaaggcagccctctgaggcctcttttataagggcaccagtcctattcatgagctctctgctctcatgacctaatcatctcccaaagaccccacctcctactgtcaccatactagtgactgggtttcagcatatgaatttggggggaacacaaacattcagaccatagcaggcctcacccttatggtctcattgaaacctaattacctccttaaagactatgtccaaatgtagtgtcactggcggttaggagttcagcataggaattgggatgagtggtggtagggagatcaattgagtccctaacagagatcttacacagggaaagttgtttggcattggaagcctgtagtaccagcaatatgcca

SEQ ID NO: 225904 - DNA, 514 bp, Homo sapiens
attttctcccactaaataatttatgcattcagaggttgggtgtgcttatgtttccagagagacaacagctattgaatagcataaataagataaaatagtcatgctagtgtagaaattaaatgttcacaaatgtgttatcgagtctatccatagaataaaagtgtagcttataaaacaattattgctttggatttcatgttttaaatttacaagactgtgttacattttgttgtaattagtaatgcttcatagctacaaggattaccagatccatatcactgcatttttccatagcacaaaacacatttatccaaagtaaaaatagtgtgctaaacatactgaagtttctgacagacacttatatttctcttcattctttcattcacagcagagtttcatccatattaaataaattggttaagttttgatacctcctactttaatcactcatcttatgtactaaaatgaaccaaattaagtttgagccaacaaataaaagtgatatgctttgagt

SEQ ID NO: 225905 - DNA, 476 bp, Homo sapiens
gaagatgactggagtcacatcagatcatcttttgtgatgattcctcatcacttccagaagcagctgaggagcttcttctgagtgcttggggatcatatagggagtttttgctttcattttttgttttttctatttaaagacgggtctcactgtcttgcccaggctggtctcaaactcctggcctcaagcagtcctcctgtctcagcctcccagcactttgggaggccgaggcgggtggatcatgaggtcaggagatcgagagcatcctggctaacacggtgaaaccccgtctctactaaaaataccaaaaaaaaaaaaaccaaaaaattagccaggcgtggtggcgggcgcctgtagtcccagctactcaggaggctgaggcaggagaacggtgtgaacccgggaagcggaggttgcagtgagctgagaccacgccactgccctccagcctgggtgacagagcaagattccatctc

SEQ ID NO: 225906 - DNA, 412 bp, Homo sapiens
atcaagcactctctcacaccacagcgaaataaaactggaaatcaactccaaaaggagccttgaaaaccatgcaaatacgtggaaattaaataacttactcctgaatgatcattgggtcagaaatgaaatcaagatggaaattaaaaaattcttcttactgaacgacgatagtgacacacctttcaaaacctctgggatagcaaaggcagtgctaagaggaaagttaataacctaacttttaacttaaaagtcaacttaaaagttaaaagttgatgcctacatcaaagactgtgaaagagcacagaccatttaagggcacctcaagaaacgagaaaaagaagaacaaaccaaacccaaactcggcagaagaaaggaaataaccaagatcagagcagaactaagtgaaattgga

SEQ ID NO: 225907 - DNA, 3635 bp, Homo sapiens
  misc_feature (921)..(921): n is a, c, g, or t
tttgcgcccccgctggcgctccctggttctgtgaggaacctcgcggcggcgtcgcaggcgtagagccagtcagtttgtgcttggtcgccagaggaggcggtggctgaggagagttgagtccactgctgaccctgttttacggtaggaggcacggctagctctaaatgggcaatttacttagtaaatttagacccgggtgccgccgccggcccctgccagggccagggcgtggcgcccccgctcccctgtcccgggacgcctccccgcccggtcgggctcactctgtacccaccccgcgccctttccgcggcctgttccgccggaacgcccgtcgcaggccttcagcagccagcatcttcgtcgcccctaagaggccgtgtcctctccctcgggctgcggccgcccctctgggggtcctgccggctgtgggttgggggctggccatcaggaagacacccatgctgcctgctcggaaccccccgaggtttggacaccccagttccgtaaggatccctcctcccagccgcatgttcactctcctgctgccttcaccacgtgagccggcggtcaaggccaggaagcccatcccagccactctcctggaggagaccgaggtgtgggcccaagaagggcccagaagagtgaagaaggatgaggatccggtgcagatcgaaggggaggatgacgagaaaaggaccccccttagcagcggagaagcatcgtccacatccaggtcccagggcacccagggagacgtggcctccttcagatgcagccctgggcctctggagggaaatgtctaccacaagttctcagaaaacagcatgagtgagaaggcccaggcgtctccagcgagctcctgcttggaaggccctgccatgcccagcacacacagccaggccggatgtgcccggcatcttngaaagcctgatccggatgcaacagcgccccctgagccagccgttggctgctccctgctgcagcagaagttggctgcggaagtgctgaatgaagagccaccgcccagctccctaggcttgccgattccgctgatgtccggaaagaggatgcctgatgagaagcctttctgtattcctccaaggagcgctgctcctcccagagctgcccgcaacaggccctgcaaaaggaaaatgtcgattccattgctgctgccgctgcccccttcactgccattgctgtgggatcgaggtgagcttcccccacctgctaagctcccctgcctgtctgttgagggagacctacacaccttggagaagagccctgagtataaaaggaatagcagaatcttggaggataaaacagagaccatgacaaacagcagcatcacccagcctgccccttctttctcccaacctgtgcagaccacagactccctgcccctgaccacttacacttcccaggtctcagctcctttgcccatccctgacttggctgacctggctactggacccctcatcctgcctatccctccactttccaccacaccaaaaatggatgagaaaatagcattcacaatccctaactctcctctggctcttcctgctgaccttgttcccattttgggtgatcagtctaatgagaaaggaggctcttataattcagtcgtaggagcagcgcctctcacttctgaccccccaacacctcctagctccacaccctccttcaagcctcccgtcacaagggagtccccaatatctatgtgtgtggattcccctcctcctctttccttcctgactcttcttccagtcccttccaccgggacctcagttatcaccagcaagcctatgaattccacgtcagtcatttccactgtcacaacaaacgcatctgcccacctaacctcacagactgcggtagaccctgaagtagttaatatggatactactgccccatctcaggttgttattttcacatcttccctaagctccagagtgagctctctcccaaattcccaaatacattgcagtgcagagcagaggcacccgggaaagacatcagtctacacatccccacttccatttatattccacaataccaccccaagttttaaccaactctttggaaaagaagccacccctcagcccaaatttgaggctcctgatgggcagccgcagaaagcttctctccccagtgcctgtgttttcctgagccttcccatcattcctcctccagacacctccactttagtgaacagtgcctctacagcatcatcatccaaacctcccattgaaaccaatgctatgcataccactcctccttccaaggctgtcatcttgcagtctgcctctgtctccaagaagtacctcccattttacctggggcttcctggttctgggaacacacaacccagcggcaacactgcctcagtccaaggctccaccagtttgcctgcacagtcagtcagggcaccagctacagcttccaaccatcctttaaatccaggagccacccctcaacccaaatttggggcccctgatgggccgcagcagaaaacctctctccccagtgcccatgatttcctgagccttcctatcatggttcctccagacacctccactttagtgagcagtgcctctgcagcatcgttatccaagcctgccattgacaccagtgacatgaataccacccctccttccaaaactgtcatcttgcagtctacctttgtctccaggaaggaggagtacatccgattttatatggggcttcctggttctgggaacacactacacagtgacagcattgcctcagcccaagtctccaccagttttcctgcacaggcagataggagaccaaccacaacttccagccatcctttaaatacaggatccatctctcattccacacttggggccactgatgggcagcagaagtctgacagttcttttattctggggaatccagcaaccccagcaccagttataggcttaacatctccttcagtccagccactgagtggcagcataattccaccaggttttgcagagttaacatcaccatatactgcattgggcacacctgttaatgctgagccagtcgagggtcacaatgcaagtgctttccccaatggcacagcaaagacttctggatttagaattgccactgggatgcctggcactggagacagtaccttactggttggaaatactattccaggcccacaagtgattatgggacctggaacccctatggatggtgggagcattgggttcagcatgtctgccccaggccccagttccacatcaggagaactcaacattggacaaggacagagtgggacacccagcaccacttctgttttcccatttggtcaggcagcctgggacccaactggccacagcatggctgctgcaccacaaggggctagcaacattcctgtatttggatatacttctgctgccgcctacattcctggtttagacccacctacccagaattcatgcagtggtatgggaggggatggcaccagatccatagttggaggcccttgtgttcctgcttttcaacagtgcatcctgcagcacacatggacagagagaaaattctacacttcaagcacccactactatggacaagaaacatatgttaggagacatgtctgtttccaacttccgtaa

SEQ ID NO: 225908 - DNA, 391 bp, Homo sapiens
cagagcctccaaaaggatataattcaaaaaggattttaaccaaaatgaaatatgttgtgactaatatatacagtttatttgaatgaatgatagtttttcccatttgatattttaactgtgctacacaagaatgagagtagacatagctcgatttgtagtctcattgttctgtcttttctgcccatttcagtgacccaggactctttgtttattgctgtgatttttcttccacagctatagaactggtccaggtgagtacgatgggaaattacctattggtaatttccactgattaaagggaaaaggttctcctaaaaatcaaggtctctggctgtgttcttatacggtctgtgttcttacggtctaaaagtaaaagatttactgataacga

SEQ ID NO: 225909 - DNA, 452 bp, Homo sapiens
ggcatcccccatcagaacaccctgaaagcacagggtatgctccctcactaatcctcatagattaccttttagtaacaatgtcatgtaatgatatttaacagttggtggctgcaataattcacagggcaagagttcaagaccagcctaggcaacatagtgagaccccatctctagaaaatataaaaaaaatcaacctatggtgacccacgcctgtggtcctcgctactcaggaggctgaggttggaaggttccaggctacctgagcctggaaggttgaggctacagtgagccatgatagtgtcactatactccagcctgggcaacagagtgaggtctgtcgggggtagggggggcagcgggtggaacccaaaccaaaaaaaaagaaatataaaggactatgaaggaatacaattaaaaaaattgtttgccaaataactagataaactacatta

SEQ ID NO: 225910 - DNA, 419 bp, Homo sapiens
tggggcctaatgagaagaggctgtgcaaggtcacacagcaaggagcaaagcgataatgagaacccaagctccccagcgtcccattctctgctgctttctaccctacctccctagttccaagaatggtcattgattttatagagggaatactgtttcaaccagaacctgggagggtttccactggctacaagcaatagttaggacatagacaaaattctgcaggagagcaagaatcttacagctacatttggagaggtttgccctgtggtggttacttaggacacaaacacacatgagggaaaatacatcaggtgacatgtttggattgaatagcattctttcattttcttgaaggaaaatgtagctatttgagccttgaaatgctagttcttgcattttgcagtgttgtttccagtagc

SEQ ID NO: 225911 - DNA, 176 bp, Homo sapiens
tgtctaagaagcttagtctagggcttctgcctgtggaagtgtccatggaaaaccacccaacagctagctatactaagtgagatttttcagctcatatagggccagctgagtcatgacatcatctcggatgagtttcctttggtcaatgaaagcgttagctaacacattaatttctg

SEQ ID NO: 225912 - DNA, 223 bp, Homo sapiens
cacacatgcacatacatacacacatgctcacacacgtacaccccacacacgtccacacacactcatatgcatgcacgtgtccacacacatcttcacatactcacatgtgtgcacacacatgcacacacaccctcacacattcacacacatcccacatccacacacatgtacacctatttacacagctcacatatccacacacgtacacatatgtacacacaca

SEQ ID NO: 225913 - DNA, 451 bp, Homo sapiens
ggacaaattatattccacttggctacagacctgcagtcgtctaatttggcttccctgcatagttccttattctatttcatttttgcaaagaatttgtagtgtattcaatagattgttccaccagatttagaaaacattactccagttatatgtaaagcaagaaatgtctgctatgttaatttacttatttgtttgttcttactgtctatataggatgagttcaacaatgacttaatagcatcagaattttgacaaagcgggaaaaaggcaattaaaatagtagctagaactttgtcagctaatcacctaatgttacctcaagtatctgtcaacagtgtgatggattttaagacattaaaaactgggcaactcaggaataagctgaaataaattataaggttttatcaaaaacctattatttagctatgaagactttttgttgttaattata

SEQ ID NO: 225914 - DNA, 300 bp, Homo sapiens
tacacataacactactgtactgcacacttacaaatggttaagatggtaagttttatgttttttaccacaataattaaaaaaaagacactgccacacaggagctccagcagccctaagccttcagcggaggttacttcagaggattgccccccttcctgagcttcatttgatacattatgcagccttcaggacaattagataagaggtgctgagtttcttaaaggagcaatcagtaggagccaggcagctcattatcataaggttggcattatcatcagttcactctctagttatcaggtt

SEQ ID NO: 225915 - DNA, 447 bp, Homo sapiens
ctcctgatccacccgcctctgcctcccaaagtcctgggattacaggcgtgagccaccgtacccagctacaggtagtcatttctacataaaatccgaaccccggctggcccacttcagacctcctcacctcgcggacccatggacaaacagaaccacatgagtggacttgggctggtgctgggattttcctggggtgctttcagcagccttccagagaccagcatgcctttctggtttctggaacgctcagtgagctttggctggggagcacaaggctgatcagttaagttcaagattatctggagatggacaggtacttttgctttatacacaccttgaaaccttgaacgaaagcatgcagtttgggtttaccatccccgtccctgctgtgtattttttttttttttttttgtcgacgcggccgcgaatttagtagtagtagtaggc

SEQ ID NO: 225916 - DNA, 473 bp, Homo sapiens
caagttcatccatattcacagccatcctaactgcctttcctcctgtctgcaggaagaaaatttgtctctctcttatttgttcaaagctatttgctcaaaccaccccatattactgtcctctcttattctttatagataacagaagaggctacattcactctattttcttgacttcatttgctaaactgtaatacttggctttcacgtcctacctttttacaatgccctaaaatgttgctattttatcatcttgagtacctggctcccatttattctctctgaatgctatctcctctgggtgatttatggcttcaaccactatatatgtgcttatcctcctcatatttctaaccctgataactttcctcacggtttcacttaaacaacaggcacttaaaattaacacttaaaaccaaaatcataagcctcccacagaaaaccaccttttccatttaaattaatgaaaccttgac

SEQ ID NO: 225917 - DNA, 668 bp, Homo sapiens
taaaatttaccttttaaagtaggccatttacagatttttagtctattcattaaattgtgcagccgttatctaattctataacattttcacttccccagaaagaaactccatatttatttcccagttattctccattccccttccccctgcgttggcaacaactaatttacattctaagtctctatgaatctgcttattctgaacatttcatgtaaatggaatatacagtatgtggctttgtctggtttccttagaacaatgttttcaaggttcatccatgttatggcacgtattagtacttaattcctttatattgttgaatagttgtgtcaatatgccacattttatccatttatccattgttccttaaaatttttctatttctggccaggcgtggtggctcatgcctgtaatcccagcactttgggaggatgaggtgggcggatcacgaggtcaatagttcgagaccagcctggccaatagggtgaaaccccgtctctactaaaaatacaaaaattgcctggcatggtggtgtgctcctgcagttccagctactcgggaggctgaggcagaagaattgcttgaacctgggagacggaggttgtggtgagccgagatcatgccgctgcactccagcctgggtgacagagcgacactccgtctcaatt

SEQ ID NO: 225918 - DNA, 148 bp, Homo sapiens
gcttttgtctgtgtgttctaattaatcttccaaataaacatgtgagataggctaaggagactaagaacagagagtctgtgtcattctatttatttatttattttttatcatactttaagttctagggtacatgtgcacaatgtgcagg

SEQ ID NO: 225919 - DNA, 545 bp, Homo sapiens
ttttttttcacaagttggggaaataaccaaatgactttgcagatcagatagccaaacaaactgctgtttcttctgaaatgtctttcacttaactccttgccttccttcccctactgtagtccccatcttctcttccactgaaaaagaaaacctaataaaaataggagctaaagagaacacaaaaggaaaatggatattaccagatcaaagggagatattatccaaacctctcataagggaggtcttaactacggttctcagagtttataagtgtattggaatttataccctagtcaaacaggtcacagacaattgtctaacatgcaggaaaactaataaacaagccctaagaaaatcaccccttggaggatgagatctggagctaagaccattccaaagtgttcaagttgattacaccgaagtgcctccaatcggtcgcctgaagtatttattagtaatagtagatcatctcactcactggatcgaagctatctcctttccaaatggaacagctaataatgtaattaaagcattaattgagaata

SEQ ID NO: 225920 - DNA, 449 bp, Homo sapiens
acatttctctaaagaagatatgcaaatgaccagtaagcacaggataaggtgctcagcatcactaatcatgagaaaaaagtaaatccaaaccacaatgcaataccaactgacacatgtaagcatagctgccatcaaaaaaaccccaccagcaaagcaaaacaacaaagccccagagaacagcaaatgctggatgtggagaagtcaggactcctgcacactgctggtgggaaagtaagatggcacagccactgtggaaaacagtaatcaccatatgatccagtaatcccacatctgggtatataccccaaaaaactgaaagtgggaatttgtacacccatgtttatagcagcattcacaagagccaaagggtagaaaaagcccaaatctccatctacagatgaatggataagcaaatatgattgatacacacaatattattcagccttaaa

SEQ ID NO: 225921 - DNA, 205 bp, Homo sapiens
actgctactagtatctattttctattagtttcattattggaactgcagaatacaaaatttaaaagcagtttctaaggatctactaaatattgaactctgagtttaaaaatgcactttacctctctttagcctacttttatatttagtaaaataaagggagactgaagaggcagaactaggtcccttctgactctatgggtcagtc

SEQ ID NO: 225922 - DNA, 458 bp, Homo sapiens
ggcaggctcattacagaggcattttcagcacttagagaaaggagttctctgtttgcacacacacgtgcatactttatctctctctcttccagtttttgctttgtccccaaaattctgatactctccttcagagaaggagctgaagtaaacaaatcaacaatcaaggcattttctgaacagaatggatgcattattctttgggtgagcagaacccagattctggtttctgttcttaactcagcttcttctcccttggagagggggagtaatggagaaaaacagaaacaagtgatattactaataacaaccctgccagctctcttttgattactgatcaaccgggtgacaatcccacagggcagagagttatctcggcagcctgtgatacattcagtttaagctgatggcggcgtatggcagcacagctccagcagaaaagcactgtcccctgtctgagg

SEQ ID NO: 225923 - DNA, 439 bp, Homo sapiens
atgagtgaacttaaagacaagtcaaaagaaactatgccaactgaagaacagagagaaaaaaagtaaaagaataaaacaaagccagagcctcagtgacttaaggaacagtatcaggcagtctcacataggtgtaattagagtctcagaaggagagcaaagaggaaatttggcagggagaaggaggaagctatgaagaaataatggacacagtttatccaaatttgatgaaaaacaacaagcctcatatccaagggtcatttcatagtaatatgttgtttgattgatcaaaaagatataacacctctaaatgtatgtgcatctaatgattccagatccatgaagcagcaatatatagaactaaagaaagcgacaaatccaaatccacagcagtgtagatcttaatatcaggttcttagtaactgatagaacatatagatta

SEQ ID NO: 225924 - DNA, 280 bp, Homo sapiens
gctgctaaatacatttttggagattcactattctgtttagaaacgttcctgctgacaccagtgttctgaggggccttatcttccacccccaaggagtttatatgcatcctaagagaaattcacacatgggctataaagctaaaattttcacattattttgtacaaagtcaaaatgacttgaatactaaccacagaatattaagtggcttccactagatcagcattcccaatgtgtatcctgtgccccaatcctgtgagtaaatttgtagaccaaaaaaat

SEQ ID NO: 225925 - DNA, 178 bp, Homo sapiens
gggatattaacgatgaactgttcaaattttattcaattactgaagaattagcagcacctttattgtaatggaatcctctaaatctacaggagatatagccgtgtatatatgtattttaaatggtaacacttttacctccatgctgctattatatacaattagttacaacatattcaaa

SEQ ID NO: 225926 - DNA, 471 bp, Homo sapiens
gcttatctgcacattcgccctttgagcagcaaggcttagaacagagaagacagtcatttccttagaaaggtgtgtgctcccaaggtaacgacacagactctttaacagcaaaagcacagggctggctgatgttcttggtgacttcagttccatgctgtttgccttctgctctttcttacacacttttgcattatagtctaatctaatctgagagctttgttggctccaggtagtcctccccagaccagcttgagactggagaggtcctaatccctgaaaagatcatagtgccctctctctcccctcttcctatccccaatatgtacttcaaaataaaattaagactaagtaaaaaataggtaagaaagtctaacaaatctttggggtttttttttttttcatgacatttaggcttaaaaacaaataacattaaaattttctctcttgccctacatttccccaaccctcacc

SEQ ID NO: 225927 - DNA, 92 bp, Homo sapiens
ccctcccaaaactgaacctggaagaaattgaacccttcaacagacagtaatgagctctaaaatggaagcagtaataaatagcctactaatca

SEQ ID NO: 225928 - DNA, 146 bp, Homo sapiens
gcctcccaccatcaaaggccacctgcttggcggctggacttctctgggtgatgaaaatatgactgtttattattatatcctttttttttttttgcattttagatattgttcttaaaaaaaaaaggaataaaagaatcagtgagaca

SEQ ID NO: 225929 - DNA, 393 bp, Homo sapiens
cccggtggtggtgtcaaaagcatagaagatctcctcttggtgggtgttcagtgaatgtaaggcatagagcaccccacaggccatgaaggcccctgacagggctggcttgtactggctggtacgccaggttttctccacttctagggtgctagcgttgagacgactcacaaccaggttgcccttgctctcctcagtggcatagagaacccacagccccttctcatcaccagcaaaatctaagtccttccagggcacaccagcataggaaaagcggttgttataggtggcaccaggcagcagacgccacagcaccagtgtgttggaggaaaggtccattttggccatgtcacttgtgccacagtagttaaagtacataaagttcttgtacacaac

SEQ ID NO: 225930 - DNA, 436 bp, Homo sapiens
gcccaggctggagtacaatggcacgatctctgctcactgcaacctccacttcccgggttcaagcaattcttctgcctcagcctcccaagtagctgggattacaggcgcccaccaccacacctggctaatttttgtattttcagtagaggcggggtttcaccatgttggtcaggctggtctcgaactcctggtgatccgcccacctcggcctcccaaagtgctgggattacaggcatgagtcactgcgcctggccgtcactccactttttaaatagcctaagtagaaagaaaataacataaaccttaggaggttttcccattaccttcaggattaagattagcatcttaagcagtataatgatgttcagggtccatcacgtttaccccagttttaatttccagactcaccttccaaagccccttctgtagtcttctc

SEQ ID NO: 225931 - DNA, 937 bp, Homo sapiens
caaaactggagcaaacaggaagagctcaatggttttatgatctgctgagaaaattgaattaataactttaaagccttcccacagagaaagcttcagggcgagtgcctttactagtgaattctttccaattttaacggaagaaaatgacgccaacgttagacatatcttccaaatactagaagaaaggaacagtctccagcctatctaagctggcatggtcttgatcccagagcctgacgtggcatttcaagaaaggaaattatcactcagcagagatgtgcaactattaaagtaaataccagcaaattgaatccagtgagacagaggaagaaccgtgttgcatggtccgcaggctcattccaagaactcaaggttaagtgagtgtttggaatcaatgtgtagaatttaccacattagccgaataaaggagagaacccgctatatcacctcaataaatgcaggaaacacttttgataaaattcagtagccttcgtgataagaatcggcaaattggagtataaagaaatgttctaaatctgacaaaaagtatctacaaaaaaaaagttaaccttttggttaattgtgaaatcatgatgacttagcctctgagcacgggaacgatacacagacgcccatcgtcaccacttatattcagagttggctggagatcctgcccgggttgtgtgtgcagggctgcccctgagagctcttgccttcctaatgtttgtgtcatgtcaggaacctcccttgcccccctcctccctgagtcctaccccttgtcccaagctgtgcaatacagtgataaatgaaaggggccaggcactgtggctcatgcctgtgatctcagcactttgggaggctgaggtgggtgggtcacttgagctcaggagctcaagaccagcctgggcaacatggcaagaccctgtctttactaaag

SEQ ID NO: 225932 - DNA, 652 bp, Homo sapiens
gagggacaaacatctgacttggacagctgaccagtgactgatcagattctctctctcttgagagcatgaattaagagacatggagactgcagtcacttgggagtagacacctgaaactaaaaagtcaaacttcattatgcagctagtttgacttggtttctcttcctgttcaaaggaagaatgggtagaataaagatttgatgtggtctggccccttgtctatgatctttttagcttgatttcttgaaatgctgcttcttccctacccactgtaactggcattcccatagtactgaggtactagagacctctgagatctgcacacatggttccctccacccagaaaactgcccttttctttctctcatcctacatagctgcctggcaaatccctagtcttcatcagctcacatcacatttccatgacaatcccctttgattcctcagaatctggccttcctttatagcactggtcatattgtattgtgcatatctggttatttgcctgttttccatgaacatttcaagcttatgggggagaagacactgtatacattttcatctgcattccttagaatctgcataacagctggtatagagaaggtactcaaaaaatccttaatgaataaagtaatggatcgtacccaaacat

SEQ ID NO: 225933 - DNA, 450 bp, Homo sapiens
ttgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgtt

SEQ ID NO: 225934 - DNA, 696 bp, Homo sapiens
tgaggtcactaatattatacaaaagaaaaggaagcaaagatggtcatgagagagcaacgttttgaaaaagaaaagtggtaggaagcatagagaggaggataaagaagattaggtttctttctgcttatttgttaaacctgttcaagctgcagtaagattgtcatgatctccgtcgtcatctgatttatcccccagccagtttctctgtaaaatctggaaagatagtagttgctgaggggcctcattagaggattggtgtgagagtggagatgtgtctgttgcaggactcctgggacctgtccagacagcagtggtggagggaagcgaagtgaagtgcagttctgtctaaactagagaaccctggagcaaggaagactgtgaggcaccacccgtggggggtgcagggcagctgccacagacgttgtttggcttcatgaagctgagttgaagatacgcaccctctgtggcccagcattttcacttcgacctgaatacagcgctctcagcagcactgttcataacaacaacaagactggatatgacccaaatgctcattgaaagaagagtgaataaaccaggcaggtgcggtggtcacgcctgtaatctcagaactttaggaggccgaggcgggtgaattgtttgagcccaggagttcgagagcagcctgggcaacatggcgaaaccctgcctctgcaa

SEQ ID NO: 225935 - DNA, 436 bp, Homo sapiens
cagtaggtattttataaatgccccccatttcctttttttctatcacatagcttctaaacatttctaggagaatgagtctctacacaggtgggatcattctctttttttgtttacagatatatgtcaaatgcctagaacactgtctgggcatagttagtattcaataaatattattgactaaataaaggaaatgtcatgtttttggaataaaattgatgtatgttaatgtttttaagtatctaaagtagaaaaatccaattttaatttctgtaaatttgtacaattttatattactttccctttttacccccaagttcatataacaaatgatagatgccttcattatataaagaaagctaaggctcatttacttcaaaaatatttactgagatccttttgtgtgccaagcactgtgataactaataggtgtaatagt

SEQ ID NO: 225936 - DNA, 1160 bp, Homo sapiens
tgaatatatataaatgatactatatgacctagtatccgcttttatattttctttactatgttcataaaattatttgcatggtattgatgaatcatcctaatagctggatcattgaagaatcactttatattttggtgctctggataattggaactttatttttttatgtcagaagctgatattcacttccattgagaaatattaccataactgtaatgttgtctctggagccagccagtaaagcagcatttacaagttcatggctaacatactcagctgcgccttcatagaaactcttagtgtctgattctttttcatttgttgccacatcatttacactagttggtctgtcagttactttttcactgcaaggtttacgatgagtcgtttctgctggaaatgtttctacattctcagggttataaatacagtatttagaatagtttgaatcggataaattttctttggaatttgtagttgacacacgtacttcagatacagatttatactgaaacaatacgtgtatattactctgtgatttagtaaggtttggttcactggttgaaaaaagcagaggccctttggatggtgatttgttaggtatgataggacagtatgtttctttatacatgtgaaatgttgtcattgccagggcagtaacttcctctttatccaaaacttcccaaagtccattagtagctacaataaggaattgacataggtcatctatagggacagaaatagtttgaggtgctgggataatggattttttcagcttgagatttccatgaaatccaagtcctcgtgtagtttttacttgcccctctacaagcccgtatggttcatttgaactaatgactgctccattctgaagtattcttcttctttcatttgtgtttcgtgtagtatgttctttggttaggcaaaaacctttcccatttctgcataagactgcttgcacattacctaaaagattattttttaaaagaagaaatttttatcctagagataaccaattgtatcaaaatctactgctaactttagtaaattctgtgtttcaatgctaaacagaaagcaggctatgtaaaagtacgtttaaatatgtgtaatatatcactactgaatgatgtacagtaaatacagatttcaaacaggtcaat

SEQ ID NO: 225937 - DNA, 417 bp, Homo sapiens
gaagggagaatgagataaaggagttccttacacccagggggaagtcacatttgtgtgtgcgtgttttcatttttataactttttcatcatgaaaggggatgtatgtcaatcgtagaaaaataggaaaatgtagaaagcattgaaaaagtcctatactacctactagtgtttttatttatttctctttattttaatgcatgtatatttgttatatatctttcataagttagaattatgttgtatataaaagcactttccccatggcatttaacattctttaaagacctagtttctaatgtgtagtattatgttctatggactaattctaagttgtgttagcattctctatttttgtaaatgtagcttgtttatgattttttactattaaaaacaatgcttttgtggacatctttgttg

SEQ ID NO: 225938 - DNA, 322 bp, Homo sapiens
gtatgtatacctaataaaattagcgctttctaaaaatgcagtgcttgtcatttactattaagtcaagccatatgaaatcacattttgtcagtaaataaatgttcagatatccacaatcttatacagttctaatagatactcaagaaattttgtcgacatgaagagagtcaaatcataaaatggtagactgaaaaagaacttcgtggagaattcttttctttttgcaaacagaggtgactgggaggtcgaggctgcagtaagtcatggtcatgccactgcactcgagcctggacaccagagtgagaccctgcttcaaaaaaaa

SEQ ID NO: 225939 - DNA, 1160 bp, Homo sapiens
aaactgctgttgtgtttaaaacaattattgcattctgcaaaattcttagtcgtattggacaatatttcagtcttacttttctgctcctctcttatcacaccctcaattctaggtgtgctgacaaggcactgagcaagggaatgggaaaatactggaaatgtagcaagaaatgcaaggagctgttctgatctcctaatttctgtgcacctgcatttgataggataactctctctggctctgaaatcaatcgtcttctgtctcatccccttcagccattgtgacctcaccatatgcccctgactggagagaagcccaggttggctgcctacaatcagagtccacatatgttcgggggagggaccccagaaggcggctgacagtattcctttagccagaaatcccttcagggaagagaaaggtgctcccctttgcctgcttttatactacagactgtttccaactccagctagaagtgactattgccgattatgctaatcagtggcgacaagctccctttgactgctcacttctccagtgaggcttcaagcttctaggcatcaagattagtaaggctgtcttctgggtgggccagtttgtttctcagtgacacgaaaacattgcctggggtgtgcactggtattttccagaaaatatttcaagcagaatatacttattttccagttttgaaaacaactagattgcccatctccatttctctctatcatctactgtattattctatggacaactgccaccctaataaggtcaagaagggaagccagaagtcaaggccacagaagacacaggaaacatcatttccaaagtgggagacaaagctgttaacaggaaattatttgtaaagtcaagagccaagcaaaacagaaaaaggacaagaaatctatcacctgtgggtatgaatggttctagggaagtctgttgacaattggagggtctcaaaggcgctttatggtacttattttatgaccctgagtctggagtctgatgaattaaagaggaaattctgctctgggcaacatttaagagatagtatctccaggcagtaactttcgtattaactctcataagattgatgccattctgtcatctaaagtgtggacaaaagtagcattaaagcaaaatgaaaggatataaaaatcttt

SEQ ID NO: 225940 - DNA, 748 bp, Homo sapiens
aaactgctgttgtgtttaaaacaattattgcattctgcaaaattcttagtcgtattggacaatatttcagtcttacttttctgctcctctcttatcacaccctcaattctaggtgtgctgacaaggcactgagcaagggaatgggaaaatactggaaatgtagcaagaaatgcaaggagctgttctgatctcctaatttctgtgcacctgcatttgataggataactctctctggctctgaaatcaatcgtcttctgtctcatccccttcagccattgtgacctcaccatatgcccctgactggagagaagcccaggttggctgcctacaatcagagtccacatatgttcgggggagggaccccagaaggcggctgacagtattcctttagccagaaatcccttcagggaagagaaaggtgctcccctttgcctgcttttatactacagactgtttccaactccagctagaagtgactattgccgattatgctaatcagtggcgacaagctccctttgactgctcacttctccagtgaggcttcaagcttctaggcatcaagattagtaaggctgtcttctgggtgggccagtttgtttctcagtgacacgaaaacattgcctggggtgtgcactgggtgaggcttgtcagtcaagatatgattttgcacttctgatggattttccaactattcactacaagttaaagatactagaaatatatacttccctatatctcttctcctaac

SEQ ID NO: 225941 - DNA, 483 bp, Homo sapiens
gatctcctgacctcgtgatccgcccgcctcggcctcccaaagtgctgggattacaggcgtgagccaccgcgcccggcccctcataaggtcaagaagggaagccagaagtcaaggccacagaagacacaggaaacatcatttccaaagtgggagacaaagctgttaacaggaaattatttgtaaagtcaagagccaagcaaaacagaaaaaggacaagaaatctatcacctgtgggtatgaatggttctagggaagtctgttgacaattggagggtctcaaaggcgctttatggtacttattttatgaccctgagtctggagtctgatgaattaaagaggaaattctgctctgggcaacatttaagagatagtatctccaggcagtaactttcgtattaactctcataagattgatgccattctgtcatctaaagtgtggacaaaagtagcattaaagcaaaatgaaaggatataaaaatcttt

SEQ ID NO: 225942 - DNA, 83 bp, Homo sapiens
gacagtccccacccttgggaagtcatgtagaaagacatgacatgcacataaaaaataaatcaaaataaaaacatgacatcacg

SEQ ID NO: 225943 - DNA, 373 bp, Homo sapiens
ctgtatgccttgaggtatagagtaagcaagattttgatttttgctaaggataaatattcatcggtgggcgcagactaggcctatctagggatgtcaggcttggatagcagctaaacttctgccttcaaggattcacattatcatacaaatgtttgcagtgagaaagggtctgatagagagaatataatattacaggaacagatatttcatttggggccagggccaaccattcaagaatctcaaacaatattctgtacctctcacggggttagctagtccaagatttgggatcctaatcacctttctttctttttttgtagagacagggttgccattgtattccagccttggcgacagagcaagactctgcctc

SEQ ID NO: 225944 - DNA, 557 bp, Homo sapiens
ttcaacgaacagttcgcatcatcatcagtattaacttctggttaactaaacatctggaccagagtccatgatttctggtttagtgctgcagaagtttctgttaatttgatgaacctgacttcaaaccacagaatattagaactaggagcacacgataccatagctacctttctgtttctacagacaagagatctggagcttacataagaaagcgaattgttcaaggtcatagatggaataggaaaagagctcagacttcagcccagttctgggctctcagtccagtatgccttccaccatcccatggagacagagactcacagatcttggaaccgcaaagactgtgagagatcatctagctcattccatcgcccatggtggaaggaagtcacaatgcagagaaagaaaatggcatggcatggttacataggggctggaagtcatttcagtgtatacatatcttaacacaccatactgtacaccatgaatatacccaatttttatatgtcaattatgctttaaagctggaagaaaggagaaaaaatatatatatgata

SEQ ID NO: 225945 - DNA, 400 bp, Homo sapiens
ccttgtattgtagaacaaagcaccaaagttaatgatttctaaggtccgtctggtgctaaaattttaagattctagcaacaatttagagtatgcaagggactagtgttaggtttacagatttctcatgagtagcctattctcatcaaaaaacatgcataaacaagattagtctgtgctcaaaacaagttaaaaagacatggcactctcgtgtattgtcatgggaaattagtaatagagagcaatgtagccccatctatataagttttaaacgtatagcacccttggctattctgtttttaaatgtttcagtccacatatatatctgattctgagaaagcacaaagcagctcctgccccctaagaagctaaggactcctggcctagccagtccactttctgt

SEQ ID NO: 225946 - DNA, 425 bp, Homo sapiens
ctgcccaaggttacacaggtggtagattgaatgagacttcaagcaaataccaaagggtcaaccttcatccagtcctctgagcattactggcagacctccctgaatgggcacatcacaaaaaaattgtaaatgcttcccacccagctcccagacaaaactccaagaatgcactaacaccactcccaaggggttgcaccagctattggagtggcttgggcaggggtactgtaagtgcctttatccagaagagcccagtgaagacctctgctctgttttcagaccacgaggacacttgggaagctgctctgagaaatttcatcagctgtggaagcagaggggctgttgatggatttctggaggagggatggttgtctgttctcttcgcttgccctactcagaaaaatgttcagatttctttttaaggc

SEQ ID NO: 225947 - DNA, 411 bp, Homo sapiens
agagatctgctcctcagcagtggatactcacctttctgtgttctgacagtgctactctgtcccatgcagctttctctagtcctactattacttctatttctttagaacaaccatagcgcatagtccttttcattaagggttttagtaggaatctacaaggcaaccaattgggaataacaaaaagaacctacgtgctttaggacttataaaaagccctataagccctccttcagaggccaaacactgaaacctccagatgcttctgaattcattatcttagaaaagtcaccaaatctttttattttttcacggtaagaactctcaacaaacatgtctttctgaacacttcccttaggtgctccatccaggtgcctgttattggaacaataaagtcatgttacttcattagga

SEQ ID NO: 225948 - DNA, 380 bp, Homo sapiens
tgagaggcctggtgggctcacaactcaggaagaccccacccacctgcccgcccccacgaacagcccaggagcaggactgagctcagcacagtggagctgatttacctgctgcagcctttctcctctgccagaggtcttctggggccaccagaacctggccatgctcacagagtgtccagccctcactgagcacaggccctagcatggaccatgggaaaagaggtaacagggtagccagggccatgctcggctgggctggagttggaggagaaaggagactcaggcctgaggggttagggactgtggctgggagcggctcctctgggctccatagcaccccatgtagacctcttcatataaaaacagtaatagctgccact

SEQ ID NO: 225949 - DNA, 462 bp, Homo sapiens
tttacccttttgcttttagttctgcaagttctatatgtataagcttgttaacttaaaaaagtagttttaggtcaagcttcatcagattttcatgagcattgttgaagagtaacaaaggtgttattaaacctttaagcttatagcttgttttggggttattttctacctaatcttgttcccacatcttaggaatgtaacatctttacaatggaaaggtactaatctttataatgggaaggtactaatatacccaaattagtgtttttatgtacatttgatttgtatctataactttttgaaaacagttttgagccaggagccgctgaagtgaaataaggaaaacatatgaagtgttcattatctaaagagttgttggtagtttattaagattaatttcccaatgcttttgatacaatatggtcctcaaagttttatttttcttcacagtgacctatcggggag

SEQ ID NO: 225950 - DNA, 927 bp, Homo sapiens
ggtatctgcacccttatgtttatggcagcagtattcacaataaccaagacttgaaaacctaagtgtccatcaacagacaaatggataaagaaaatgttgtacatatacaaaatggagtactatacagtgataaaaaagactgagatcctgtcatttgcaacaacgtggatggaactgaaggtcattatgttaagtgaaataagccaggcacagaaagacaaattgtgcatgttctcacttgtttgtaggagcttaaaaaattaaaacaattgaactcatggagatagtagaatgatgattactagaggttgggaagggtgggggagaagaggcgctcggggagctgggacgggcaccgggttggggggtcccggaacccctgaaagttcagtgacacctccagagttccctcttccccctgcaacaagaatcactccaaacttcccaaacactttggacccagcaatttccaggagttcatcctgatgagagaactgaaaggtgtgcacacgttagtaacaaggaggcctggtgaccgcctaagcgtccaatcccggggaccaccgggtcgaggccgagaggatggagaccgcgtcacaggcacctcgctgctggaatggagggtggtggggagaacttagaagattatgcaatgggctggcagggctatacccagccgccctggtaagcagaaactcaagaaacttctagggtcctgttttctggtcgtatgatcccaggagtgcacatgggcccctcgggtgtctgaacagaagggcataggagggagggccgcagccctgcagtcttactctgctggtgtagcggtcacctgccaactcccaccccaccctgcaccgcgggctcctgagtcggcagattaagcattttataaattctattttaaatacgtgttttaaacttgtc

SEQ ID NO: 225951 - DNA, 467 bp, Homo sapiens
aggctgaggtgggaagatcacttaagcttgggtgatcaagtctgcagtgagctatgactggcagagcgagaccacgtctaaaaaataaataaaagtaaataataccctggataagattcagaggagcttactagagagctgaatgggaatcagttcccaacagtacttctgttggggaggggtagagtcctggttgtggctgtgcaagttcttgaacttgtcaggaaaaagaaagatccatggatgataaaacattgaatggattcatagaggtgctgggctgtaaccagttagtctttcttaggaaaaaaaacttaacaagtttttgaagaaatacaggaaactagagtggcatggtggcacacacctgtagtcccatctactcgggaagctgaggtgggtggatatcttgagcccagcagtctgaaaccagcctgggcaacatgatggaacctcatctctattta

SEQ ID NO: 225952 - DNA, 291 bp, Homo sapiens
gttaggaggagagaataatccctgtctctgagcctcggtgagtgctgagtctcgactagccagaaagggggccagaagtttgacaatggatcagactatctcttagtgcgtggggctctcagaagtcatttaagaggatcaggggctcaataaggaaagaaacccacagattcacaggacaaaaacccattgactagacgcactcctcctgtactacacagctgctctagggggtgcaggaaggcaggggagcagatgataggacaaatgcttctatgagatataatcata

SEQ ID NO: 225953 - DNA, 443 bp, Homo sapiens
acaagatgaaggatctaataaaaatgtgttcttattcctgattctaaaactttaacagctgggctttcccatgtggaataatgttacataaataactcagccaggaaacagaggggctgtgaagaagtccaacaaaatgatagatgatcttggacagtcttagtatcacacccaatggagttagaaggaaataagtgcattgaaggtacgggtgagctatgttgttatgtgtgagcagcaaactttacagaacctgacagttatctgagtcatgtatcactaattctacagaagttttctttctacttaagtatattaacactccctaatctattccatagggaccttttctgctccatccaaatttgtcatcttttaattagtcatggaagtctagataaagcgggtttcagaaaataaacatgttgagttttaaaactaag

SEQ ID NO: 225954 - DNA, 309 bp, Homo sapiens
ctttaagctctagggtaaaaaggagaacattcatgcttttaaattggatagaaaagcagtttccatcctgtagctgttgtagcacatattgtcaaatagagactattagatatatctaaatgtattgcttctcagcaaattatatacactttttttgacatgttttacctatgttgaccttatttagagttttgttgcatattttagagatgcaagttattaaatgttttcagtttccaataatgtgatgcaagctcaatgctgtttcttcaacctgtcaagtctcttagaataaaacacagggtcact

SEQ ID NO: 225955 - DNA, 398 bp, Homo sapiens
tctctggcccggcgtgggggcagggcattgagccttttccttaattcttcagttattgaaagtagagtccaaccaggttacaaaactaaaaaaaagagtccaggacattgtctgtctgccttccggtagcatggttctctgtgggtaccctacgcttcgtttcttagttttactctaaaacaaccctgaggagacatttactagttgtcagattacgggaaggtgatgggttccagttttttgaaactttttttgttggctttcatattacttcaaatggcagtgaattaaaacagtttcttagaactctaatctgaaaagttaaatacgctttaaaacagtctgaaactcttctaaaaagcaaaactgcattattaaaagcatccatgtaagtatct

SEQ ID NO: 225956 - DNA, 383 bp, Homo sapiens
tcatccaaatacacccattgtgtgtgtacatgtgtcagattctgcaggggagggggcagacctcatccaaatacacccactgtgtgtgtacatgtgtcagattctgcaggggagggggcagacctcatccaaatacacccactgtgtgtgtacatgtgtcagattctgcaggggagggggcagacctcatccaaatacgccgattgtgtgtgtacacgggtcagcagtcctaagcaccatggggtcaggcggtcctaagtccacaaatgcacgcacctactatgcagccacaaaaattgtaaaaaattaaaaataaataaataaaaggggagaaacagaaaaaataaactgctaaaaatatacttttactttttataaacaaa

SEQ ID NO: 225957 - DNA, 395 bp, Homo sapiens
agctactccggaggctgcgacaggagaatcgcttgaacccaggaggcagaggttgtggtgagccaagatcgcaccattgcactccagcctgggcaacaagagcaatactccatctgaaaaaaaattaaaatcaggaataaggcaaaaatatccacttttgtcccttctattaagatctagccagagcaattaggcaagaaaaataaaagacatccaaatggaaaagggagaagtaaaattatctctgtttacagattatatgatcctatatgaagaaaatcctaaagattccacagaagatctgttagaactagtgaatgaattcagcaaagcagtaggatgcaaagaacaatctgaaaaggaaattatgaaaacaattctatgtacaatagcat

SEQ ID NO: 225958 - DNA, 408 bp, Homo sapiens
aaaccattctctttttatttttcaaatttttttagggactaggtcttgctctgttgcccaggctagcagtggtgcgatcatagctcactgcagcttcaaccttctgggctcaggtgattctctcacttcagcctcccaagtagctgggactacaggtgtgtactaccatgcctacctaattttttaattttttgtagagatggggtctcactatgttgcccaggctggccttgaacttctggccttaagtgatcctgctgcctttgcctcccaaagtgttggaattacaagagtgagccaccccgcctggcaccattcctttttaataaagatcaaactaatgataattgaagtgtcaatataaggaatgaaaattctcgctctggcttctcagatgtggggggcaaa

SEQ ID NO: 225959 - DNA, 213 bp, Homo sapiens
agtgaggcagatgtataataataggccgtcttggaacaagtcttgcttttcaaacatagtataatagccttgtttgtgttagcaaagtggaatctatcagcatggttgaaatgcttaagactgctgctgataattttgtaatataagttttgaaatctaaatgtcaattttctacaaattataaaaataaactccactcactgtgctaccaaa

SEQ ID NO: 225960 - DNA, 266 bp, Homo sapiens
gttgaacaaagaactaaaatcaagatatgctttatttaaaaatttgaaaatcattgaagtctttgtaagtctttgctataattttccatcacatttaattggtattttatacaatgaaatacaaaaatgtcaacgaattttctcttcaaagttaatgccttgtctgtttctctttcatcatattcattatcaatagagtgtgttaaatctccaaattctcagttgtaatatgctatgcaaaagtaaaataaacatttaattttata

SEQ ID NO: 225961 - DNA, 414 bp, Homo sapiens
tttttccaaagaagcacagcggcagctggcctgtgggtctcagggtggtcctgcctgcctccttccttcccttctcagttaagactctctttagactgtggcttgctgagcgcaagaagctgtatgagctgaaagtcataaacttctcataaagtctacccatacaaatggtattagcaataagaagataacattgctgcaaatattcaactgaatggagtactagttttattttataagcatacaagggagagttctggtaaataccttgtctgagtaaccaaaatcaatgcagttttattaccaagaaaaaaacaacacgtcttcctctaaaggttgattataatgtctccaagaggtcgacttaaaaataaatttaaaatatggtaaaaaacatacacactgaagaacaat

SEQ ID NO: 225962 - DNA, 320 bp, Homo sapiens
agaccatcctggccaacatggtgaaactccgtctctactaaaatacaaaaaattagccgggcatggtagcggatgcctgcggtcccagctactcgggaggctgagctggaagaatcacttgaacccaggaggcagagttgcagtgagccgagatcacaccactgcattctagcctggctagagagcaagactccgtctcaaaaaaaaaaaaaaaaaaagaataggcaaataactagagaaaaatagtccagaaacagacctgaatatatataggaatttagaatatgaaagtgtcagtgtgtaggaaggagtgaaatgaa

SEQ ID NO: 225963 - DNA, 371 bp, Homo sapiens
caaaataattgtgttaagttttatggaagatggaaatataaaaaggacacagcctctttgtcaatttggcaggcagaacactgttagtgccataagggaaggaaaaaatgccatgggagcttattcattcactaaccaaatatttattgattatatgttgccccgcaggcactatgataggagatatgtgatgtctaagacccagtcactgctgtgaaagatgagagaaatgcaaaaaacagaaaaaaaagtgctgttaaagtatgaaaattcacagctgtttattttgtggtctctctcttgactagtcatgatgatttttatttgctattaacttattaaataaagttaaattgttaaattgttagcat

SEQ ID NO: 225964 - DNA, 1914 bp, Homo sapiens
caaggttgcagtgagccaagatcacgccactgcactccagcctggacaacagagtgagactcgtaataatactttagcctttacataattactctaagttacgtgtgctttcaagcttatacatttaatttgatttttaaacttaaaaagaacttgtatcatcaacctgaacactgagcttaaattcagaaaaaaagattttagggccaggtgtggtggctcacacctgtaatcccagcactttgggaggcggaggtgagcagatcacctgaggtcaggagttcaagaccagcctgaccaacatggattaaccctgtctctactaaaaatacaaaattaactgggtgcggtggtgtagtgcacacctgtaatcccaggtactcgggaggctgaagcaggagaatcgcttgagcccaggaagcggaggttgcaatgagccgagatcataccattgcactccagcctaggcaacaagagcgaaaaactctgtcttaaaaaaaaaaaaaaagattttaaacaatttatctgcatttcactggtaccaattctttatgatttattccattaacctgtgttactgccctacaccacaaatttggaaatgataccttacaaaaaaggaagtgctgaaatatcctctaggttaataatttaattcacactgcacaaatgctaaactcccctctgtgaaaaaagccactcatccccttgtgtactcagtacgggtagagagtcccaggcccatgagaagtccaggatacatgttcgcctcggtggccacaagactcttccctgagcacaagtgggaggcccagcctccatctcactgcccttcttactcatctctactgcaagactcattcctactgttcaaaaggtctgaattcggccaggcgtggtggctcacagctgtaatcccagcactttgggaggccaaggcgggtggatcacgaggtcaggagatcaagaccatcctggccaacatggtaaaaccccatctctactaaaaatacaaaaattagctgggtgtggtggcgtgcgcctgtaatcccagctactcaggaggctgaggcacaagaattgcttgaaccagggaggcggaggttgcagcaagccaagatcacgccattgtactccagcctggcaacagagcgagactccgtctcaaaaaaataaggtctgaattctggccctcactgaaagatcaacttatctccatgtttatcatgttagcatgtgcagaattcaattcaatacaaatcgttctggctgaatggtgaggagaattttctttaaaaactcaaaatcgggccaggcacagtggctcatgcctgtaatcccagcactttgggaggccgaggcgggcagatcatgaggtcaggagatcgagaccatcctggctagcatggtgaaaccccgtctctactaaaaatacaaaaaaaaattagctgggcgtagtggcgggcgcctgtagtctcagccactcgggaggctgaggcaggagaatgatgtgaacccgggaggcatagcttgcagtgagccgagattgcgccactgcactccagcctgggggacagagcaaggctccgtctcaggaaaaaaaaaaaaaaattccaaaaaactcaaaatcttggccaggtatgtgggaggagtggtgagatcatagctcacacctgtaatcccagcctggaatgcagtggtgcaatcacagctcacagcaacttcaaactcctgagcactggggcaggaggatcgcttgtgcccagaagtttgaggctgcagtgagccgtcatcacaccagtacactccaggctaggtcacagagaccgtgtctcaaaatcaaaaacaaacaaacaaaaactcaagatcctcatagtagacgcaaacttcctttgttgtgacacagtattttgt

SEQ ID NO: 225965 - DNA, 248 bp, Homo sapiens
agtttgttctttggtattagatctgatagactttatattcactaatcattgataaaactttggaaagtgctgtatttttctttgttgaagctaagaatggtttgcttaggagcatcctcagatttgtcttaactattgatactttcttttggggatgttttatctttcattataactaaaagcagatatttctccttgaggatgttatttgtttctacataaccaaatgttttctttgtgaaatggaa

SEQ ID NO: 225966 - DNA, 697 bp, Homo sapiens
cagcaagaatggaaggccctcatagcgatggttattttaggcaagtgctcaggcaaagcaactatctcagaataacttgcctggcagactgttaaggtgaaaatatttgtatgccagtaaaaacatcaacatattttctacttgtcaatataaatatatcaaatgagatcatgagggaaagggctttgcaactgtaaagtatctctagctatgtgatatatttattatttgcttttaaaataccaagatgggctagagaacagctcataattcccacagaacagtttcaagacggaaaaaaaaaaaaaaaaaaaaaacaaaactacccgcatttttaggccttgtccacgtgctccagagttgtcttttgctgaaagatcttaagtgtgactccttttgactggattttttcacccacggccactcagtaatgcaaggggcctggaccagcagcctggtgagactgcggggcctgcttcaggaaggagggtggtctctctggaccccacaccttcctgacagctcagcatctgaaaggaagcactgtggtgtggccttcaaggggcgatcccgggtttgttggttttgatcaacctagtgacatgcttagtttcttgtaggagtgatagaatttttaaatctccaagtcctagcagttaagtatacaaaacactgcccttgccaacaccccccatta

SEQ ID NO: 225967 - DNA, 578 bp, Homo sapiens
ctccgaggttacgctgtccatctcagggcttctaggattcccgtaaagaacaactgaggacttcttcctttacatcttggggtaaaataaatactcaggacttatttcatctagaaaatatgcaaaaataaaagatttttcagccttctgacaatctaaattcaagaaaggtattatagcttttgaaatgtacaatttcacaacattgataaatgtcctcggtggagacctatcgctcattttccattccctgcacatttcattattacaacgtaaattggcagttgattattactactttattaccctgtatgatttcctgaagtgcaggagacagaaagtccactataaaaatacccatgaaatttgtatcccaccccttgatgccactcattgatttgtctttcttttatccagccccatttggtttcacctttctgcacagcaaactcaatcacacataagggtacaggcctgtgcacacacagaggcaagttcaaactctggaatagtacccttccagagattaagaaaaatactgtgaagtcccccgtcttcagtcccttctctcttcaagt

SEQ ID NO: 225968 - DNA, 573 bp, Homo sapiens
ggtagccattggcagagccatgggcacccagcctcccccataggccacactcccttggtcccctggcatcctggcatgactcgcctggttggcagcactttgttaatatgggttgccggagattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcaccttgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctcccaaaaaaaa

SEQ ID NO: 225969 - DNA, 555 bp, Homo sapiens
tatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcaccttgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctcccaaaaaaaa

SEQ ID NO: 225970 - DNA, 790 bp, Homo sapiens
catccttgcagcctggcacaatgggctcccacggagtacacagtgtttcttattgtggcataaaatgccataaagtcagaacaaagagtgagcccagggccttgatgggtctgctgcttcctgccgcgcagagaatacaagcgattgtttcaaagccagtggtgagttgtcaagaaattacccacaacccagaacagaggaaaatgaaagtaggttttgggggccagtcctgccattttgagggtgtttgctaaattactctttttctgtgactgtgtggaaccaaatgccatggaaggaaggaatgaccaccacccagaggcaaaaataaccccgcaaagcttgggaaagtcagccgcagcaaacaatcaggaaggcgaggccaagttcactggatgcagagcagataagaattttaattcatcctgaacgcaaggaaaggcgccaacaaagggaagaggttatcttccggcatgagataagatttgttccttttccttgctgggattctccagcgtccagcacttggagagtttgggggttggtttttttactgccaggattcctctaggaaaaccctccccaagccctggcaggggctgtctggcccttacctgaagggaccacattcactcacaagctagtggccttggtggatttggggtctgctgaattcagaggttgaacaaagcaaacaggtctcccaagaaagggccctcaaagcgggcaagacggctctctgcaaacaggttcgagaaaagccttctccctgttcctttttccattaaaa

SEQ ID NO: 225971 - DNA, 250 bp, Homo sapiens
cttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgcctcactccaccctgaatggactcgagccatgtattcattcagtaaactgacattattctcccaaaaaaaa

SEQ ID NO: 225972 - DNA, 535 bp, Homo sapiens
tgattctcacagcggactcttcccctttttgcccctgttctttcttcacctttggcaagcatcagtcacacatcttgaggaacctgctcacaaagtggcgcgtgtagcagccccaggtgggaatggagggacttttctatgtagtgtaatggacataaggaggcagatgtctgtgtgggggtgagatgtctgtgtggaggtgtttgtatgcgtgatttctgtctgggccttcttaggcctgctggtataaaataatatgggaaatgcagatgactcagcactgacacagtcaagatccccagagttagcatttctatattctctgctgtttacgaaaaatgtgcttgtgccatcaatcagcaactcatcctgcattttccgctaaaagccttttactgaaaaatgcatatacttcaaacttattccccttctttttgtaaactgagctcattagcagctgacaccaaactgagaactagttttgtttgtttgtttgttttagcacggaggattaaactggaaggaaatgagcatt

SEQ ID NO: 225973 - DNA, 468 bp, Homo sapiens
tcttagaacttgttgcctccctgggcagacgccatgaagtgtgataaccagcactaagagaaagtctcaggaagttccccggtctgaccctgcggccacggcagcctctgcccacagcctgcttcagtccacctctggtgctgcagccaactctgctacaacactgcttccaccagagtgtggaataaaatcacagtaacccacgctgttcctgaaacagcaccgactgcaacactgcttccaccacagggtgtggaataaaatcacagtaacccacgctgttcctgaaacagcaccgactgcaacactgcttccaccacagggtgtggaataaaatcacagtaacccacgctgttcctgaaacagcaccgactgcaacactgcttccaccagagtgcggaataaaatcacagtaacccacggtgttcctgaaacagcaccgactacaactgcttccaccagagtgcg

SEQ ID NO: 225974 - DNA, 405 bp, Homo sapiens
aaacatgccccaagtgggtaaaatgaaaacctgttctcaaaagagaatatagaaagaattttatttaaattggataaaagcctagttgttgtttttataaattttatttaattaagttgtcacagtgggaaatattcaatttgttagttgaaaaaaatgtaaaattgtgttctgggatctgtgattatttactgttacagcagtggggttggggttgggttgtgcattgggaacttaggggtttataataacttccagtatcaggacagtgtaaatgacttaaaatctcttgtgtgaaaaagtttgactttctgattctcagccgtgttgtggcaaaatggtccctggagtttttgaccctgtgtttaaagaaatatgctataaaataaaaaataatttggaaga

SEQ ID NO: 225975 - DNA, 484 bp, Homo sapiens
ttctcacatcaaaacttcttagagaaagcagatataacttcaatggataaataatttaaataattatttgaataattatttaaattccaaataatatccaagactagaaatggccgtggtcaaagacacttaccacaaacacaaacaactggagtttatactgttgtattacgtggggatttccaaaccacacagtattaccccattactctaatggaacaccttaaacagtttattgccttaaaatctgctttattaaaacaaattgtagcatgcaagtgtatgtatgcacagaaacagaacagctaacccttcagatacctgagattagaaataccagtatttgctgtgaaatgttggcttccccgctaaacataaagcaatagattctgctctatcagtgttccctacactactaaggtattgtgcactgctaacccttgcagctctattgcaaggtcaaggtgattatccctattttaga

SEQ ID NO: 225976 - DNA, 347 bp, Homo sapiens
gctgttaaaggaagccaagaaaaagagtgaagacattgagaaagtgtgcttatcaaactcccttaacagaattacagaactacaaaagctggagaaaacataacccagccattttatagatgatctcatggagcccaatttttttcacatgatttgcccaaagtcatttgtgcagagtaatgactcatgaaaaatacaaataaaataaagaggaaatctatgcagtaaataaatacatggccttaaaatattagacaatgcaagtattatacccagaacagatgtccagatctctgcagacactcttaggtgcttagggcctgagtatactaggtgacatcatagac

SEQ ID NO: 225977 - DNA, 200 bp, Homo sapiens
tagtcactacattacactctgccttctgtgtaaaggagaaaagctagtctgactcaaacgaagaagactttaagaacagcttcttggagcacacttatggaaactgacgtaacagatctaggctgggctgagaatcacacttttataaaaggttgcccaagtagttaccctgaagaccagccaggtttcagaacccctaa

SEQ ID NO: 225978 - DNA, 530 bp, Homo sapiens
agtaaatttggtaaacgaaaaattatattggataatttaaatgctggcttccttatataacaatgtaaggaagtaacaatgatctcactttctttgttatccatttttatatacactattgttatcgcctgtggtgtccatttgcccccttttctaccatgaaaatttttgcatttgatatacgatagctttctaaaatattaattgatgattaatataattaataattattttaatattttacctataatattgtcaaaaatatttcccaataatacttttatatttaattcacgggaattttactgtaaaattagtgctttttatttgttaaatctttaattttgtcattcttttacttatgttttctgaatctgatatcatgacctctacaatgtttgtttacaaaaatatttactgatatattttaatatctgttgttgtagtttgttatgttgaactcattaatattttgagattaacttgggaatgcaaaagtacaaatgataacatgaattttaatttccaaa

SEQ ID NO: 225979 - DNA, 582 bp, Homo sapiens
ctcacacttgtaaccccaacactcagtagagacggggtttcaccatgttggtcaggctggtctcgaactcctgaccttgtgatccacccgcctcggcctcccaaagtgctgggattacaggcgtgagccaccacgccaagcctaatttttgtgtttttagtagagatggggtttcaccatgttggccaggctggtcttgaactccttgcctcaggtgatctgcctgccacggcttcccagtttgctgggatttcaggcgtaagtcaccgcgcttgaccccctttcttgtttttgaacttagcttagctatatattaaatttttgtgtgttttattttatccagaactataatataaccaactcatcttcttttcctgcccctttttctttcccctttttcttctcctttcctctctctttattcactcttcagcctatttatactgactttagcagttttcaccaaaccactttattcaaggccaccaaacacttctatttgctaaatccaataaatcatttatttatttatttattttattattattattaatattattattttttttaaagactgagtct

SEQ ID NO: 225980 - DNA, 584 bp, Homo sapiens
gccatttcaaatggatctgtgtgattgttgaggaatgtctgactccaagagaagcggtggggcagtgtctgtggctgctcaacattgaaccctcaggcctctcctgaatgacagacctgcctcctgatcccggccgccaggtgctgctgcagaacctgcaactcaacatttccaaacaactgcatgaattcccatcaaaaatgttctcttctcttcttgtaccccaacctcagtcaacgctgccaccacccgcccaggtgcccaagatagagatcctgcctgccttcttcatccttatacctgtcctgaccctggtcaggcacacaggagggcccaggagatgtttgcagagtgaggtctgtggtctccctgcccagcctcgagctctctggccttctaatcccacctctgaactccctgcatcacctccttccaccttaagtctgtcttgggaaaataccggtagcatattcagaaaaatgaaacgaaatctgccctaccaaaaaacaaatattccattatcttacatttcctgtttccctgagaaacggaatagtcaaaaataaacaaactgataggatggc

SEQ ID NO: 225981 - DNA, 236 bp, Homo sapiens
aagaatactaatgagactatgcagaattgatatggaattgcacgtatatgtatggctgggctaagatttgcaagggcagaggggagatttagggccaaatcaagcaggccttgtatactctgccatgaccaggattgggctttattctggagataatgtgaatctatggaaggacttacataagaaaagatgaagtcagttttatgtttcaaaatgatcaatgtgtctggggtggt

SEQ ID NO: 225982 - DNA, 2388 bp, Homo sapiens
ccgcaacctgctgcgctcgcccaaccccgaaggtgcgcaagggcccagagcagccaggaggcaccaccctgaccgtctgtctcttcctctttccctgtttccttatctctctacctctttgtctctctctgtctatgcatttctctgcatccctctgtctctttaggattctttactggtgctttatttagttcctttgatgaggttttgttttcctggatagtcttgatgcttgtggacattcatcgggtctgggcattgaagaatttggtatttattgtaatcttcacagtctaggcttgtttgcacctgtccttcttgggaaggctttccaagtatttgaaagcacttgaatgttgtaatctaagtttttagtcactgcatctgtatctgcattagtggggactcaaagcccagtaatgctctggttcttgcagacttgtagaagtattgtcttggtggtcttggataagatttggaagaattctctggattaccaggcaaaggctcttgttgtcttcccttactttctctcaaacagtctctccctccatgttaccaccagtgatgttcactcaaggccctagggctccacagtgagcaggtgatgaagccgggcaggcttgtattcttttcttcagggaggtgagttccttggttccaggtggatctagagatgccaagcaggagccagggcctggagtctagaaccttaggaatctatctgttgctctgttctactgtggctgagctggcaccggagccagaagaggaagttcttcccactcttctctcccctttccacaagctaaggagttctccccatggccaccaccaccccaggctcatggcgagtactgccaggctactgctgatgtttatttaaggcccaagagggttcttccatcagtttgtggtggatgctgccaggcctaggactctcccttcagggcagtgggctttcttctggcccagggcaggtccaacattactttccaagagccaaggcctagaatcaaggaccccaggagactgcttgatgctctacctgactgtggctgaactgctgcctaagatgatttttgattcttatgaaggtgctttttggtgtgaatagtttttcaatttggtgttcctgcagtgaggatgattaatggaggcttctatttggacctcttgctcccctctcctcttatagtattcttgctaataattcataaccttaatctaaccagaaggaaaaaaaccggaaagaaacaactggaaatcctaaattgggagactctcatttcataaaacaccaggcttgtcatgtcagtgacatgaatgattaaaaaggactgatacatgacagctaaatgtaacatgttatcctagattggagaaaaaactttgctgtaaggaaaagtattgaggtaactggtgaagtttgaagaggaaccttattaaataatagcattatatcaattttaaatctcctagaaaaaaggaaaaggatgctgttatattccctttgtgatatcgtacaacgagacaactgcctcttctctatccatttcaaaactagaaatttactcatgggaaagagaaaatagtccagactatgtagcactgctttcctaatttgagagaagatataccattctgagaaacagaggaattaaatgaacatgtacatactgaaaatgagacctctagatctttttccctactgggttttcaaatgaagacaaacaggcctttatgctccaggcagagtattagaagattcgtctttgcggactcttaccaaccaagaaaaaggacctgaaacccttattaggttatagtgaaactgagcttgcaacaagcttcacctgtggcatcaaagtttccagctagatttacctaggaacactagacatctgagaaatgaaaaacagagacccatacaaataaatagggtaaaacacttggataaaacagactacttaaaaacttaaaataactgctatcctcagcgattcaagaagttactacagtcatgaaatgagaacttaatgttccaaaataaaaggaatatttaacaaaaaggagtacttggaaaaataaaaatataatagaaatgaaatgtttaactgaagggttagaaccttctattcaatttcctgtaacatagggcagaaagaaacagaaaatagaaaagaaaaattagaggactagtaatactagaagctagaagacagagaagtaacggtgctttcaacattctgacagttctagtctagaattctatacctagttttatgatttaagcttgaatgtaggctaaacacattttagacatgcaaagtctcatagaattatctcctacaaaccctttctcacaaagtgactaaaggagtaaac

SEQ ID NO: 225983 - DNA, 404 bp, Homo sapiens
ccccagcacagcctcaaatgtatattgaccatctagagaggcttctagatgccacaatacaggagccaaggcctggaacacaggagttcacaatccaagtgtgcctcaaaccgaccaaacgggaaccagggtgaggaacatgctccccaatacccagccatgtggtactggctgtcactgctacagaattcaggggaccgggtcattaaaatttgccatgcagcagatgaaaaagaagcaagctgtgaacaaggatcatcgcgttggaaataacagatactacccaagatgtgcagagaaacaagaatcaagggagaatacccagcccatccatctggagactgtcagttctcttggggaaaagcaatatttttatgctgcattttcctactcctcagggtaac

SEQ ID NO: 225984 - DNA, 498 bp, Homo sapiens
ctgagaaactcccctcccctgaagggcattagtaactgatcttccctgcacacttcctcccccaaaacaagaaggagaggatgaagcttaaaaaccctgtttcagctagaatctttccaagcccctctgctgagaaagacagaaccagtaccagctctgccaggcccatttaggtcttcctctcaacgttctgccactgctagcagctctgtgatccagactgctgaagatcagtaaagatgtccatttgcccagctgcatcatctgagagtgtagcatgttgaagacatgatctgttacagcgtgagacaactttctcttagtgcctcatgtttaataagtacttgtacatattgatagactgcatgaagtatgcataaacatacttagaaaaacctggactgaaagacaaaccctacactgtggtttcttcacccactgccctaactcactgtgctgtacagggggactgaataaaatcatttcacatgcatttcc

SEQ ID NO: 225985 - DNA, 418 bp, Homo sapiens
  misc_feature (141)..(141): n is a, c, g, or t
tatgtccatatgaaatgctgactttgttcaaacatgcaaacgggctacctaccctcctctcctacccaccctccaattgctgaagttccattcagcttttccttgtcttcagaaagtatattgaatgaaggtatagaaaantaaagcatttaggccaaatgttgggagctggaagaggaagaaatcaactgttaacttcaaagtgaaaagacaccaatagccagaaaaggttttctctcagtacagattttgctgggagtatatttctctattatttcaattattacaacttcctgcataggttgaaggtcattcataattcacgcttctgtcatttttagacatgccaaatgcagtctattaagcataaataaaacttccagtgtttgatcaggaaaaataaacggggattcataac

SEQ ID NO: 225986 - DNA, 264 bp, Homo sapiens
ctactgaggaattgataaacaaaatatatatctgtatagcaggatattattcggccctacaaagtaatgcagtactgctgcatgctgcggcaggggtgaaccctgatgcgttaggctgggctgggtgcggtggcgcacgccggtaatcccaacactttgggaggctgaggccagagggtcgcttcagccctggagttggaggttgcagtgagctatgattgcgccgccacactccattctgggtcacagagtggatcctgcctc

SEQ ID NO: 225987 - DNA, 293 bp, Homo sapiens
aattccccctttcatttcagcagaggacaatattgagagacagcagagtccagaggcttttcttatctaaggagataataactgcctaacaggggcatggaaaaatattgaagtattgggatgggcaggagaccagagagcttagccccgtctcttccaatctgatagcatcccttgatagttcatcttggtttgctttagctcagatgtacctggacgtcagggcagggggaagggaggatagagaaaagaaagaagaaaaacaagataaatgtatcgtgttatgaaagttt

SEQ ID NO: 225988 - DNA, 579 bp, Homo sapiens
gagaaaccagaggaagtggctcccctctgcacacacacaccgtggaggattatcttttaaattgaagaaataaggaagtgaaagaacttttgagcctgttaactcagaagattagcactggaaaggacctgggatctagaccgacctccttatttcctcatacaatggaggcctacaaacttgggatgttttacccaggtctacatacattgtgtcacagccatgactgcaccgtgtgactcctgttctggtgttctttctggtacaccattgaaaggcaatgagattatttccatgtctttaggaggaaaaacagaacagcatcctgccacacccagcctcttggtattcaccatgcactgtatttcttccttaaaacaattgaagcccagacctttcttttctggccccctactgaaatggaaaatatgttcgattattgttaatttaaaaaaatcagtgaggatacaagtgttagacgctactaatgaatcaagggaagtcttcaataagatgtagccaaaaataagcaataattgattcttagaaaggtataacagtgtgaagacgggtttgctc

SEQ ID NO: 225989 - DNA, 355 bp, Homo sapiens
tggtggtgatggtccagaaaggaggcatatacttgtgatagtggtttttgtcctttccatacatgacttcaactattttttatctttaaaagctaaattctaaagtaatgatggaaatggtgactgctctggcaaatttagattctactgtaccctgtccttcctatccttcttctggacatatttgtgtacatctttctttattgtgtgggttacatgcaaagctggggccagagtgtgtattagttgataaaagcagtactttatctgaatagttgttcactgttgcttttatgaatggattcatagaaaaaagggtaatttaggacacataaaatacatgattggaaattaa

SEQ ID NO: 225990 - DNA, 303 bp, Homo sapiens
cgattcttctctagtaaatgactgcctgcttccccccaagaggaccccaaagcaaattttaggtatgccacatagcctatatttaaaaccatgttgctcaaaacacactctccaaatttgataaaaatctgtcaggctgattttgcttgatgtagtaacagagacatgtaaaaacatatacaaacatttttgtttagctatacatagatgcagttaaaaagaaataaatactaggcagtaaattcaactggctaaggaaaagagtattttgatggtgttgttagaatagatgggaatttgagt

SEQ ID NO: 225991 - DNA, 708 bp, Homo sapiens
ggcagtagggcgcaaggcagtccggggcgggaggcaggggtcgcggtgcgccgggccctcaccgctgctgagcgtggactcgcagtgccagatgtccaagctggcgggtttccggcaggactcccacaacgacaggtagtactggtggtcagctgtgatccaggccgggctcagcaccgcccccagatccagatacagcgtcaggaagatgcacaacagcccgaccagcttcaaggggagtcaacaccgacacgcgcacctcctccatgccgctgcccgccgaagccattcctggatgccgctgccgcccgaggacgccaggcgggtccggggagccaggagtccgacctcccgaggggagaagccaccgagcccccacgcactgggactcgctccctcggggctctgcgcgccccctgccgcgcgaccaagatctatggagaagtgaacccagagaatttgcactgacacccatggacggaaggtaagatgtgcctttcacttttcaccatgattgtgaggcctccgcagccacgtggaactgctgttggccagatgcttatctgagctcctagaaaccacccacattctttaccatatggccgcctccatcttcaaagccagcaatggataatttataccttgtcaagttcctctcattcttcaaatctctctgacttttctgtctctgactagtgtgtccagatt

SEQ ID NO: 225992 - DNA, 522 bp, Homo sapiens
agccttcctgggaaattccaaaaacacttgcaaattcccatagggaatcttccagctaagtttagggcatatttgtccaaggtcaccgacagggtgaattatatgggtcaaatttctaggtgtctgtatgtgtctggcactccacttccattccaaactggctagaaaagaatgtttcatttttccattcactttcagtgtctgccctgttcccatagtaacctttggctgtcaccctcccccaccttacacagatagatacacatcctttctgaattaaatggaactatgtgacctaggttatttaagtcctccctatcctgtgtttgctcatctgtaatagggtgataatagaaatacctacttcaacaggttgttatgagattaaatgaggtaaagaagcatcaggttttaccacaatcaccatcactactttgtgctagaggcaaatctccataagaaagttgtccctttaagtctcacgaatagttcacgggtttgggaggtgggggggggcggaag

SEQ ID NO: 225993 - DNA, 695 bp, Homo sapiens
ggaattgatagtacatactttgattctttcttaaacgtcttccaaagactagagaagagttttacttttcttcacaataaaactaattctgtttcagaattactgtgtgggtacattggacccttttataaatctaagatacttcatggcctcctgccatatcttgaaaaactatactgtttcatcatcctaggaataattttatcattacttattcattatttccagttgtactgaaaaagactaaattattaattttttaaaaaaacagaagaatgatgaaattgcctagaaggataatgcaggagtgacatgaatcatcactgttacatcatccttcacttttattattgtgctgcctaaagtattgcattatctttcaagaatgtgcagtagaagtctggagacacactgtctttataatcttctttcactttcattgaacaaggctgagaattcacaattttatattttccacacaaaatggcaaataggaaattgacaaaacatgttttcacaatttttagatgaatcagaagatgaatgcaaagaaacacgtagtctaggtactagaacctaatgatgtaatgaacttcatcttttaagtaattctcagactacgatttttcagtggatattggtagatgttttttctaaaactcaagaactgataagtgaatgatgtatttctgtgt

SEQ ID NO: 225994 - DNA, 167 bp, Homo sapiens
tgttaaacacataatcctaaatttagttgaaccatctgggcaactcttaataaatagtgagaacagactgttctgtgaagacgggcacattttaagtgctcgggcagcataaatactttggccaaccttgagccagtgagccaagtaaaaaaataaaaaaatgaccc

SEQ ID NO: 225995 - DNA, 323 bp, Homo sapiens
aagaatcccgaataatacaccatgtactcttattgtctttctactacagctctttccactactaacatgaaacctatgtcaaaactaagaccaacctggaaatgggaaattaacagattttagctcactataaatatttttcaaccattagaggctgaccaaaaatggaattgactgatttatgcaacaatgttccttattgctataaactggtaatgaatcctcacactgaatgaaaaactgaattggatatttctcaagttccttccaattataaaatcacatgcttctaggtgagtataaggtgtacttaactgtccttc

SEQ ID NO: 225996 - DNA, 219 bp, Homo sapiens
gtgacatctctcagccaactgaccacagttgactcagctgttctgactggctagcaagatgtttgtgaaggagggggaggaaaaaaaacaactctaacaaagctgaatattctgtctgtgcagacagatctagctttttaaaacagaatcctcaggactaactttaaaaagtatttttcagggccagtatggccctctgagaattatgaaaaagggtat

SEQ ID NO: 225997 - DNA, 420 bp, Homo sapiens
ccatgttggccaggatggtctccatctcctgaccttgtgatccacccacctcggcctcccaaagtgctgggattacaggcgtgagccaccgcgcccggccaggcttctttaataagggcactaatcgccttcatgagggctctgtcctcatgacctaatcacctcccaagtgccccactcctaatcccatcaccttgggagttagtatttaaacatatgaattttgggagggtacaaacattatgtctatgccagtaacctcctttgtgaagccttctttaactcccaccaattcttgcatccatactccccctagcgttcttcacatgcttcgactattgcatctcttacacaaaattatttacatgtctgtgagctccttaaatgcagggaccatgtctcaaataaagtgtatccaca

SEQ ID NO: 225998 - DNA, 372 bp, Homo sapiens
aagaaatcccatgaagagagaaaaatatgattaataaaatacagtatataccggaatatattacaattattatttctgaggaaaagggagggacagttttttaaaagctccttctttatgtgtttattttccaaatttcctataacaaatgtgtagtacaatgatgattaaatgaatgagtatataaagtgctagaagaatgcctggccttatagtgaactctcaaatatgagcttttactgttgctatgatataattacttttattatatataaaatatttttaaaaactcactctaattgtaattaattgtttgtgtaactacttgtttaatgtttgtcctctatcctctatcgtctttggtcccttata

SEQ ID NO: 225999 - DNA, 407 bp, Homo sapiens
tgagaaatgaggaagatttatcaagagatggggatggagtataaagaggtagttaggcagatgctgtaggtagagagaatcttgtgggctgagagttggtgtcataaatgcatgacatgtgtttagagtatggcaaagattcacttggaagtaaggagaggtgaagagtgtggaacagtgtgaggaggttgaagtctgagtacatttctatttaatttagtaagcagtggaaaactatgactttttaaatttagtttttttttttttttattatttgtaagctttttatcttgaaacagttttacatacacaggaagttgaaaaagaaatgtatagaggagtccagtgtatccttcacccagttccccccagtgaaaacatcttgtataactttaggtataataaaa

SEQ ID NO: 226000 - DNA, 294 bp, Homo sapiens
tgaacagatgaagacgacaaagccattgtccttaggggatcatctcttggtgggaagacaggtaaacagtaaccattccacaggcacccctggtaaggatttaggtggatggatcctgtgggagccctgaactgggtcttagaggtgagcaggtgagcaagtaaggaagccagaccaagagtatttcaggcagaggcaagaacctaggtaaaaagagaaaccaaatgtaagctcaacgtctttctgtggagcagacacctaagaaattgcccaattcattcccaagcccccagg

SEQ ID NO: 226001 - DNA, 675 bp, Homo sapiens
gagactttggacatgtcagtactcttttgggggccttacttttcttatctgtaaaataaaatgctaacattctggaattttatacacaatcatgtgatgagcaccctaaaacatgacagttaaaggatacggctaaaaggtcaggctggacctctcgcgagctctctatatttcagccattttcaggttggttctttttgtccctttatgcctttaccgggcagcggtgatcgccacgcagcatcagatagtatatggataaaaataggttcttgtaaatgttgaactgaagctgcattaaacacctagaaaaaacatatgtatgtgtcagtgctatcagtatattcaatctcagaagtcctcagtatattaaatctcagaagtgataaactttgaataatttctataaaaatgtattactgatttttccagttttattacattactcttctataaaatgatggaattttgtttcccaattatgaccaagatgattatctcttaatcaaaagattattattaactcaggatcagatttaaagatacattcaggccaggcacggtgactcacacctgtaatcaaagcacttttggaggctgagatgggcacattgcttaagcctaggagctcaagagcaacctgggcaacatagcaaaaccctgtctctgcaaaca

SEQ ID NO: 226002 - DNA, 830 bp, Homo sapiens
cattacactgcatcccacgtaagttttatgccacaaaagtaattctgcagaatgtctgtacaaaaaaaaatctctaactactgtgaacttttagtttgaaagaagatttaaatttcagttttcaccaaatagaaatatctagaatacagcaaagtttctcttttaaaatggtgtcattgatgtcataagtatgggtatttctctgcatattttcattgtttccacaaattttacttgcttaaagaagtgaaatctatgaaaattagggttatgttatatcatttaacagtcataatactttttaaacttttaaatatgttattgaaatgtagcatacacatagaataatgtgcctaagcattggctctgttaattttcacaaaatgaacacatgtgtaaccaggatcaacaaagagagcattatcagcaccctgaagtctcctagtcactatcctaacccctaagccactcactttcctgacttctaacagcatgaatttgcttgcctgtttttgtgtttctagcatatggaatcctatgatgcctgtaggtattgttttgtgtctggcttgtcttactcaacattatgtttgtgagagtcatccatattgttgcattcagttgtagttcagtcattctcattattgtatagcacttcactgtgtgaatatcgcactttctcaattctactaaagatgggcattattaagtagtttctagttttgggctattttgaatagtgcagctgtggacattctcctatgcatctttttggtgcatatatatgttgaatatgtaagtatatagatataaaaacctatagctgtgta

SEQ ID NO: 226003 - DNA, 442 bp, Homo sapiens
agctaaatgggaatattttagaagtttgacccattgttgcactctcacatggcagcctctttatcttgttagagaacatcctttgatttcccttttcattctttctgtgagtctgagctttcctttttacctataaatgtgcttatcttatcaaatagtactgcatgttgcccattcctgggacaaaagagaaataccatcctgtatttcttatagcaacccaggtaaggtttgtgtgtgagggagcattttggagaaaagagaattgtaaataaatgggtataatctagttggaaaactaaaaactttctttaataattttaaggtaggtcaagagcagtagtagtcattgtgtatttcaggttaaccaagaaactcctactgccctgtgaaaatttattttcaatgttagcattcctatcaatggataacagttacaagg

SEQ ID NO: 226004 - DNA, 661 bp, Homo sapiens
ttcaccgatggctaatactttaccacatttattctctgtatatatacatattttttttttctgaaccatttgagagtaagttgcagacatcaaactcctttacccataaatactttgatgtgtattctcaaaatgaaagacatttacttaaactgcaataaattatcaaaatcaggaaatttaaatattaagacaatactattatttgatctacagaccttattgaaatttcaggagtcccagtaatgtctattatagcattttccccccaactccagaaatccaggagaatcatatgctatttttagtttctaagactcttcagtctcttaacctagaagagtttttcagcctttgtcttttagacaccaacatttttgagtagtacgcatcatttattttgtagaatgcccctcatttgtttaaattcatgttacacattttttgacggaaatttatagtgatgtgtatcctcagtgaatcgtatcaggaagaacatgatgttgattagtccccttattaatgttgattttgattatttggttaaggtgggtgtgccaagtttcttcactatcagattatctcttccttttctaattaataagtaaattatggggagatactttgagactatataatattttgttcctcatcaaacctg

SEQ ID NO: 226005 - DNA, 413 bp, Homo sapiens
ccggcccaaatactttatattaattttagcatttagatactactatccctccattttacaaatgagaaatctaaggcaagagaagtgaagtagtgtgctaagtaacatcccaaagacagtaagcaggccgggtgcggtggctcacgcctgtaatcccaacactttgggaggccgaggcgggtggatcacaaggtcaagagttcaagaccagcctggccaagatggtgaaaccccgtctctactaaaaaactataaaaattagccaggcgtggtggcaggtgcctataatcccagctactcgggaggctgaggcagagaattgcttgaacccaggaggcggaggttgcagtgagccaagatcgcgccactgcactccagcctgggtcacagagcgagactccgtctcacaaaaa

SEQ ID NO: 226006 - DNA, 360 bp, Homo sapiens
gaccttgtgcttatgtctttcccttctctttctcttggagacagagatgctctgaacaactgtggaccttgtgcttatgtcttttcccttctctttctcttggagacagagatgtaacccattgctccactatgttggaaccagaatgtccaaattagcacttgaggttctgcatgaaagaggaaatagcagaaagcggggatagagtcatagaccacacgggcaggacgtccctttgacctaggagggccctgggcagctgggcactgggtggttagagcaggggtggagtcatagaccacacgggcaggacgtccctttgacctaggagggccctgggcagctgggcactgggtggtt

SEQ ID NO: 226007 - DNA, 669 bp, Homo sapiens
tgaacatttactgattgtttcctactatgtactagacacagtgggagaaactcaaagacgagtgaggaaggaggatactgcagccaacagttggcattgttacattaattttagaaaaagtagccttcgggcaaaaagtattacttggagtagagggtatctcctaaagataacaggtgtgagccattgcacctagctgagagaaacttaacaacttcagaatacattctacattctttggaagctcatgggcaacatggacccaaagtgaccattatgctgagccataacttctggcaaatttcaagaaattgaaatcatacatactgtcctctttctgtgctccgacaatataccttagatcctagccagtacggtaacagtaaaaatatgaagacaatacagattagaaagaaagcaagcttgctttattcacaaacaacatgaccgggtggaaaatcccaaagaatctaccaaaaaagcttctagaattaagtgatttagcaagcaacaaaatccaggaagtagataaaagttttacaaaatatgtaaaaggtctgctgaaaactatacaacagataaatcaaaaagaccttcaaaaatagatgtaccatgttcatggaacacttagaagtggttaaggtaatttttttttttttacttcaatta

SEQ ID NO: 226008 - DNA, 344 bp, Homo sapiens
ttcccattctaactgccttcattaaagaaggcaataacctaggaaagttatttttctagttcaatttcataccttgttaatataattcttattaacgatagaaccgatcttacaatagagtatggtaaaatcagatgcctccaatgagaacttgctgcagcatcattcctctcttctctctgattctgatttataaaaacttaacagaggccggatgcagtggctcacgcctgtaatcccagcactttgggaggccaaggtgggcggatcaccagaggtcgggagttcaagaccagcctgaccaacatggagaaaccccatctctactaaaaatacaaaaaaat

SEQ ID NO: 226009 - DNA, 498 bp, Homo sapiens
caaccatcccacattagcaacctaagtaggccaccagtagagctggtcaagagaaaggataggttcaattaattattttttaattaaaaaaaaatagagacagggtcttgttatgttgccgaggctggtcttgtactcctgagctgaaattatcttccctaacactttgggaggccaacacaggaagatcacttaagctcaggagtttgagaccagcctgggcaacatagtgagactccatgtctattaaaacaaaaaagttcaaggagaatccaaattaatggatgtggatagaaatcaaagtggcgattcctcttcagaagtgaagactgactgataggagaaatgagagaactttctgagtgatgaaggtgttttatatctagattggagagttggttacacaagcgtatatatttgtcaaaagtcatcaaattgcacacatattatttcacagtatgtatgttttaccttaaataaaaatgttttggccaggca

SEQ ID NO: 226010 - DNA, 359 bp, Homo sapiens
ttaggctagcttctacaaattgcaatatgcagtttttgaaagattttctaacaaaaagccaataaatgtagccatctccttgttgtttgcaatggcagagcatcctagagttcctcagctaacctctcattatgtgtcttaaatgcaaaagagccattaattatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaa

SEQ ID NO: 226011 - DNA, 443 bp, Homo sapiens
cacaggtggctcaacctcaagggttggtggtgaactgttagtagcccagagttctgaactcatatatccaatgtgaatcaccccaaattagccaatcagtaccattctagtggcccagtattgttcaatgccataaaataaatactgtgctggtcagcagaagcaatctacttgtcaggttgccctggacaaccccataggcatgagccctgaaccgcctcagggcatttggccaaccacacagatcaagaggtgggtcacagagtactctgaagagaaaccaactgggatgatcccagccactgaagagaacttagaatatttcaagaagagcactcaaaagtgtggggtcccctgagaatctggcctggggcctgagctagggaccctgcttgcctaggtcttagggcaaattgtgtaataaaatagagatgatctcatat

SEQ ID NO: 226012 - DNA, 506 bp, Homo sapiens
tcctttagcctttcttgtcttgcatttctgcttgtaacaaattctctcagctttagtttatctgaaaatatttcacttgtttttttaaaggattttttttttgctagatatataattcaggatttacaggtgtgcatttttttctttctgtattttaaaagatgtcattcattgtcttcagatctccgttgtttctgttgataaggcagacatcatgtgcattcttctcattatgtaatgtgtcttttctttggctgcttttcagatttttctctagctttcagctgttttattctggtgagcctaagtataattttctttgcatttaacctgcttagggttcactgagattcttggaatgtaggttgatgtttttgtcaaaattgggaaattttcagccattaattctttaagtttttttttctgccccaaactctcttttctccttctaggacttgaattaaacacataggatcactttattattttgcagattactgaatctg

SEQ ID NO: 226013 - DNA, 210 bp, Homo sapiens
acagcttgcacgggcctcaagggtgtcatgtggcatgaaagacactcatctcaggccacacaggattccattcattgaacattcctgagacaacggaattctggtgatagagcacaggtcagtggtggccaggggccgggtgtggctatgaaggggtggctgccttgtgatgattcaatatgctatgtttttcctttgtggttttctgta

SEQ ID NO: 226014 - DNA, 353 bp, Homo sapiens
ttttccttacaacttatctccttttaacaagctgtgtgatttacctatttatttcgttcatttttttattgtctgcctcctcccaacagaatgttgtaaaggctaagaaaaaccctagtgtttttcctattctcacacaacacaacccctctgacatgagctgtgttagggttgtttcctcacataccaaacaattctccagcagacaccagctgggtgtcctctaattcaattctattccggcacttggtgaagatagtgtcggatcccacaggttgaaggctcagtcccatcagactgccccccacttcacatgctaatcacaagtcctagcttgtgacctatactgatga

SEQ ID NO: 226015 - DNA, 459 bp, Homo sapiens
gtgatcccatgtaacttctctgctatgtgagtgatggatctactggctttataggacatggagatttaaatcctttaaaccaatctgtatgtccatttttccatatccgatcaaactctccagcccacaaactgccactcaggtcgcttaaaagttattgaagaaaaggcagctgggtgcggtggctcacgcctgtaaccccagcactttgggaggctgaggtgggtggatcgcaaggtcaggagatcgagaccatactggctaacacggtgaaatcctgtctctactaaaaatacaaaaaaattagccgggcgtggtggtggtctcctgtagtcccagttactcatgaagttgaggcagaagaatggcatgaacccgggaggcagaccttgcagtgagcctgggcgacagagtgagactccacctgggtgacagagcaagactctgccttaaaaaaaa

SEQ ID NO: 226016 - DNA, 344 bp, Homo sapiens
ctgttgttgagaagtggctgtccaaccagggactcatttcccagacccccttatgtccaggtgccattgttcttgccaatagaatcaagccccagtcatgggtattatttccgggataggtttgttaagaagcaggtgtgcctgctccacacagacccttttcccttccatcagaagatgaaactgacaacaatgagttcttcttgtggagccagaaagggaagagggccggaaccctgaacgaccacgtggaggaaagctgtccaccaaccaaaaatgcctgccttggaacacccattcattgctatgtgggcaagaaataaactaacatgtcaagctgctga

SEQ ID NO: 226017 - DNA, 695 bp, Homo sapiens
aagggctttaaattggatgatcttattagaggtacattaaagatagatcgctgtatactgtgtggagaaaagatttgaggaggacaagactagaggtagagagactggtcagtagactttttcagtaatgctgataaggaataatgggagacttagtacagccattaaaaggttggaaaaattggaagactcagaaatatttggaagaggaatatttggcagcacttaatagttgattagatatggcatatgagtagcagtcaaagatgagtcccagatttgtaggttgtgacaagatatatagtgatgctgttaataaagaataaaggaaaaatagctcatgagacagtgataaacccactttagtcctcttaagtttgagggtacctatgggacagccaaattagcatgtctgcactgcagtaggctatagtagtagaagttagaaatatttgagtcattggtatgtaagtagctgaaatcatgtgagtggaatagcccatctgggaaaagactgtgtgaagtagtgatttttttttttcttttttaggacagagtagattactctgttggtggattatgtggtttgagaaatcattttttgtatgaaaggctttatttggaaaaaagcctttatcatatttatgatatgaactataaaaatcaaagaattagaaaacctttggggtttatgt

SEQ ID NO: 226018 - DNA, 277 bp, Homo sapiens
caagagtagaatcaagtgcaaaggaaagaggaagcagaaattgcctgtcccctcaaaaagtaaaggaagactttcagaagaggggacactcaatccaggttttgagggatgaacaggagtttgccgacaggacaaagaagagacggacatttgaaacagaaggaatgggatgtaagaaggcaccaagaaagatgctgctaatgagaattattttaagtgcagagtagtgtatgtaatccttcattaatatattaataaacatatttataaataattt

SEQ ID NO: 226019 - DNA, 1096 bp, Homo sapiens
acagaattattattttaatacatgatataaaattcaaaagatacaaaagggattagagggaaaaatcattctcctctcccttccagttctgtcttctattttcccgatttctctcccaggggacaaccagttagttataaatatttccagagatactctttacccatataagattgtacatatacatgtgttttaaaattttatttaattttgtatttagaggttaatggtagcatgctacatggacctagcaagctactgtatgcaccttgcttttctcatttactgtctcttggagtatgctccattctcagtaggcaatatagtgcagagattgagagcacagaccactgggtttgaacaaactccactctttactagctaagtcatcttgggcaagttttctaacttctctgggccttaagttcttcatctataaaatggatataatagtccctacctcataggcatagaatgactgtaagtattaaatgagtcaagatacatgaagtatatagagcttggcacattttacataattattaactattacgaatacatatggagctgcatccttctttttaacacctgtataatattctacactggatgtattatatattttattttgtctgaccagtctcatattgatggacaactagattgttcctagtattactgttgcaaacaaattgcagcatttgctgtgatgtatatttttaaaggaaacaacataaatgtccaaagttagtttaattatggcacagtatatgtccatatgatggaataaatcagaataagattgtagctaggtgtggtgctcaggtctgttatcccaatattttgggaacccaaagtgggagtacttcttgaagccaggagttagaaaacagtctgggcaacatatggaaaccctctctctacaaaaaaaaaattcaaaatattagccaggaacagtgtcatatgcctgtagtcccagctattcaggaggctgaggtgagaagatggcttgagcccaggaagtcaagactacagtgagccatgattgcaccacacactccagcctgggcaacagagcgagaccctctctcttaaa

SEQ ID NO: 226020 - DNA, 615 bp, Homo sapiens
ttttttgaaacgctaattcagtgtagtatagtatataacattaatacagagttgaaatatggtctgaaattgttaaaaattgaatgggataacatttttcactttagacttggtaaaatttggttaaaatcgataaaagtaatctattcataaaaaattctgattttgtggaacatggaagatgaaaccatgattatctctagaataaaattgaaaggcaaagaaaggaattgtttagcatttcaatcagaaatttagtctttgtgggtatattgaaattttagggattattttcatgacctgtaagggccaaaaagaaagatcatttgcttgtagatggtagaagtcaaatatgttgatagtatagtactaatttgtcttaattttttctccaatatgtgtagcactttttcaaacaactttcttatcggatatgcttgttacttgaaaataatttttaaaacttgtgtttcttttatagcagaaattataactagatgagtgaaacattcctcttgtgaattgttacacataacatggattgaattttggaaatgaatctttttttttttttgagacggaatctcgctccgtcgccaggctggagtgcagtgg

SEQ ID NO: 226021 - DNA, 219 bp, Homo sapiens
gcctctggcttttgtttgggttgggttctgccaatgtgaagtgctgggagaagactggaaagaaggagaaaggcgaggtcagggtatttcttcccccggcctccttcactgtaggtggccatggctgctgcccttgaccaaaggtcacagcccttatgacagccctctttccacgtgactgttttcttccaagttcctgtaactgttccccttctgcta

SEQ ID NO: 226022 - DNA, 649 bp, Homo sapiens
gtcattagtcaagttctgcaggcctccccgcttccctggtggtgtctgcctatcctcaagcccattgagactccagtaatttttcctaggtgtacgggttcctcaataatctttgttctggaaggccctgttcctgagaggaatgttgcattttcctcagtgtgttttagaaaagaatttttattattttgctttacgttttctgttttttttttgaaaatttattccaacataactaaaattatgtaaaaagggaagatggcaaaagaatagagtttcttttagattatagtaataatctaacatcttgaaaacgcttaactttgcttttgatgatgacaagaaaatgagatgaatctactgaaggtgaacctataggaattttttattacttctgatcacgctttgcttaatgctggaaaactcaaatctttatgtgtattataaccatgcttaagtataattatagtgagcagacattgagttaaatgaattgatggtataaatgatgttgtttataaaatatagtgctatcaactgtattgtagcacttttttgttataaatagtaatttacaagccagctgaagattttgcattgagcttagatattgtccctgagtatttcaataaagttttaaatttaatat

SEQ ID NO: 226023 - DNA, 418 bp, Homo sapiens
tcataagcaatgtctaaataaattgtgctagatcctgttgtagtttccaaatatttgccatttttccagcaaaaagttgatattaatatttcccaactgctgccatcaggcttggccacgtggcttgctccagccaataacgtgaatgaaattgatttgccaccttcttgcaggtgcatgattctaccatcttttttccttcctttgcctcaagaccagcacattccagattgggcctgctcctatgtctgggtgccagaatgaagaagacatggaggagagctgcagccaacctatgaaggacacataacacagcaagaaataaacgtcctttgttataagaacatgagtgtggggccattggttaccatagcataacctagccaaagttgactaataaatagttttttagaattgt

SEQ ID NO: 226024 - DNA, 567 bp, Homo sapiens
agaggatgagggaggagcatattcggattgaaaatggtgatggtgtggcaggaacacagggactgtccactctgcacaggctgtcggggtctccgtgggggctgagcacagggtggcaaacacaaagaggacactgaaaatgaccaactcaggatgggggagctctctagtaatctgaaaaagggagattctagccctagttgaggccggcgctgtgtggggaaggggacaggctcctgtatagggtgacgctggaactccctgactttaagatcaccaagtcaggccgggcgtggtggctcacgcctgtaatcccagcactttgggaggccgaggtgggcggatcacgaggtcaggagatcgagaccatcctggctaacacagtgaaaccccgtctctactaaaaatataaaaaaattagccgggcgtggtggcgggtgcctgtagtcccagctactcgggaggcagaggcaggagaatggcgtgagtccgggcggtggagcttgcagtgagctgagatggtgccactgcactccagcctgggcgacagagcgagactctctcaaa

SEQ ID NO: 226025 - DNA, 549 bp, Homo sapiens
  misc_feature (511)..(511): n is a, c, g, or t
cagcaggccattttagtcacttcttttgtaagcagtatgacccagtccctcatataagggaaagtaaaatatccatctgaaaaccactcttagttctaggtataataaatcacagccgctatcatatatctcatacattactatatctagtgtatcacagtatctaggacgaacagacatcaagtaaaaattatctctgaaaaacaagtgaaattataagcagcttaaacagcactgtcccaaatttttttaaaaaatcagttcgtagtacctcatgcttgtttaaattgtttgactaaggctaacacccacagtttgatccttttttataaatcagtcagattttcaaccagtgacataatatacccataactctggacaatcagaggtagtaaatatacgtgtgcatgtgtctttataatagaatgatttatattcctttgggtatatacccaataatgggattgctgggtcaaatggtatttctggttctagatccttgaggaatcancacactgtcttctactatggttgaactaatttacattc

SEQ ID NO: 226026 - DNA, 715 bp, Homo sapiens
aaaggctgggggtcctattcagcctccttgcacagtgtggtggtgaatccctaaggtgtctgggagagctgggagacgtgggttctgccaccagctctaccaccacctcccagccagcttacctcaacttcgtgggggctcagtgttctcacctgcaaaggacgtttgggagagatctctgatactcctcttccctctcccgctctaacaaagcatagtcctaacatctgaggccagggtcatcatagagtagactgaaacatcagggtgagcagggagaaggaagggcaagtgggcgagcagctgtctagaggggcttcattagacagccgaagtcagccaaggaaagagggaccgaggtcattagaccgccaaagtcagccagggaaagagggactgaggagacgggcctgagagaggccgtcgaggaggcgtgagagcctgagcctcaggcgaagcttctcctccccagcctgatgttcctagatgaacttaggaagccagattcccctgtctcctgggaggatccactcatgagtgtcacacctggctctagatcaggcctacactggtgctagcatgggacagctaaggccatgggttttagagtcagtcatacctggggtcacttctaggactgtcacttactagctaaacaagttacttagcttccccaagtcatgttcttcctaaataaaggacaaaataacagttc

SEQ ID NO: 226027 - DNA, 307 bp, Homo sapiens
gggtattttgatgaattcccagaatctcactgttggaattgattcttaacattctaatcaatgctttaaatctcctttatgagaccacaacaagtggactttcagcttttcttaggaaaaacaaacaaaagactgaagtttcagggaagaaactgtctcataagaaagtcattactttttcatgcccttcttagtaagtttttgcttttataaagtcagatctgccttcttgaaagttccaacctgtttattttaatactgtcttctaggaccacagaatataattttaactcctttttcatcatgt

SEQ ID NO: 226028 - DNA, 247 bp, Homo sapiens
ggatgagtgctgacttaactctgatttcaacatgctacagggtcagtgctgacttaactctctgatttcaacacactgcgaggccagtatgaacttaactctgatttcaacatgctgcgggacaagtgctgacttaactctgatttcaacacactgtgggatgagtgctgacttaactctgattttaacatgctgtggggtgagtgctgacttaactccgatttcaacatgctgtggggtgagtgct

SEQ ID NO: 226029 - DNA, 370 bp, Homo sapiens
tcatggggaggagtaggcacctgactttctttttttccttacgacagctttatccaaataaagcacggtgtgtttcatcacccataatggaaagtgcctgtcactccttgaacaacatcatatggttggtggccggtggataatggaccactgagtgtcaaggtgactggctttcaatgcacacaaaactaaaaattatagacctgtcattccacaggcaggccacaattagctgtctatgcaacttgaaatttccattttgccagctgagtaatcatttgactagagtttttcatttggaagcatttctaagccttttgtgtgcaagtcttttaaaatgtggatcctgaagtaaataaacagtgcactt

SEQ ID NO: 226030 - DNA, 448 bp, Homo sapiens
cacatgacttctactttctccacatcctcatcagcatttgttattatcctctgttttgttttgtttttgactttcgataatagctatcctaatgggtataaagtagccatagttatttctgtgttctaattttatcaattctaaaatcttggcactgtgaacaagatttcatctcttacaaatgcttgtggctggccactaaaagcctgaggaatccagaatgtctggccctcatcttagctggcagttggcaccaaggtaaaaaccctaaatccctttgggaccagaagaaacatttacccctttaaagaccttgctacataaacattccatattacctgtgatttctggttgttttaaatgccaactgtttttattttgtgattttgtaagtgaatttagaatgttgtatttaaacttttgtgctatccaaaagtgctctctcaaa

SEQ ID NO: 226031 - DNA, 109 bp, Homo sapiens
ctagcaaagtttcaatgatgaataacatctctggaaaggttgctgtgcaatgaaacccaatgtctgagtcagaatctgatcagcaacctttcatattccaaaggggagg

SEQ ID NO: 226032 - DNA, 448 bp, Homo sapiens
tacctcccggctgacttttcaccttccgctcccctttcctcctagtctcgaccctactacaccaccgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcaggacccgtgcgttttcagatgtactagctgggctgttctaactgcagggaaaaagcttacaaaacaagagttaattttaaaaacgtttcaaagaaagatgtgtttttaaaaataagttaataaaataacactcccttttccctcct

SEQ ID NO: 226033 - DNA, 534 bp, Homo sapiens
tcccaggggctggctggactctgtggggaatacaaaaggaccagaaatagtccctgcccacagtgaacttaaaatttgcttacggaagagcagctttatacacagataaccttgaactagggttgaaagtgatgaaagttttgagagtgctgtgaactttgcacagaaagagagagtttaagttcagcattgggagttagggaaggcctgagctggaaatgaaaaatggtttaggaaacagacctgtgtccgggtgcagtggcttacgcctgtaatccaagcactttgggaggccgggtcaggtggatcatttgaggccaggagtttgagaccagcctgggcagcatggcaaaaacccatctctactaaaaatacaaaaattagccaggcatggtgccacacacctgtagtcccagctactctggaagctgaggcactagaatctcttgagcccatgaggtcgaggctgcagtgagccgtgatcacgccactgcactccagcctgggtgacagagcaagactgtctcacaaaaa

SEQ ID NO: 226034 - DNA, 412 bp, Homo sapiens
caggagcgcgactcctccagtcacatttgggccacagaaatgggcttgaggccgttagtgccagcagaggccagcctgtggccctggcatggggcaaaggctgtatttgaaaatatgtcatggactggcacagtggctcatgcctgtaatcccagcacttttggaggccaaggtgggtggatcacctgaggtcaggagttcgaaaccagcctggccagcatggtgaaacctcgtttctactaaaaatacaaaaattagctgggtgtggtggcacatgcctgtaatcccagctacatgggaggctgaggcaggagaattgcttgaacccaggatgcgggggttgcagtgagccgagatcgtgccactgcactccagcctgggagacagagtgagactctgtctcaaaaaaaga

SEQ ID NO: 226035 - DNA, 362 bp, Homo sapiens
aagcctagtctgtttgttttttcctaaaagaaaagcagatgattcaactgtgtatttctcagtgttgatattgtggtttgaggtatttcataatcttgagtaaaatcttgtcaattttatgctatgccttgtgggaacatatttttacttttaagtctctttggcaagtggagcttcctttgtgtttcctcaccaaatgtattccccattgttttctgattaattctttttcagaatgtttactccttcttacctcaatgtcattacttttcagtcttggctttgggtaaacctaggacaagaattggatatccaaagccaatttcaatataaaaactataatatctatcaaaatctatgta

SEQ ID NO: 226036 - DNA, 586 bp, Homo sapiens
ttccagaattaggggaatccgtttgcgttgttttaagccaacaagtttgtggtattttgctgcagcaacagtaggaaacaaatgcagccatgaagtgaatgtccttctgtacctttgagtttatgtataggtttaaaaaaaaatgcccacctacactaatcaatacggacaaacatgggattgtctatgcgtattactttgtgatttctctcttcacctaatttgtggtgaacaacagatatgttgtgaacaactttctatgctatgtattttaatggctgctccctcgcttagcaatagttgatgcagtatttattttgtttttgtattcttttgctgatggaggctggccttgctggctgtacatttattttgttagttctgttctgtttttttgttgatacatcatatgtatcttgagagttttcccagtagtgttcatcccagaggatccaagaaacgtcaagttggttggaaggtaggttgtacaatggagaaatatttttttctccctgacttaaatttctgattgattaaaccacaacagatcacagcttaagatccattcgacagggctttcttcaca

SEQ ID NO: 226037 - DNA, 313 bp, Homo sapiens
ctctctttctccctctctcccagacctgtgagaccaaaccttaattaatgtaaacagctgtcaggagagctgctccgatttaaggaatggtcttgttttttaactgcttgttcagtgcaggtgaaggaacttttggagggttgggaatgtcaagctccctccatggataatttcttataaaaatgcggccgggcgcggtggctcacgcctgtaatcccagcactttgggaggccgaggcgggcggatcaggaggtcaggatttcgaaactagcctgaccaacatggcgaaaccccgtctctactaaaaataca

SEQ ID NO: 226038 - DNA, 531 bp, Homo sapiens
caacagcagaatgcacattcttttcacatgcgcaaggaacatttaacaaaataggccatattctgggccataaaacaagtctcaaacatttgaaatgattcaagtcataataaaaaagttatcttaccacaatggaattaagttataaatagtgagtaatagaaagagtcttagaaaaatctccaaatatttggaaactagataaggcacttcttaataacctatcagtcaaaaaggcaggagggatcagaatgtattttgaatggaatgaaaatggaaacccaacatatccaaatttgtgggtgccactaaatcagcacttgaaaggtttcaagtcaataacttcagcctctaccttaagaaatgagaaaaagaagagaaaatgaaacccaagtaagcagaggaaaggaaataatgaagatcaaaacagaaattaatgaaatagaatactgaaaaacaatggagaaactcaatgacaccagaagctagttctttgaaaagatcatattgatcaacctctaggcatggatc

SEQ ID NO: 226039 - DNA, 564 bp, Homo sapiens
acacagaaacattccaagcctgtggtaagttctcttgccctgaacctttaaatactcttagtctgtaagagagaatgctcctgaccaaaatcagctagaagtccctctctggtttattctccaaaataaacctgtttttgactgttgagtgacttttcatgtttttttcctctttctttaactcttacacccaatttattatctctgttattcagtgtaggttattcctattgatctatttttaattttgttcactgtatctttggtcatctccaatatgttgttaatttttatttcagatattgtattttttagtttttaattctcgtttgttcttttatagtttctatttctttgctgaagttcactatcttttcattcattatcaatatatttccataggtctttgaagataattacaacagctggtttaaaatcggtgctgtaattccaacatcttcaacaccttcagttttgcctccattgattgtttttctcttgagtgtggcatttttagaaatttctagtttcttagaaatctgagtactttggatttatattcta

SEQ ID NO: 226040 - DNA, 365 bp, Homo sapiens
tagctattattattattattgttgctgttgttttttgttattactactatggagagagaatacttaatgaattccaagtttaacatgcttattattctcagaatagatgcattgtgggtcaactcctgaattcataaaagtcccattctggctgttgcaaagcctgacataaagggaaccctcttttctattgagggaacgcagatgccaaaagtcacttcatattaaatatttgcatcattttttattctgatctccatgtgcgtgaagttttcagttttgtgtatgaaaatggctcttagtgctaacatttgtatttgtccatgaagagcactactttaaagaattaaactgaaaattttaat

SEQ ID NO: 226041 - DNA, 522 bp, Homo sapiens
ctaaaaacgttaagcgcctttttatacgtgcagctgtcgtatgggattcttatattgtaaaatgcctgtttacttcttttgctcattttctacttttctccttgtttccaaaaaattgaatcactgtatatataaaatctttcactctgtatttcaatattttctttcttaagagtatgttttgaaagacaatctttaattataatgtagctcaatttattattattttttcctttgggattaacagttttttgtctagtgattatttgccaccccaactacataaaaatattttcctccattgttataggttattcttttacttttgcatttagactgacaatctacctgaaatcaattcttgtacgtatctaatttaggtagcatacttaaaatatcatccttctcccttcactgcactgtcacctgtgtcataagtgaaaatgaccacatatggattgggtctatttcttgactctattaataaagtccattggcctgttgtttctatccttacaccaa

SEQ ID NO: 226042 - DNA, 376 bp, Homo sapiens
gacatttgccctaaccttgcagccttggaagatacgattacggcgcagagtgctgtcgccttaagcaggaaaggagcatacaatcttttgggggagataagacagaagaaacacatagacatacaaagaacagaattagaaaacatgctgagctcagcgagagagagaacattttggattgggaaagaagaggtgcctgcacctaaaaccaattatgtcttgaagagcggatagtgtgcgatagaagatggggctacccttcaggaaggggacctgccgagagaagtgagaaagagagaataggcaggactcttttttagagccggacacttagtcactaaacaatctttgttacataaaatacttaaatcagctt

SEQ ID NO: 226043 - DNA, 731 bp, Homo sapiens
agtagagatggggtttcaccatgttggccaggatggtctggatattttgacctcatgatctgcacgcttcggccttccaaagtgctgggattacaggcgtgagccactgtgcccagccctcatcacagtttttatttatttattttttaattgttttaaaaatctgaccaaacctttggtccaccctgactggacgtaaactatcctgagtgccactccctgggccccaaggtctggcctggtcctgccacttctcctctgtctgttgtctcttccagtagaggccccatcatgcgccttgccagccccagcacaagaaacagcttggtagaaaagaagggcgcacgggctttgggtgcaggcagaatcagaattcagactgctcaccgaaacccatcctctcgcgcttgccagctctgtgcccctgggcagatgatttagcctctctgtggcggtttccttatctatatgtttaggagggtcctctgtgagggttaaacaagataaagagccccattctgtgccaggcaacgagaaatagtttttgttttggggattttttttttaatgttaaatctttgcccttcaataaacatttgtagattgatttaatttttaagggttctctttggcagacactattcctgccattatttcaatgtggcctccttttcctctgaaagaatactgactgggggcaagtgacttgggtatttctaccaccacatggc

SEQ ID NO: 226044 - DNA, 117 bp, Homo sapiens
ggttgagggtgaggtctgtttattgccattctccaagcacctgtgcgtgctgcaggtgttgcaaggaaaactggtaggcgggtgtttgtctacacctaggcaaatcacacccaccag

SEQ ID NO: 226045 - DNA, 410 bp, Homo sapiens
agtgaatctgatgatggtggatttggggaaaaagccctagatagtaacctttgtcttcttgtcttttcactgtacacaatcccccttccaacttgttttaattacctggagctttaattatcacctatatgccaatgacttccaagtctctatacctatagtcctaacctctctcttgaatgctaggtttaaatttccatcagccagcagataaatctcccttaatataccatggataatttcaaaaacactttcaaaacataattgtgagaacttatttcctcctaagacacttgaaattaattgcccctctttgaggtctacgtaggtagtaaaaggccagggttgaccaaaacgtgaaatccactcagggtaaagaaagttttatttaaatttcttgtaaagttaaa

SEQ ID NO: 226046 - DNA, 464 bp, Homo sapiens
ctgataattgagttattaaaagatttggtttccttgggcctataaatcaataaacagtaggattaacgcaatagtttgccttttaagtcaagggagacgtttaaggcaagcccctttgagctttgttttcaaaccaaacaggtgagttgcagctctccccccggcccctgcactcttcagacatttggtccctgcccactcctaaacgctcagtcccaaaacaaaatagcgaaagacaggaggagtcaggatgtggcagtgctgccttcacactttccacttcgcaagttcttttaaaggttccaaagatctccagaccattctctgccaaaccctgccgcctcctgcacgtattgcaggtctctggggagcaagaaatgtcctgtttgggtgaggattccgtcacctaaaaagatctttaacttctcccccaaagtgggaaggtaactttctcccccttttcc

SEQ ID NO: 226047 - DNA, 978 bp, Homo sapiens
acaaatgaggttaattggacatgaataattcttagcaaacatacgctacatactgatcatcacttttatttttgtaagtgattctgaccaatcttttaaaaaatgtgatctacaattctgctagacaccaacgtaagttatgaatctaaagttttcgaatttaccatttccccatttttgaaaatggactctgtggcatgcttccccctctccatgacttttccaagattactcccaagtggttttatcatcacactggcatgttctttcaacatgctcaagaattcaggtcacttaaagcagttaggatttagagtggcttaaggaagtgggtaggtgttctgtgtcaactagatggtgcaggtgatgatgtggggctgtcagcaatgcctagtcctggaatatttcatggtatttcatggtcttcgatgaaggtggcattattctcttgtatgatgatatgcccacagatggactctctcagaaatggatgctctgatcagacacgctgagactttctcacctccacataactagttttagctctcacagagtgtgcctttcatgaactcaccattcttaaaacaggttcaacgctaatctaggtgctaacgtaaatttaaaaatatttcacttagcatataaaatactgcaggtatgcactcacaaacaggggattcaactagagaaagcctgaatagcacttgtgacacgcaagaggaaaatgcacaccctgaattaaaaggtcttcagaaaaaaagcagaagaaagttaccggagttcagcaacactaaggcggccatgtgcattaacgagctcattaagagtagggctttctcagttaatatttgaaagccgtagccttctagagtaaatgcataattccttgaactttgataatttggcgctgggacaatgaggcacttttaaatcacttaaaaatctgctttgaaccaagaacctcctctggatcatttt

SEQ ID NO: 226048 - DNA, 485 bp, Homo sapiens
caaagtatttaacattttactaggtggaatcaatgaatgaaccaatgactgccatagaaccattccatttcaaagccagaaggcacctttgagaattatttcattttttttttcaattatttgctttaatccttgtttttttgttagaatgaaaaaatgaatgtccagaaagtcacaaagcaggtttgaggcattgctgggagaagcctccagccccctattggggtaagagtcagctgttctctctaaattgtctggagagttttatacccattgtgcacacctacaaagcatgcacaaaccatagctgatcattctgcagttattcatgtcataggaaaatgattagctgtggtatacccttatatgaggtagtgaaaatatattttaccttataatatattgattatatattcacttcaggcactcatctaccatatataacacaaagttcacttgaattatttgcattttggaaaagcaaa

SEQ ID NO: 226049 - DNA, 384 bp, Homo sapiens
agagttaagagatcagaatttccataatcattttgagacatattgatgccaagttatgcttatgctttaagagtttttcttaatgttttctggggtcataggtgcctttaagagtctgagaaaattttttgtgcagctttccattactatgcctaaccgcaagattttacatatatttgagggtcttcaagattccttgaaggctatcccttggacccaagcttggacccaagcttgggagtacttgtgctaacatgcaataatggctctaacattaaaatttaagctgtagatttggtctgtcatgtacactgctttatccccagtgcctagaacagtgcgtggttcataatcaacactcaataaatatttgttgaatgaata

SEQ ID NO: 226050 - DNA, 515 bp, Homo sapiens
agaacctccgaattccaccctgaaagtggagtctagtctgatcaaatgtgtgggacctgcttatgtggccctcttcctgttcatcacaccttaaccctgaagggcaatgagcaaacacaatgatttgccaaacagcagaagggctcatgcccatttcgtgggagtccccagctggaccctgtacaaaaaactgctttagagactgctttaaggtgtggaaggacttctgtgcaaggttgcagctctgttaggagaagcatattagcactgacctaaatggccatccaagtatggttaattgcattgtcgtatttataattccttgatacagaatgatctctaggttaagttaggcacaagaggaagacatgtacaactctgtgtggtgggccaccttgtgtgttttttgaagtgtgtgaataaatatgtgtattacacatatttacatgcacagaatctttgagagggtaaaatgatgagaaactgtacctttaagaagggaaactaggggcagg

SEQ ID NO: 226051 - DNA, 631 bp, Homo sapiens
aaaattttaataacttaggaatacaacagtcttgttaaaactgacatttaataataaaaatctaaaaagcatggtaagttatggcttaatctcttctgggtagagtgatatttatcacaaagtagtttacatgcacaaggtctagttaaaagcttttaatctcttataaaatttccaagtctggtatcttaagtaccactcccctgatccacaccactgtactttcacgattactaggaataaatcttctgaagtttatgatttctctcagaaacaagagacctctttcagattactgggattcctgaagtatagttatgaactgagtggcctatctagcatcggggacagaaagattcatttctcaaagagattttggggttatatatttttgaccaaattcaccattactcatttggcattttcgaccatcttaacaaatgcagactatgaatcattaaaaagactcactaaacagaagtagggtaatgtgggaaaaacaatggaccacagggttatagtgcttaaaatcctggctttgtcattttctgtgtcatcttagacattatcctcattgagtctcagtttcttcatatgatatatatttttaaaaagatattagcagctgtct

SEQ ID NO: 226052 - DNA, 559 bp, Homo sapiens
cagtggctcacgcctgtaatcctaccactttgggaggccaaggcaggcagatcaagaggtcaagagattgagcccatcctggccaacatggtgaaaccccatctctactaaaaatacaaaaattagctgggcatggtggtgcatgcttgtagtcccagctactcaggaggctgaggcagaagaatcacttgaacctgggaggcggaggttgcagtgagctgagatcgcaccactgtactccagcctggcaacagagtaagactccacccactcaaaagaaaaaaaaaaaattctgctcaccataagctatcattaaggaaatgagtaggcacaaaggactcatatccagaatgggtaaataactcttacaaatcaataattaaaacaagaacaaaacttccaaattgcccaagcaacaaggaccagatttaccctcctgcataaaacaaccaaaaaataaataaataaataaaactcaagaaacaatggtgtatttattagtccattctcatgctgctacaaggacatacccgagactgggtaatttataaaggaaaga

SEQ ID NO: 226053 - DNA, 337 bp, Homo sapiens
tcagcgtaatactgggctcagctgaaactcaaactcaaaatgaattaaagacttaaacataagacctgaaatcataaaactcctggaagaaaacacaggggaaaagctcctagacattggccttggctatgattgtttgaataggacatcaaaggacatgcaacaaaagaaaaataaacaagtaggactacatcaaactgaaaacttctatacaaaaaaggaagcaatcaacaagatgaaaagacttcctatggatttggaaaaatattttcaaaccatatgtcttttaaggggttaatatttaaaatatataaggagctctcacaattcaaaagca

SEQ ID NO: 226054 - DNA, 380 bp, Homo sapiens
cacccatctcttctctcctagtgctgctgggaaaagatgactgtgattacaaagcatctctctccttaccatgagctcttagaagaaaaggtatcacagagaccaggcgtacttgccaagcttgtgaatttgggggaaaggataagtggggagattcctgggttgctgctgtgcgtttacttcttgaggtagctcctctcaccaggtgaagtgcaagccagtttcatttttgtaccttttcccaagctcctgtggctacaagcttgctacagctgcaccttctagactctgaacacccctccacaccttttcttttcttttttttttttttttgtaaaatatatatacatgtacaataaaatgcgaaaatcttggttgta

SEQ ID NO: 226055 - DNA, 291 bp, Homo sapiens
gaggcggccacccggtagcttgggcgggttccgcccacctcccgcctgtatttacagcccccttccaacatccccgactccctgagggcgcccctcattctgctcggccttgccttccccattcggccacatcctcctctctcccaactcagcttcgacccccaaagcctttccctaaccatcggaaccacaggcttttctccggcctctgagtgccagtcttcaactaggtgtcttttaaaaaatcaaaaagcatctcatcctacgggatgtgtgtgaaaaaataaaaat

SEQ ID NO: 226056 - DNA, 473 bp, Homo sapiens
cagtcaatgaatattatctgctattattatctaataaaattgtcataatgatcaaattagattacttttatgaaagaacttataaatccagtggcagccttgatttagctgtgagaactacgtttgaatctttgctctactacttaggcataaatttcgtttagtctctttccttttctggatatcaggttcttcatcagtaaaatgggaaatcatactcatggagtctcatggggtgttctgaggattcagggaattcaatgagaatcatttcttaaactgcaaagtattgtgtcaattttacctcttattattgttctcctgaaaaattacagaacttttccttcaaaatggtcaacaattttattttatattgtcacactaatcagaactggttgtagaatatttgtgcctttgaatgaatacgtttgtttaacttgtactcatattgaattataaactcttgaagaaga

SEQ ID NO: 226057 - DNA, 389 bp, Homo sapiens
aataaaatattactttactagtgctcaaaaaaatgtagactaaaataatgagctacaaattataatcatgtaattgtcagactgaaggcaatgataataaccaatgttgtgagaatgtggggtaacaggcattctcacaaacacgtggttctattttcaggctattgatgcctgataatttggtaccttgtacttagttatctatttacctacttatagaatactttttatcggatctaagtgtgttttagaattccttggatcctggctgggtgcagtggctcacgcctgtaatcccaacagtttgggaggctgaggcaggaggattgcttgaggccatgagtttaagaccagcctgggcaacatagcaaggcccgctgtctttgcca

SEQ ID NO: 226058 - DNA, 400 bp, Homo sapiens
tgaagcctcaaagtgctccatgctgtctgctgaaatgtgttttataatacatttttttccacaaatcaaaataaactagtgtaaatgacaatggaactagaaaagctttgctctttataaaaagggacgtgtgagattctttgaaactgagcgctggcggagtctgtactctctgaccctggaggaagagatgctgttctttgaaatgagggttttctttctggaagaggctttgtgagcatggaacagcaaagcccaggataggaactgagagaggtcaccgaagtgtagacaccctggcctcagtctctggagttcaaaaaggctgcagtcaattgttggaatttcttttcacatgaagaaatctacattctgtgtaaataaaccactttaaaaatgt

SEQ ID NO: 226059 - DNA, 2455 bp, Homo sapiens
caccctggcccgctccccgcgccctccacgggtaacggccccctctctcggtgctcagaaaccggcggtgtcgacaggtggctctcgcttggcctccttgtctgcaagcctttctcctagagatctgtgcctcctggcgaaccatgggagacctgccgccctaccctgagcgccctgcccagcagcctccgggccggaggacttctcaggcctcccagaggcggcacagtcgggaccaagctcaggccctggcagcggaccccgaggagaggcagcagatacctccagacgcccagcgaaacgcccctggttggtcacagaggggcagcctgtcccaacaggagaacttgctgatgccccaggtcttccaggctgaggaagcccggctgggtggcatggagtacccatctgtgaacacgggctttccctcagagttccagcctcagccttactctgatgaaagcaggatgcaggtcgccgagctcaccaccagcctaatgctgcagcggctccagcagggccaaagcagcctgttccagcaactggaccccaccttccaggagcccccagtcaaccccttgggccagttcaacctctaccagacagaccagttctctgaaggtgcccagcacgggccttacataagggatgaccctgcccttcagttcttgccctctgagctgggcttcccacactacagtgcccaggtgcctgagcccgagcctctggagctggccgtgcagaacgccaaggcctacctgctgcagaccagcatcaattgcgacctcagcctgtacgagcacctggtaaatctgctgaccaagatcctgaaccagcggcctgaggaccccttgtctgtcctggagtctctgaaccgcaccacgcagtgggagtggttccaccccaagctggacacgctgcgggacgaccccgagatgcagcccacctacaagatggcggagaaacagaaggcgctgttcacccggagtggaggcggcactgaaggcgaacaggagatggaggaggaggtgggggagacaccagtgcccaacatcatggagactgccttctacttcgagcaggccggcgtcggcctgagctcggacgagagcttccgcattttcctggccatgaaacagctggtggagcagcagcccatccacacctgtcgcttctggggcaagatcctgggaatcaaacgcagctacctggtggccgaggtggaattccgggagggcgaggaggaggcagaggaggaggaggtggaggagatgacggaaggtggcgaggtcatggaggcgcacggcgaggaggagggcgaggaggacgaggagaaggccgtggacatcgtccctaagtccgtatggaagccgccgcccgtgatccccaaggaggagagccgctcaggcgccaacaagtacctgtactttgtgtgcaacgagccgggcctgccatggacgcggctgccccacgtcactccagcccagatcgtgaacgcccgaaagatcaagaagttcttcacaggctacctggacacgccagtcgtcagctacccacccttcccgggcaacgaggccaactacctgcgggcccagatagcccgcatctcggccgccacgcaggtcagcccgctgggcttctaccagtttagtgaggaggagggcgacgaggaggaggaaggtggtgctgggcgcgactcctacgaggagaacccggacttcgagggcatccccgtgctggagctggtcgactccatggccaactgggtgcatcacacacagcacatcctgccgcagggccgctgcacttgggtgaaccctttgcagaagacagaggaggaggaggacctgggggaggaggaagagaaggcagatgaggggccagaggaggtggagcaggaggttggccccccactgctaacgccactttcagaagatgcagaaatcatgcacctggcaccctggaccacccgcctgtcctgcagcctctgcccgcagtactcagtggccgttgtgcgctccaacctctggcccggggcctatgcctatgccagtggcaaaaagtttgagaacatctacatcggctggggtcacaagtacagccccgagagcttcaacccggccctgccagcccccattcaacaagagtaccccagtggcccagagatcatggagatgagtgaccccacagtggaagaggagcaggctctgaaagcagcccaggaacaagccctgggagccacagaggaggaggaggagggcgaggaggaggaggagggcgaggagacagatgactgaggcccaccctctagccactttccccaagcaggtagatagcaaatttccccttagaggtagttagcatggattatattttcactatgtgcttcctgtccccagagggcagggatagaaaaggaaggcaactgcttcaaataaaattcctccacggcatt

SEQ ID NO: 226060 - DNA, 339 bp, Homo sapiens
aaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatc

SEQ ID NO: 226061 - DNA, 430 bp, Homo sapiens
cagggttctcatgattttagatggcacacagataaactgagagtgaagagactcagggttcggttgatggaatagaactaaaggagaaggatgtaggaaggaggggcgagggcctctttacattcactgtccgctttacatttttcctagaggcagatgtacccaagagagatattttggcttttggagtgtggccttccctcagtgcatacactatatggaatttaatcactcttagattcttagaaaatatttttaacattcaaaatatatatcaaattataattgctccatctttgatgttttggaatatacttaaatccagagaataacaaaatttagggcagaattttttttttcatatcataccaagagtactgtatagaaatccaaggtactgcatgatggtctgtgcttaactatgacaaaa

SEQ ID NO: 226062 - DNA, 425 bp, Homo sapiens
ggtcttcaaattgtattctgcgtaatacaggtttaacataatgttatcgggacatacagatagtcctcaacaaagtttcaacttaaaacttttcaacttttcgaatggtgagaaagcatacctcaagtaactatacaaccattctgttttcagtacagtgtccaataaactacatgagatattcaacactttgttataaaacaggcttcgtgttagatgagtttgcccaactataggctaacgtaagtgttctgtgcacatttaagtaagctaagcgataatgttccataggttaaatgtattaaatgcattctcaatttatgatattttcattttacaatgggtttatcaaaatataaccttatcataagtcaaggagcacctgtaattaaaaacattaaaaataacatttgtgttaccatatt

SEQ ID NO: 226063 - DNA, 396 bp, Homo sapiens
tttcacagatgagcaagctgaggttcaaggaagaaatctgctaaaggcacacagtctcagcacctagactgagaccctggactcctgctgtcattggccaaggcatactctgactctttatatttccatttgtctcctaaatttgtaattcccatgattacacattgagatgactatttctaagttttcctaaaaataagggtggattacttgagcccaggagttcaagatgagcctggccaacatggtgaaaccctgtctctaaaaaaaaaaaaaaaaaaaaaaatttacaaaaattaaccaggcatgatagccccacgccctgttgtcccacgctatctggggaagagcttccctccattttcttaccggggagatcctcctaaagtccgacct

SEQ ID NO: 226064 - DNA, 431 bp, Homo sapiens
tgagaggtaggcgtatcttatcacctgtcacagatgagggaactgagagcttaatttccccatggttgtggggctaataaatttccaggctacgatttaagcctaaacctgtttgacccaaaagttaggttcctaatgacattgctatgtgttctaccaaacccccagtaggacccttgtgataactaaatgacataacatttgggaaggtactttgctattggtaatataccgtacatgtgtacctcaattaaacaaatattattattaccataatgaataccacaggtttgtccttgggaagaggaatattctgattgtctttccttttgtcccttcactgaccatacagcatatacacgggaagcctttaaagcattgtggttaagcatatgggttttaatttaaataaatgggattcaacttcaact

SEQ ID NO: 226065 - DNA, 367 bp, Homo sapiens
cagctatttcacaggagagtgcagtatcaaatttaggtttttctggtcccaaaccctgatgtttcccccacatcattgtttctcagacttggctgcaatcacctgaaaaattttattaaattctttttttttttttttttgagacagagtctcgctctgtcacccaggctggagtgcaatggtgccatctctgctcagtgcaaccactgcctcccacgttcaagtgatcctcctgctacttgggaagctgaggctggagaatcacttgagcctgggaggcggaggttgcggtgcactccagcctgggcgacagagggaggccctattccaaaataaataaataaaggacacattcttatcagcaaaa

SEQ ID NO: 226066 - DNA, 455 bp, Homo sapiens
ggcccccggttgtgtgtgttgtgtgcgtgtgtatttggagaaagaccattcactgaaaggaacggggccagtccttactccgtggaactcagacctctcctcttcgcccacaatcccctcagaaatgctagagggaatgtctactgagtcgaaagtcctacagatttgtctctgttccttcccattgcaaaaccaaatcgctttcatgtttctgggacccactctttcttcacccagacataaaaagagaaaacgtgtgcagtgacgaccagcggaacggaaggagcactggactgagatttaggaggcctggctcctacgccttgcagtttcttcatgtcgtgtgcaaggtggtaaacactctgcctgttttctcaccttcaaataatacctacctctcaggactgttgagaaatgctgagtatactgagaaaaaaaaaaactaaaaaactgga

SEQ ID NO: 226067 - DNA, 162 bp, Homo sapiens
caaaccatcctccatccccgtcccatagaaaattgatcttccatgaaaccaatccctagtgccaaaaaggctggggattgctgccttatatcatatacaaaaattaactcaaaattaatcaaagacttaaaagagttaaaaatataaaactattagaagata

SEQ ID NO: 226068 - DNA, 467 bp, Homo sapiens
ggactctgcaaggtacccgaggacaggagtcactgcttgcatcccctcagccttggggcaagaagaaggagccagaatccaggaaaggggctttggcgaaactgcacggaaatcattccttccgtttacgtaattttagttttaagtgtagcagccggggagaaaattgtgaaggggagtgagacaagcgttcgattacttagccaattgtagtgcacaactgaagttgcagacctgaagaagccgccgcattgccatggcaacagtacagggactgaatctctggtttatttcaatttcatatctacccggtagaggcccaccaaatacgatccagcccctgctctcaaggagaagtaaggaggacagtcaatcgataaatattggttaaactcctactgtgcaggcaacctactggacacggagatacaattatgaataaaacactgctcttgctctcaagcaaa

SEQ ID NO: 226069 - DNA, 149 bp, Homo sapiens
agaaataagaaaatacaggatatgagtgaaaatttatccaggaaaatagatatcataaagaaaaaacaatcacaatttctggaaatgaaagacacctagagaaacacaaaatgcaatggaacattttaactacagacttgaacaagtat

SEQ ID NO: 226070 - DNA, 300 bp, Homo sapiens
ccatatttgcaaaacacaaaagccttttaagagttaaggggccaatatattatacctttctcccacttttgagtttagagccaattgagagaagtacactggggtcaaatggggcagatcaaataccagcttaattattggtgaagttagaatgggaacccattttgcatttgtagtctgaacagactttctataatcctctcctagaatgaaagtaatcatctggaattgaagctgtccccctgcaggagcttaaaaatgtgtgtgtgttttgagtaggtggatgccagagagaaaaaa

SEQ ID NO: 226071 - DNA, 565 bp, Homo sapiens
gactatagcttattgtaataagtttgtgtacaattagagtatggatcatatgtgtgttcaaagggcaggaaggctagaaatgaatctggagaagtaagacagaacaagattaggcacaactttatatatctttatatatcctcctaagaagtttagcagcatatcttaaaaacaatgaaagcccctggatgcttggataatgctcacctgtagtgcagctactcaggagcctagaatgggaggataccttgagcccaggagctcaagtccagtctgggcaacatagtgagaacctggctcaaaaaaaaaaaaaaaagccattgaaaaggaaaacaaacaaacaaaaatacatttatgattaagaaggagggtgttataataagattttctttttagaaagattagtctggtgtggcagtgtggaagatagactgggtactggggtagagatgggggttgttggaaaacaaaatcaaagccagcagaaataggacacttacaagtaatccaggaaagaagtgataaggactgaaacaaagttagtggctgtagcaagggaggggag

SEQ ID NO: 226072 - DNA, 387 bp, Homo sapiens
agaacttaaagtataattaaaaaaaaaaagaaaatacaaagatcagcagcttgaggtatgtgcatttactgtctaggtagacatgaatgaactctagagttgtacatttctttgtcttcctggatacttacaatggctagtacatttccctttctcttgaccatgatagacacttgtgccgaaaaatagtctggcacacatagatctgcactggcttagagggtggtccagatgagtcccttctcttggcaagcttcgtagaggtgacttatcattttcaagaaggaaacatgaatatgttaatatgtgttataaatagaacacaagccattgcatatgtaatgaagcctttaaatgaggaattgtaagtgctgtaggaattcaaag

SEQ ID NO: 226073 - DNA, 432 bp, Homo sapiens
ctcgagttggagctgcaatctggtcctgcctgccgtctgccatgatgccccggaaatgtctagtactttttaagttggttgctatgagtaaccagagacctttctcctggtgatattccctcctgaattcccccttcttactcttatcctctgtattcattctctattgctgtgtaacacattacctcaagctcagaggcatcaaacaacacaaatgtattgctggctcacagtttctgtaggtcataattatgggctcaactgaattctaagaaagctgtgatctcacctgaggctcagggttctcttctgagttcactggcttttgacagaattcagttccttgtggttgtaggactaaggaccccattttcttgctggatatcaactggagtccattctaagcctctagattccaccagccaaggccct

SEQ ID NO: 226074 - DNA, 491 bp, Homo sapiens
cagctgcgacagcaggggttgtagtttgttccactaatatttctgttatgtttcccccagaatcctggaatggctgttcccaggcttttttcaaagcaagtggatctgagcggggcaaagggtgaaggcaggggacactgtggtatgcattcactcccccaggtactgggttgtcggcagctgatatttcccaactgagacctgctacaggaattgcttgaggctaaagagagccactctcctcaaggccacatcctcctccctaatgagagctacacccaataacccatcatggggataaaaggactcaaccctctttgcttcagtttggaacatctctgaagggccattccagcttcatagctcccagcgcatttgtcagagaactctgttgcaaccacatcacagtccagctcccccctgcctatgtattgcttccttcacacagatgttgatcccaggaacacttcctaatacacccgctttcagca

SEQ ID NO: 226075 - DNA, 457 bp, Homo sapiens
agcgcctctccatgtctctcaaagaaaaagtcaaagtcttaaccatggctccaaggctacgtcaggggtcagcaaactaaagcccacagccacacgcattcaattgccctatctatggctactatctgtctaccacggttcacctgcggctgcccagcactgccacgaagacatcaagtagccccatgaagaagccagcagttaacaccacactgccagctgtgtgaggctccaccttggaacgggggtccccagcacaggtaagcctttggatggcatctgactccaagtggaaactccagctgaacttttccccagcgcctgacccacagactccatggccatcatacatttattttgaaagaaaaataatggtttttttctcatgccactatgtcttgccacagaactgtgtgtaatctccctctgtcataaacatatctgtatacacattgaa

SEQ ID NO: 226076 - DNA, 787 bp, Homo sapiens
caagcgaccaataagcctattaaaagatgctcaaacctcatgagtctagaaaggtgcaagttaaaccacagtgaactattgctagaattgttgctaggttggttaaaatgaaagagactgatgttactcagtgatggtatgtggaaccatagtaactctcatcccctgctagtggtagtgtcatttgctgtatccactttagaaaaccatctgacattattggctaaaagtaaaaatagaaacaccctcttcctcaacagttatattccttgatacagacatcagagaatgtatatgtacatgcaagaatgttcatggcagcatttcttttaatagtcccaaactggaaacaaatgtccatgaacagtaggataggtaaataagtcatggtctagtcatacaatggaatcccaaacagagtttttaaaaggacagagtaccactacagtggaaaaacacagataaatcctatagacataagattgagtgaaagaaaacagtttcaaaggagtaactatgtatgattccagtatataaaatcaagaacaggcaagactagtccatggtgatacaatagtgttaccttttcgggagagagggtaattgggaaggggacccagggggccctctgaggtgctagaaattttctgtatcttgatttgggaggtgggtacataggtatgtatgtgtacaaattaattgagctgtacgttgaagatttctgtaccttactgtgagttgtatttcaattaaaagtaaataaaaaggaaaacattgatacttttca

SEQ ID NO: 226077 - DNA, 561 bp, Homo sapiens
caagcgaccaataagcctattaaaagatgctcaaacctcatgagtctagaaaggtgcaagttaaaccacagtgaactattgctagaattgttgctaggttggttaaaatgaaagagactgatgttactcagtgatggtatgtggaaccatagtaactctcatcccctgctagtggtagtgtcatttgctgtatccactttagaaaaccatctgacattattggctaaaagtaaaaatagaaacaccctcttcctcaacagttatattccttgatacagacatcagagaatgtatatgtacatgcaagaatgttcatggcagcatttcttttaatagtcccaaactggaaacaaatgtccatgaacagtaggataggtaaataagtcatggtctagtcatacaatggaatcccaaacagagtttttaaaaggacagagtaccactacagtggaaaaacacagataaatcctatagacataagattgagtgaaagaaaacagtttcaaaggatttattaattagtgtattcccgcgttacccagtcacgagcgtctgtgcaac

SEQ ID NO: 226078 - DNA, 210 bp, Homo sapiens
gtgaccagaatatgaatgaaggaaggtgtgactggaatgtgatttataactgaagaaaaaaaatgtaaacaggagaatggtttgcctggcacctgtaaaggggagacaccaaactacaatttagtggtattcatttaacattggccaggagagtataccctaaccagcagacaggaattccccttggcatgtataaccccaaagctatta

SEQ ID NO: 226079 - DNA, 554 bp, Homo sapiens
acttataaaaacccatctcagtgatcatagcagacttatacttttcttattctatacacagcaaggtatagtatctctaaactataattcctgcttagacaagattaagagtcccagtgactaaattttaattatgattcatttagacaagccaagacatacaactagacaaaaagtaaactgctgacttaagagatttaataatacaaaaacacaataaagcctgccaggaaacagtatttccctcctcggctttaaatagcaccaagcctggtcactttaacagacctcttcaccccacattttgtatcaccaagaaaaaaaaaaagttaaaaacttgagggcccagtccaggttttctacctaaaaaaggcaaatcatcagcctttgggcaacatagggagaccccgtctttataaaaagtaaaaaaagaaattagccagaagtggtggtatacgcttgttgtcccagctactcacaggtgaggcaggaggatcacttgagcacaggagttcgaggctgcagtgagctaggattgcgtcactgcactccag

SEQ ID NO: 226080 - DNA, 523 bp, Homo sapiens
aacagtctgggttttgccatatctttaccctgctgaggctctcagaggaggatggatgacattccacgtgatgacacaggctgatgaccctctgggcatccaggcacagaaggcaggggctctggaggtgaaagttgccttcactctcatggccctttaacgaaagaccttgtcttacccatgttaaattcagtttggtttaaatgtttcttcatacatagtgaactatcacctaactggatgtgtaaacaggctataaccaactctagtaccaatctctgggtttcagccaatcacagacagccaactcttcaaaccatgttcaaagaaggcaaacgccaagctagaacccatccagctgtttctgttccttacttctgttttccatatgtcactctcttttttctgcccataaatcatcctcgaccacgcggtagcctggaagcatctctgaacctattctgttttggggattgcccaattcaagaaccatttttcactcaattaaattctgttacattta

SEQ ID NO: 226081 - DNA, 338 bp, Homo sapiens
taattttgtttattttttgtagagatgaggtctcattatgttgcccaggctggtctcgaactccagggctcaagcatccctccttccttggccttccaaaagtgttggaattacaggtgtcagccaccaggactggccagctgttgatttttatttaaattttataattaaccatcagactctttttctgttagtttttggttggttctcttgaatttttaaagtatacaactgtgtcatattaagatagtgttcattttgtctcttcctttctgataatgtattcttgtttttacgcttgcttatctgattgcactgagtggtatttcaagcgcaat

SEQ ID NO: 226082 - DNA, 534 bp, Homo sapiens
gagggtgggcggagttcccgcggtggccccgcccctggctgggggcgcccgaagcaacccggcctcgcttgtggggagccctacacccgcggccagtccgcccctgcgggggaaaatgccggagtgaaactggagcgattgccgccccgccacgtgacggtcccgcatcggcgacctggaagcgggtgagctgccgccgcctccaatctctcccggcgcagggggccgggatgcggccatgcggcggcgcgggaggcccgagagcggggctcaccctcctcagactctgcggcggagagccgagtgatgaataaatgagtaaccacatcaatatttaagtgttcactcggagccttggggccagtgtgtcacgggttgggggaaattacaggccctggtggggggttaaataactacttccacccattattaagtgcctactgtgtgccagggcctaagtattaacgtatacttggtttattattgataataacgatgtttagtaattatagatgctgaatttcagccaactct

SEQ ID NO: 226083 - DNA, 628 bp, Homo sapiens
cgaaaaacccgctctgcgcctccaggccaatcccacgtcttccttctaaaagtccctgctccggaaagccctctccgtaaaagggtcccggcccgcagttcctgggatggccagcctcttggcgcggacttggggtgatggggacccccgccgctcccctgaccccgggccgcgctctcccctcctccagtccgcccctgcgggggaaaatgccggagtgaaactggagcgattgccgccccgccacgtgacggtcccgcatcggcgacctggaagcgggtgagctgccgccgcctccaatctctcccggcgcagggggccgggatgcggccatgcggcggcgcgggaggcccgagagcggggctcaccctcctcagactctgcggcggagagccgagtgatgaataaatgagtaaccacatcaatatttaagtgttcactcggagccttggggccagtgtgtcacgggttgggggaaattacaggccctggtggggggttaaataactacttccacccattattaagtgcctactgtgtgccagggcctaagtattaacgtatacttggtttattattgataataacgatgtttagtaattatagatgctgaatttcagccaactct

SEQ ID NO: 226084 - DNA, 282 bp, Homo sapiens
gtgaatttcccccactttctttcttttttttcttctgttatttacattcccacaccatgccttttgggcaaggacttcttaggagctaagccaaatatccaagtggcagacatggtgtggttctcacaatcccttctccctctccaaccctggacctgtgtcctcaagtcatactctggcacttaggatgagtcttttcataggattccccttgatccttcactcaaccttaaaggactcacctctgttatcctgcagacatgtccagatcagctgattcct

SEQ ID NO: 226085 - DNA, 342 bp, Homo sapiens
gtatgtctacggtttgggcgtatgtatgtattaataaaaccacatttatctttcactgaattcttaagaagcttaaatttcccatcaagatcctattcagttatctaaacacttatgttcctatagaaaaacgtgtgggagagagtgggaggcaacccattttgtcatttcacttgtgtaatgtttgggtggaagattgagaagcgtttgtatgaactttcagataactagattgcacttgcttctcagtgtgcatatttaagattttactgtatgcacccagattgggatttgggtgtatgggagggatgaggatggaagtggagtggaagctgttatctg

SEQ ID NO: 226086 - DNA, 474 bp, Homo sapiens
aacaactttactaaggaatgactgacatacaaaaagttgcagatattgaatgtgtataacttgatgtgtttggaaataggtataccatgaaaccatcaaaccatcatcactatccatgccctgaacttatccactatctcccaaagtttcttctcccttccttttttttccttttgtggtaagagcacataacataaagatctagcaaatttttaagcatacaatacagtgttgtgaatcatgggccctatgctatacagtagatctccagatcttatttattttgtataactgaaatattgtataccctttgaccaacacttccccatttctctccctcaacagcccctagtaaccactattctactctctgtttctgtgagtttggctatgttagattgcacatataagtgagcttgtgcaatatttgtctttctgtgtctggcttatttcacttaacataatgccttcttc

SEQ ID NO: 226087 - DNA, 765 bp, Homo sapiens
aggccagcctgaccaacaaggtgaaatcccatctctactaaaactacaaaaattagccaggcctggttgcaggtgcttgcaatcccagctactcgggaggctggagacatgagaatcacttgaacccagaaggcagaggttgcagtgaaccaagatcacaccactgcactccagcctgggcgacagagagagactccgctgaaaagaaagaaagagagagagagagaaagaaagtggagagaaagaaagatggaaagaaagaaaagacggtgtgcttttgtttgctgaatgatgggattcagagcagccagtgttgtcttctgcaacccgcaaacacccatgggaaggagagcttgtctggttagttagatgactttggatagatgaagagtacaaatgcatggcaggaaaaaggttttcaaggcatgatcggttttcctttgtgagctgaacttggactcttcagaagtcctgaggatgggccagcttggcaagttttctccttttcagcttccagtgtgcactccttctttccactctcacctctgaatgctgtgtggaggcgctgatctgcctaagacccaggctgtgagccaagctgtttttaatgaccgtccttaagcttcagcccaacagctgttttacaggtgcacatgattcagcaactagctcactgtgagtgtatgatttaaaaggtgcatgtaaatcatttgaaaaggtattttaaatgctccagtgggctcgctatttaaaggaatccttcag

SEQ ID NO: 226088 - DNA, 247 bp, Homo sapiens
ctgaggagttagggaaagccaatataaattagtaaaaggttaacaataaattttattaaaaagcacagtttcatcattcaagtatgaatagaactttaaatcatgatatgtgttttctcattaggactttttggataatcctgatttaataattaggtaataattccatgcgaactgtctgcaaatgggaatttccaaagcgtctaaaactttattctctttgtatttacaatagctctcctatagt

SEQ ID NO: 226089 - DNA, 1431 bp, Homo sapiens
catccttcagattaaggtgctccaatataatccataccacagcaaacaaaatcctgaagaattctgctgccaatcatcttgcctcttaacctcaatataacaagaacatacataaaagagattaccgatttagtaaatgctatcatctcataccccattcacaccactggcctgtgatattcttcccctgggagagatgtcaagatttaatgagattctatcataacctgtagaaaaaatgagcaacatggaaacattccaattccagtcttaggtgagttccaatgaaattacctgaagaactgaactagtgcttttagttaaggggaaaagtgccctagcttttaaaaaatatgtctataaatctagttttaaaaacatagcaattggctgcatgtggtggctcatgcctataatctcagcattttgagaggccgaggtgagaggactgcttaaacccaggagttcaagaccagcctgaacaaaatagggagacccccatctctacaaaaataattttaaaaagctgggcatggtggcatatacctgtggttccaggtacctggagggctgacgtaggaggattgcctgagcccagcaggccaaagctacagtgagctgtgattgtgccactgcactccagcctgggcgaggagagcaagactctgtctcaaaaataaatacataaaatacagcgtccaaaagtgtgtcatcttctttctcttcacaattttataataagggggtaaaatgcctgtgagtctattcattatggaaaataaaaaagaaacaaccatttaaggctgaggcattttggttttctgctggcttttagattattaactgcattaagcccctcactacaacttcaccagtatcctagaaacaatttgggtttccttttaggcagggacaggaagtattcaaaggacagacatatggacagagttaggcccttcagggttgaagtctgtggtttcttgtgtctcaagactcaatgtcttgagaagttggtggaccctgtcctccatccaagaagtgctgccaaggaaaccaggggacctagcaaagagtcaggagaaaatggccaaaggaattctgacattccatacctgaatgaactgttttcgtgagtgctttgatcaccctatcccctatcaaggcgctgaacaggtggcccgcaggaaatctgctgtcgcaagaggagggctttgacttacttcccctaattgttgagtaaaaagtgattctcttaatttctgtattctgtttttcatatcaccagtagaagggtcctgtggatctaaatagagcacattttaaggctacagagtagtagaaattgatgtttagacaaggcagcttgttcaaaatctgaaaggcacacccagaagctttctctaaacattttggctcccattaaaaaaaaaa

SEQ ID NO: 226090 - DNA, 462 bp, Homo sapiens
tgggagccagcagaaaagccacctgttgtctgtaaggaagtacccacaggcctggctgagctcattacagcagagagccagcaacgcttcctcctcttagattccgtcatgttagacaatctgcctgctctccccactaaccgtcaaagttccatggaatgaacttgccactttttcaggatcctaaccaccgcactttcctgctacctctggcacttggaatttcagagacaaaaccccttttttaggcagcgagccctgattttcagttccaaagctatgggcactgctgagtgggaccagaggagtggtgtgcagtgagctacctggaggggttgcatgagaccatgtcccctctcctggatggaggtgtcttctggttgccaagaaagtattgagtgataatcagaaaaattccttgattttcatggtttgttgctttgtagcaggtcttaaggaaaa

SEQ ID NO: 226091 - DNA, 500 bp, Homo sapiens
acctgaacatagaacatgaccacatgagtccagaagacctgaagagaagtgtacagatttgggttttcttcccaaagaagaagaggtgggcaggagaaacttcttcctgcttgtggatgcagttgtgcgagaatataattcccaaagcaacaacagcagccactttgtgaccacgaggtaaccaacccaaatggaagccaatgtggtaaggaaggcagaacaaaatttgtttaatacagatttttaatgatcttattaagctcttcgaaccaagtttggaactaccttcctcagaatgaaaaaaacaaaaacaactgggaattctgtatccgagatgcttgtagcccgcctttctagcatagggtacattcactccagctggtttacctcttgctatcaaaatacatagggcctttgttggttgtttggatttcctctcagtgttgtgcagaccaacaaaatttgggggtatattaaagtaaatatgctttaaaattagt

SEQ ID NO: 226092 - DNA, 397 bp, Homo sapiens
ggctagggaagctgaacctgaagggatattcttctccctgccccctaacagttaggacgtgacacatgacccaggctcagccacctggccactattctctgagcttggcatcttcagcaagtgacatgaaaacatagagacaattttagaattattcatagcaacagagacagtaggtatgcaacagcagtggggccctggtggggtttgaggggggtggccctgccatgatgagggtggccatgccaggctgtacctgagacacagacttggctgtggttcccgttgccgagcctgcctaggttacagcccattttccatatccgatgctgcagttttcctgtcaactctttgtatcctttcagtaaatttcattttttcttaaatgaaaaaaaaa

SEQ ID NO: 226093 - DNA, 412 bp, Homo sapiens
gataatttcttacattttacatgactatgtatactaaagatgaagtactgctttcaagtacaattttaggtgcctatatggcttcatcctttgaatagcactccttcctccttttctatatatataaaaactatgtcagccttgaactcaaactaaaatttcttccattaaagggtatgttcattatttactgtaagatgaatgccctatggatttttaaacataagcctggaaaataggaaataattcactctggcttgaaaagggtggagatttctttgtttctttttatatttattcaggaaaagctgacaatcgtctcacattaatgaactacaccatcaatcactgtgttgacaatgagcggaaaagcgaggtatatgtcaggctaacggcatattgcctttttcag

SEQ ID NO: 226094 - DNA, 339 bp, Homo sapiens
ccacgcccggctgactttgcccatattctttatctaccttttcattcactttgtattgagttggagtttcaaaacatatggacaaaatacactatcatagttaagagtatggatttagatcagtttaaattcaaaccctacatttggaactgacttaaacgtctctgtcttgatttcctcatccacaaaatgggttattgggaagatcaaatgagctagtatgtttaaagcatatagaacattgtacaaagcatatagcacatagtaatagcatataaggttttctactactattcatagacaactatctcccctccaaattgtcactttagttatata

SEQ ID NO: 226095 - DNA, 233 bp, Homo sapiens
atatttaattttcttgttaaatttaaactcaaaaacctccccaggggaaaatgagtaaaggatgttgtaaaagaaagaagagtcaaaatggaatgatgagagtaccaaaaataggctgggtttagtggctcatgcctgtaatctgagcactttgggagaccacggtggaagagtcgcttgaggccaggagttcaagaccagcataagcaacatagcaagaccccatctctatt

SEQ ID NO: 226096 - DNA, 530 bp, Homo sapiens
agcatgcttgccctgggaatcattcaccaagagactgttaccgtggagtcaacaagggcctggattccaactccagctccctattggacaagctctgaacctgagtttctgcatttgtaaaatcaagataatagtgtgaacttcacaaggtttttgtgaaggttttgtgagacgatattagggtttcctctctttcttagatcatctaacttggctcttcatcattactaggccatcatctttgcttgtaccactcccctttcctgagtatcctcttcattcttttcagtcattcccttccctccttcagaactgattttatccaagagatctaaccccaggctaatcatttcttatttccatattctcctagaccaaattcatctaatctgttagcctatctagtttataatgcattattctgtattcatttatgagtagcatttgtggctttgtaattgtcttttattttcgtgatttgtctttaaggttaaatagtaaattcctcaaggacaactgtatcttctact

SEQ ID NO: 226097 - DNA, 403 bp, Homo sapiens
ccagccttatttttaaaatgcttcttaaatgtctttagagacaatattcatcacttggtatttattgttataagaagtttgaaaaccaacataatttcaaatgcatgttataaaaacaatcccactttaacatttagtattaacatttgaattgaactaccagtagagagtctgtcagctaaaggcatgaaaaagagcttgatatggaacaattcttaattctagaagacactttagaaatagaaggtaaaggccatatttatactgtcaaaatacagccaaagttgagagaaggtgggggatggttaacgggtacaaaagaaacataaataatcaataagatccagtatttgagaatacaacatggtgattatggtcaataaaaattgtacattttaaaata

SEQ ID NO: 226098 - DNA, 317 bp, Homo sapiens
gctatgattaacatctcatgtacattcaaataaacaagcaaactgtagaataaatcccagaaaatgttattagctttttgtacacgttatttgaggtctttgaatattgcgggagagtattggaatagaggacagagtgcagatggcaacacggaaacctgcaattactgatgtttttaaaaatgtgtgtcatagaccaagcttggtggctcacgcctgtaatcccaatgctttgggaggctaaggcgggagggttgcttgaagacagaagttccagaccagcctgggcaacatagcaagaccaaccctgtctctac

SEQ ID NO: 226099 - DNA, 466 bp, Homo sapiens
gcttcatcatggtgggcttttttcatattaggttttgttacctttgagtttttaaattatgtgtaaagcttcgattaaaaaaataaaaattattaaaaagaaactgagacagtctatccacctatctctatttacccagtgctgttgttgtgttacataaaattcaattttagcttcatgttcatgcaatattttcgtttacccttgattcaaccttgacctttaaaaagccaaaaagacaaatacctattttgacactggttctgatctctctgaaattctgtgtgaccaatggtcaagtaaccttgcaggttatttatcatgtctaatctgaaaaaagtcattgtatttactaatattttaatattcaccttataggtaagcattctaaacatgattgtggcaagaaattcttatatgctttacatgttgaaattctgtgtcaaatgaagtacatatgtatatt

SEQ ID NO: 226100 - DNA, 451 bp, Homo sapiens
attattcagaaagtgggtcattctatttggcattttgaattagtatcaaaatgagatctttaaagtttaccaaaataaaggaaaccacctttgtagtctgaaaaaaaaaactattatgaatactcgtgtataagtatttgtgtggatacatgctttaatttttcttgggtaaatacctaggagttgacttgctggggctgggttatatggtagatgggtacacatttagctctacaaaaaattgccaaaaaaggaagaggagggtgggggagaaaggaaaaaataattgccaaaatgttttccatagtggctgtaccattttgtattctccctagcaatgtatgacatttccagttgctttacatcttctattatacttgatatcatcaatttatttttatttttgtcattctcatggttataacaaggtatctcatgttggttttaattt

SEQ ID NO: 226101 - DNA, 398 bp, Homo sapiens
tctgctgattagctgtgagccttcaggcaagttatttaacctctcaggctaagtgtccccatttgctaaatgagtgtataataatgaatatcttcatgagattgttgtagaataaatgagataatgtactgtgcatggcctgtaggaggtgcacaataagtatttgataaataaattaatgcatgatctaggaaaagcactcagcacactccctgcaccttggtaagtgtccaacaaatggttggtatcaacgttgtttaaaagagcatagcactatttctagcagggcatgatggctcatgcctgtaatcccaggaatttgggaggctgaggcaggaggattgctgaggccagaagctcaagaaaccctggtcaacatagtaagaccctgtctctac

SEQ ID NO: 226102 - DNA, 449 bp, Homo sapiens
ggtatggccgtcaaacttcggcatatagcagggttgcctaggaagttgctcaaacaaacaaacaaacatatgtcctgaccctggaaattctcattcagcagtgtcaaagcttgggcatctagctttactttgaacacactctctagtaattctgatacactctgaatttgagaaccattagtgtattggaaagaactcaggccctttggagccatgaaagactggatttgaattctgattctgccatttatttgctatgtgcctggggcaaattacttacctctctgcaccatcatgtctaaaatgccaatcatttgactaacttatcaagtgatcgcagagaagtaggattaagcacatattatgctgttcttatagacaattttgcatttaacaaaattttagttcattttgcatagtaatctataataaatgctaaatgcaacaca

SEQ ID NO: 226103 - DNA, 138 bp, Homo sapiens
agatcctgagctgggagacaagcagggctgacatccattaggcacagtgccgagggcccacagtgcttttgggggcccatggaaatgttttaatttctttgtagaaacaaaacaatatataatatttttagattaaga

SEQ ID NO: 226104 - DNA, 393 bp, Homo sapiens
ggctttccaaaatgatgggattataggcgttaagccactgcacccgaccaactttgttctgtcttaaagtaaagtttattatatttatttgattatgatgcttctttgatttcttcttacttttattcatcgcaaaaatcatttcttgggaaccaaacccagtccctttaagaaaacaacctcgtagaaactgttaaatatagctgagttattttctgttatttcatctggtgagacaatagaatcattcctagaataagggacttaaggtttttctacagccaacatgtgatgggattttttacaaccaacatgtggtgtgttattagtgatgtcatcagagccataattaatatatgttttcataaataataaattttgacaaaacactac

SEQ ID NO: 226105 - DNA, 372 bp, Homo sapiens
aggcaatgggttaatggagactctagacatttgtttcctcaccagtgaaaattaaatgaagacccaggaatcactacagctatagggatgagaaggacatttcagcagctagagtgtggtggcctccttagcagcttctttttccatcaagaaaatatttctggacaaaaacaaacccatagctggttggaagcagggcattgggcccagtgttaaagatttgaataagaaagatgcagaagatattaatcataggcttatcaatgcccctaggagatctgtccccctgattgaagcaactctggcctttggaagttcatacccaagaagtatgatatcaatcttatttttaaataaagtaaaaatttgatt

SEQ ID NO: 226106 - DNA, 523 bp, Homo sapiens
agttagatacttttcatctccttccaattgtgcagttctcgaggaatcctgcattgcctgtttctggactggctgcctgggagggagcctaaatcccttcctgtcttagagcatttgcagcagtggggttggagcctttctcagttttgataagtaggagctgtttaatgttgtatttgcttcacgtgttgatgctgaacgtgggcgcttgaaaccaagtttgctcttggatccatctcggaggagcccctgggtccgtccagggtttttttgcagcgtgtgcggctggtgctgtgtgtcacagcatgcgaagaacccacacggagatgatcaggctcctgaactgaacctcaagaacccagtgaacaagacctacatgaggctcctacaggatcccttctggccctgatcattccttcatcactgttaccagaaacggggaggtgagggtaggaggtggtcagatggtgccgatggctggtgcagctggtggcagaggctttgaaatccgacccctttcaca

SEQ ID NO: 226107 - DNA, 414 bp, Homo sapiens
aaaacagacacggagaaggggtgaggatgagcccgcacctctgaaggtcagctttgcactgcctccgactcccttgctgatgtgctggtgactcacaaaagagctggctcctctctgtgcctctgtttacccacctgccaaggaagagcctgggttgcgtgatgccgaacaccccttttcagctctcgtattggtgggtgcttacagtttattttctcaggaacctctctgatttcttatatcagcaagaaggtttccatcttctcttggaaaaagcccttccagctgcctggccttgcccaacatggggtgggacagtgccccagccctgccttagcagagacagccaccatcgtccagcactgaggccacctctaacagccccagggcagggcattccctgtaaagcaggga

SEQ ID NO: 226108 - DNA, 310 bp, Homo sapiens
ttcccataatctttactgttaatgctcataattagtcactttccctttaatggattcactaaaatttagcactttaatcactgcaaaaggactgcctacaaatagcacaaagcaaaatggaaaagttgtaaggcacaaccattttaactgatgaaggggacaaagggaaataaaattctcataagttatgaacaagttgttttttcatatctcattgactttattatcattaaatttaaaaaacattaatatttaagctgctattttatatcatattataattgcattgtatatcattatgtcatatcat

SEQ ID NO: 226109 - DNA, 520 bp, Homo sapiens
aaagatgtgaaaaaattaatgtttatttatacgatatataagacattgatttttaaatacagcggtaccatccccgtcccccataaccctggttcctccaggcacttggagccattggtggaaggacgtggactcctagaaggtgattcgcaaaggtgccacgtaagcagaggagccgggtaagcagaggcccagtgccacgtaagcagaggaaggcccggagccggctgctgaggtcctgagggagagggaggggcacctgctcagccttgcctgtgtgtgtggatccttctctctcaggggaagctgcctggacatgcgtgcgccttgcagttctgtcctgccaggctgcctgctcttcctcttgaaagcaaaagacttcacttgctgaggatgcaacgatgctctagtgtcccttgcaggagccagtgtcagagccaggagccgtcgtgggcatcccctgctccaaagttacgagttctggtgaaggggtcaggacagcccctttgagagttcagca

SEQ ID NO: 226110 - DNA, 209 bp, Homo sapiens
gtctctactaaaaatacaaaattagccaggtgtggaggctgaggcaagagaatagcttgaaccccggaggcggaggttgtggtgagctgagatcacaccattgcactccagcctaggcaacgagattgaaactctgtctcaaataaataaatagggtgagttgggtttaagtaaacaattgttgcactgctaaaaaactgttcatatgc

SEQ ID NO: 226111 - DNA, 632 bp, Homo sapiens
aagaaatgctgatgaaagtaatcaaataagaccttaataaatggagatgtatattgtgttcatagattgaaaaattcaatattgttaaaatgtcaattcactcaaaactcatatatagattcaacataatctcaataaaaagtcacatttttatatatcaaaaggtaattttagagtttatgtgggttaaaaaattacctaccaggtacaatgttcactatttggctaataggtataccagatgcccggtccctaccaatatgcaatgtacccatgcagcaaacaagcacatgtgccctccgaatctaaaataaaaaatataataaagtttacatggaaatcacaggaactagaacacacaaaataatactggaagagaagagtaaatatcggaggagttacactatctagtttgaagacatattaaaaagtaacacatagattactggaatagtgagtctacgtgtaaatttacacaaatgtgttcaattgatttttgacaaaggacaaagggaattcaatgaagaaaccataatattttcaataaatgatgctagactaattagataaccacatgcataaaagtaaactagaatttatatctcatacattatacaaaataagtcaaaatg

SEQ ID NO: 226112 - DNA, 530 bp, Homo sapiens
ggtagaagttgcagttgcattccatgtgactcaagttgcatagccatgttcctctcaaggctctgaatacagttccaacagctttaagtctgaattctttaatttcacagaagcaactggaaggaaccccaactaagctattgttggaagcgtccatgaagccagatgcatattcccttcagctaagcgtatatactcgtaggtatgttcccaagagaaacctctagcatgtgtctttatttaaacatttttggttgagtatacaattctaggtagtcacttcactctagcaccttaaaaatgtcattccactgtcttccgctcatccattgctgttgagaagtcagctgtgggccaaccttgcctctctggctgcttctaagctacactccactgtaataatcattcttgatgtcctgtaatttggtatcttgaaatcatgagccaaactatagccaggcttgtttctatccttactatccttgtgttttcatgggtgcacaaaaatcatatcacaaaccctctggcca

SEQ ID NO: 226113 - DNA, 272 bp, Homo sapiens
attttaaatacttatatatttacattgcagtgaaattgctccatacgacccttggaaatactactgtacaacatcaacttagggtgcttttttaactcatttgagtgaaaaatggtgatcacaagtctgtattttcttataactgttaatatttcagtgaggtaagaaaaaatacagggctaatttatgaaatgagtgagcttttttctaagtagtgtttgccaggtgtgtagattggtagtttaggaaataaaacaactttccagaatgaa

SEQ ID NO: 226114 - DNA, 506 bp, Homo sapiens
gtttcatgcaaaaggccccgcttggtaaaagctctggccagaaggaaggaagagatttctcaggcagaagcccgtgttctgctggaaaacctgtgcacaaaagaggaaggagctagaaagaatacagacagacaggaaatggacccacagagggaacaacgacagtgaagatagaagcacgtggctgcagggagacccgtagacgctgtgttcaaaagcggagagcgtcaagggcagagagataaatggggcaagctctggttcctggaagggcagcgatgtgcctcttgagagctgtttcctgtagtccttgccccgtgccaggcagccgagtgaggctcatcgcagcatgtcatgcaagggctggcaccaccgccttcagcggtctctgaggactgcactctgttcagtggtgacacgctggggcagagacaccacgccaagagccattccagtggctggagaggacatttagaacagcaaaaagcaaccaaagtcgaagctgc

SEQ ID NO: 226115 - DNA, 436 bp, Homo sapiens
tatccttatgcttattttcttttttctctaagtagctggaataggttttcgttcttgcaattaaaaacaatagctaaaatacatatgttatagaatgagagaagggtaagaaacagcgttggaaattacattttaatgaaataaaatattctcaatcttaaagaaactctgcttcctaaagagaattgaaaacaatagacttggggaaatcaacaactgagaaggctctaaggccacaccctgaatttaggggaaaccgtctgagttggggaggtttctcccaggaccaccaagtgtgtcctggtataggacattttaaaaagttttttgaatggagaactgacttaaaacatcttacaaaaatttaacctttttgattctccgttgtcccagcctctcaccactcattctcttgagacacagaaaaatgagtaga

SEQ ID NO: 226116 - DNA, 417 bp, Homo sapiens
gataaaataactttgttatgctcttctatttgaaaaataatggaagcaatggacactgagactccaaaagcagggagggggaagggaggcaagggttgaaaaactatctattgtgtgttcactatttgggtgatgagttcactagaagcctaaaccctaacattatgcaatatacctatgtaccaaacctgcatatggacccctctgaatttataatttaaaaaagtgactgttcccttcttctgcctctgaataaacttctaccataatgttcccctcccccgcagaatgggcaaagggccaggcatggtggctgacgcctgtaattcctagtattgtgggaggctgaggcgggaagattgcttgagcccaagagtgcgagaccagccaacataacaaaaccccatctctactaga

SEQ ID NO: 226117 - DNA, 501 bp, Homo sapiens
cactattaaccatctttactccctacttgcttataaagtttagagttttgcagattgttctgttattttgtatttttcttaatgccttgcttccacctgtgaaagagatatttttaagccattttggaagtagaaacctaatatgtaatcttgacccaacaggataccgcccttggtgaggctttcctgctaggattactcacagtgattctggaatgccatttcactgttacaggcattcctcatggcttaaaacaggcaccttagtattaggacaatgagctttattgtctgtgataaaaaggtcaacagttgttttattagttgataagatatttcatgtaagatgacaattaaaaagctaaatgtcaaagcttggaagagctgcttacctttgtcctaacaaacctgaggtactaaatgctgaatcgttgaatcactttagaaagctacaaagtaaagaataaagaatataaatatgaataaagcatacagaatatg

SEQ ID NO: 226118 - DNA, 383 bp, Homo sapiens
attttatccttgtcaagcaattcttggttaatagtttgctttgtcgtgccagtatctccataacagaatggggatgtcttggctatataagtagccaagtaagaaagcttcactagtaccagaagggtatctgttccatctcccagcaattgttgataaaagattgatgttctctgttgcatcttttgttaatatgaactaaaacttatttctctttgatgaactagtttctgagcttacaaagagcagactccggaccaatgtgcccagaatccctaaagagttaaccatctcccaagaacccagtactgtcaatggaaatataacatgagccatacatgatagccatttatgtaatttgagttttcgaacagccacattac

SEQ ID NO: 226119 - DNA, 166 bp, Homo sapiens
acacacatttcgcaagttcctgctgtgcccacacctacccttgccaatctgctctacttccccgggggcccgaccggcacactcagggcaggcactcttccgttggtccccacgtcaccctacttctcgtcgacgcggccgcgaatttagtagtagtagtaggcgg

SEQ ID NO: 226120 - DNA, 301 bp, Homo sapiens
tatgggaaagttctagaaaaggcatcttttgcactgtgctgaggcaacaggcaggaatggggtagcaatctccaaaaactaggacttctttctgaggtctttgaccccaagtgctccatagtccaaagcagcttctccttcctcctctccacccaaagctatggcgactcccttgtctgatgcagatcagtgctggatgctgtggggaagagagtactgggctgacagtcagtggatgtggattttgtttcccagttccatcgctgatttgcaggtgagtcctttcccctgcctgagactc

SEQ ID NO: 226121 - DNA, 253 bp, Homo sapiens
gtttatagcatttttgttgccaaattataagtaaattgtaggtatttattaatatcattccaaggaatgactagcagtgcaaaaaataggtactttagtggtaacaattatttgctaataatccagaacctacaaataacagaaggaaacagcacactcttaaataaataatgggacaaggaagaaactacaaagtcaattagaaaatactttaagattatgtagaatgagggcccaacaaacgaaaatgtat

SEQ ID NO: 226122 - DNA, 493 bp, Homo sapiens
tttagtttttagcatgaatttacattttagtaagctgtagtaagccttagctaaagtgatacatcctgctcacataatcatttaggtaaagttattaggattatagtatatagaatgggtggatgattttggtatattcctttatcttataaatcttatcttacaaatctgtatcttataaatctacgaaaataatcatgtatttacttatgaaaactagatcaaatagtgaagttaagtagtgtccgtattgttctaaagaaaattaggttgtagtatatattaaaaacatttaatgatctgccttccttacttttctcatttactttggagtctgggactctactagcttgtatggtttgttggattcttttagtttagtaatttgggaaacaggaaggtaacctcaggatggatgagaattgccattagctatgggtcagtttagtagacttgtggattcataaagatttttgaaacttgatggctgctt

SEQ ID NO: 226123 - DNA, 421 bp, Homo sapiens
ggaaatcggctctgccacttactggttgtatgttcttgggtaagtaacctatgtgtgcctcagtttcctgatctgtgaaatgggagcaatcagctcttacctcataagttgttatgagggttaaatgagttactatttgtaaagggtatagaacaatgcctagcacatggtaagcactatagaagtgttggctgttactaatattatccttcctacagaattttagagtttggtaagaaattattcaaagtaaaaatcaatgggggggagtaaaaaattgaattttaacaaaagatcttaggggaatgtgatttaacttgagtttccaacatatggacattggtgttgagaatcccatcatatcagaagaagtactgctgccgaaatcaggacagtatgtgaataaaacttcataggtaca

SEQ ID NO: 226124 - DNA, 408 bp, Homo sapiens
cccttgttcttcaagagttaccaaagtggtctggttttccactattttctattgccttgtgttaagagtttaagatagcataatactgtcagagatgtatttgcatgtatcttttagggaatttcaagtgcttccacatccttcttgttaagtgccacacaactgcacagatgcttacttttctcttctttctgattaaattagaagagctgcagttttcacagaggtggtcatgatgttatgacccctcctgtgctgcaaggttatcaaatcctgaattcttagaaaaggtggtaggaggtgacagggagagtgtccagggagtgcttagttgagagaaaaaaaccaaacagtcttctcaggaagaaaatagctagttgttgcagctttgctaccagaggctctgat

SEQ ID NO: 226125 - DNA, 589 bp, Homo sapiens
acattctcaggaatatgcatcccaaacccatcagggatagaaatttttatcaaggctactaatataattttgctcatgggtggaataaactaggagacacaaacacaacaaatgaacttttgtcttagcatcttatatccttctagttttaatcaaagaaataaatcggacttctatggattacctgccattaaccaggagactgaatgaaatcttgcatggttcaggccaggcatggtggctcactcctgtaatcccagcactttgggaggctgaggtgggtggatggcttgaggccaggagtttgagaccagcctggcaaacatggcaaaaccttgtctctactaaaaatacaaaaattagctgggcatggtggtgggtgcctatagtcccacccagcatcccttgaacccaggaggtggaggcagaggttgccatgagtcaagattgtgccaccgcactccagcctgtgtgacagagagattcttctctgaaagagagaaagaaagaaagaaagaggaaagaaagaaagaaagaaagaaagaaagaaagaaagaaaggaaagaaagaaagaaagaaagaaagaaag

SEQ ID NO: 226126 - DNA, 541 bp, Homo sapiens
ctcctggtctcatataaccagtattgagtgctgggtgctgattccaaaaaaccatgccctctgcctcccctaatcacagctctgagggaacagcagctgggggtcacatggagaggcaatctaaatagcaaccacaccaaggaaaacctcattgtcctgccccacccccttctcctacctctcttttcatttacgaattcaattatttgtcaggctgaacatttaaatgcactctatgctctctagattctccctactccccttctcattaaaattctaattattaccagaacaagtaagatgtatgatcaaaggaaagcaaagccctagaaacaccttttgttttgaggtgactcatattgcagagaatgcatccagaacagctgtaacagagaacagatgtgaagggctagagatggccagatatgtagaataaggacacatatagctgtggtgacttccctggtgagcccactaggataaagacctgaagaaagagtctccaaattatttagatcatgaactcataacaggtaaaaaa

SEQ ID NO: 226127 - DNA, 336 bp, Homo sapiens
tggaataatgaattatccagcttctgccaaaatgagtcacaccatggccatgaacgaaacttatctctttctgactctttcctcatcttgttcttccatcttcccttgcttgtctcctgtgatctgtcttgccagtggtaattggagcatttctcctttacttaagttctgaagtgtctttgggactcgctaatgtatccaacggctaaacaaggcctgtcaaggacatttatggctttctagcatgggcagttgagtgtagcttacaagcaactttggatatatatgaccaggaatataaatgttcctttttggaaaacaagagaaccccagcca

SEQ ID NO: 226128 - DNA, 402 bp, Homo sapiens
tttttgtagagacagggtttcaccatgttgcccaggctagtcttgaactcctgggctcaagcaatcctcccatctcagcctcccaaagtgctgggattatagttgtgcggcctatgtgcaattctgaaccagacatgaacgcttaaatcagaactagtattgcaatagctgctaatatttccacaatgttataaattgcaaagtgctttcccatctcacttgattaaaccaagctccatgctaacagcagcctcctcccagggctctttgatttcatttttactgcagtccattctcgacacaaaaaccagggtgatctttttaaaatgttgatcagatcatatcactctcttgctcaaagttttccagtagattccattcccactaagaaaaacatttaaa

SEQ ID NO: 226129 - DNA, 509 bp, Homo sapiens
ttttctagctttgtttcctacctgccaaaaaggctaatgcaagatgcatccacttatggtctgtatcaggtgaatagaaaataaccatttgccaagatttggaaagacagagagctctctggacacgggttcgatggagcttgcacctctctgagagctgaagtcaagtctcaccctctctccatactccctggcctagtgtgctctgggcagcaggtaggaagggacagggacctctcatctcaagggctgccccaaagggccctcagggaccatgggcctgttaggaccccagcaccccagtgtcgatcctggaagtcaaaggtcacgactgtggggggccagctcatgtcactgatggcagcaggcagggtttccagcatgggcggtgcgctgctgtctgatacttcattattgtgttgtcatcctagctgtataattaactatatccaaaagccggaagggaaacctgtagctctgcatatggagaaataaaacagagcatatga

SEQ ID NO: 226130 - DNA, 271 bp, Homo sapiens
ttttttgactttgaatcttcaaatacttttttcacagggattttgaagtaatttttattgattattaggtttattcaaggcccttgctttctaatataaattttaaattatttttaatttatatatttaatatatatttaatttatatatttttaattatatatatttatatataatatatataatttatataatatatattatttatatttttataatatataaaaatataatttatatatttttaatttaataaattttaaattattaa

SEQ ID NO: 226131 - DNA, 500 bp, Homo sapiens
caaggaagaaaacggttacctctggttccttcccttgtattagctaaactcatgcaagaagaaagactgaagtctgtcaacacacctgggcagacttttgtcacataggctcaacagactttgtcccagaccattgtatgttcttcattcccattaagttcccctagaaatcattcactaccctcctaaaatcatccacactttccccatctccctttcccataagaaaaaagatacagggtcaggcatggtggctcacacctgtaatcccagcacttgggaggctgaggtaggaggatcacttgaagccgggtgtcaagaccagtctgggcaacatagcaagaccctacctctaaaacaaaacaaaacaaaccaaacaaaaacatgtaaccatctataccccattgcatagtggaaaaatcactctgcgattctctctcatgcatgctaataaatgtatatggcatttctcctattaatttgccttttgttagttgatg

SEQ ID NO: 226132 - DNA, 594 bp, Homo sapiens
ctttaggtaccattgtcttaaagaaatctctgcgacagagtcaacatcatacactctaagctctagagctatattttgtaaaaacaaaaaaggtttccctgcttcactttgcctgcggacccccttctgatgaactccactcaggccttgttcctggagccctcttcctctggctgcaatccagagcaagttgctgtctggacttgttgaaaagctgttgtcctgagacttctcttcaaattctaaggaaaaatttactttttctcaggattctaaacccaatcaaataatcaagtgtaaaggcaaaatagatacaaaatgtaccttgcaaatactctaggaagctactggaagaaaggcttcagcaaataaaggaagtgtatgaagaaagaaagaagcatggcacattgctaccttaactaataaaaatctctgaactttccggtcccatctgaggaagcaaaaatgctacttgctgcaaaaacgacaccatttatcacactgcaacaaaagcaatgtataggcatgccttggggatatgtgagtttgattccagactacttcaataaaatgaatactgcaatgaagtcacac

SEQ ID NO: 226133 - DNA, 368 bp, Homo sapiens
tgcatcagataagtgtcttggggctaggaaggccagaatgggggagcagccaccccaagcctttgtggcccacggagcctgctgaagggacttcagggttgcccatccctcactgtgaagtggcccagagtaggaaaggggtgggagccaggaagccacccaggtgtgcagagcagagctctggtgtagaataggtggcagcagagtgggaggcaaagtgctttgatgtgaaaatgcctgacattctcaagcaaaccacttgttcttttaactgtggatttatctggaagtaatagagtctgcttgagatgttaccaggtgatggaacactggttagaatgaataaaaggttcacgtttgtgtcttca

SEQ ID NO: 226134 - DNA, 933 bp, Homo sapiens
gagaaatatgacttttggaaatgattttatttgggttaggtttttttatttatataggcagatatatatggtgttttgctctgtttacatagctttatacctttttatatactaaattgaaatggataggtagaagcaatattttcagaattggtcattgtcctgaataaaatgagccactgtgttctctcaggcaccatgcaagctcacccaatattcatataccacaaaagggtgtttttcctgcttaagtttatattctatatcatattctgttttttttttctggatatttccactttatattgttctctttcaacattttgtaagaagtagtatttcctattctctgctgttacaaagactatgaaaatacatgcaactcatttaaagaaacaggtggatgtctggaagttttctctacctaacactttcacatataaaatttatgatgtttggtttctatggtatttaacattggcaagaaaaaataactcccaatgaagtaactaagaccacttgttctagttcttcctgtagtggaaagagatagagaagagtgatagtaacaaagtattctcattactctagaacagagattggcaaacatttttctgtaaagggccagatggtatatacttttggcttcgtgggccatagggtctctgttaaaactgctcaactctgtctttggggtgggaaagcagcagtagacactttgtaaatgaatgggaatggctgtgttccaataaaactttatttacaaaaataggctgtgggcagcatttagcctgtgttctgtagtttgcccatccctgctctataaaaagagtaggaaactatgccccagggccaaatccagcctgaagcctgtttttgtttggccacagagctaggaatggtttatgtgttttcaaagagttgttaaaggag

SEQ ID NO: 226135 - DNA, 652 bp, Homo sapiens
tgaatatgtatggcatagtttactatgttatgcatattcctattgcaatgctctgttctgaaataaacatcttttctttgtgatcctctctctgttatgtaggttgacagtaaaaattcaaagtggtttagtgatttgaactttgctttatataaacatttcctttttatatgctttgtgaaactagaaggtgtaataattaatggcatacttagttaaaaaaatttatatgatatgcacatactgcatttggtcctaataatgatctcaacatttcatttacaattagcttattccacagtattaagaaaacataggtttcttcctattttatataaatcagcctttaaaataaaacaaaccagcttttgcaaaattatttacaaagatacctggccttgtcatttgtcatttgaaaataattatgggacctgctttttaaatttactgagggggatctctttctgctgtaaaattttacttctttctgaagtaaaattgtattttaaaaaatgatataatgaaaggccaggtgcagtggttcatgcctgtaaatcccagtactttggaggctgaggcaggtagatcacctgaggtgtcaggagttcgagatcagcctggtcaacatggcaaaaccccgtctctactaaaa

SEQ ID NO: 226136 - DNA, 1155 bp, Homo sapiens
cgggagtggttaaatgttaaatttaacgatgtacgtatttaacccccacacgccccaaacaaatctgacaaaagttaaagaccattccctaggtgtagctctgttcctacatgcaaaattttacatattgttccagggagctcacggtcttctcaggttcatctgtggaaccattcgacaaccaaatgttatggggaagccagtctcatgagctccaacacattcttcagtgcaatcagtggcaatccctgcccacttaggacttttcgaatagtgctcatccctgacttctggataaacttctttgcagaagcccatttgactccaaggacagaaaaaaagagtgcaggttgttattatgcaaagccacagcattaaggagctcaatattcttctagatatctgccctcctgtctgagaatcccatacttagagtatagcaggtcccatctccatttgggatggtggtggtggaaaagggggcgtctctgatgagcagagcatctttaatgcctgctcaggccagagcccctttccaaagacttcgagactgccgtgggcctgctgactcctctcacgctttcaagctacagtgcttcccatcacattgcagaaggccgccttgggtcatatctcgcaaaggaagagctattaacaaatattccatttgtatttcctgcgtggccctccacctggaaatatcttttatctggcaacttttgcaaaatgaaccaaatcttgaaggaggtcttggcaggtttatgctagcctctctatcactccaacaagtcatttccatcctcgccttcacaagggtcaagcaattgtgacttgggttgggagacggggctggcacggaatggtagcaagtcatctaggctctgaggcatctttttaaccctgaaaacgtccacttggagggcaagagccaaatctaaaaaattattatacacactgtctctcagctcaaatatgtatgctctcactccaagttcagatcacaatttacaattccgcattttgtaattgttaagtgcagtctggcttccccaaagacctcaagctcattctgcccaggattaaatccaagagccttcttagcccagtttctggcatgcaggaagcatacaataatggaagggaaagaaagaagac

SEQ ID NO: 226137 - DNA, 487 bp, Homo sapiens
ctcagacggtctttgcatgcatgcagccattggcactcccattgtatggaaggaaaccagcccagggtcacacagctggtcagcagcaacatagctggtctcaaatctaaggtgcctggccatgcctccatgagggaccgcctgcaagggaggttgatcctggctttggggagcctttcctgggctgcacgaataacctccattgttcgagaccccaaactctgctcacatcttcctttccctgtctctgcttgggctatgatcacggtgactctagcaacccttcatggacattatagtactctctgccattcacttttggtctaatctgacttcaacccccacttacttggtctctccttttacaaccaacacaaccgaaatctagggctttttttttttttttttctttttgagacagagtctcattccagcctgggtgacagagtgagaccccatctcaaaaacaaaacaccaaacaaaaaca

SEQ ID NO: 226138 - DNA, 539 bp, Homo sapiens
caagacccaaccatatgctgcctaccagaaacttaaagacacacatagactgaaagtgaaaggatggaaaaagatattctatacaaacagaaaccaaaagcaatcaggagtagctatacataaatcagacaaaacagacttcaagtcaaaatctgtacaaagagacaaaggaggacatcatataataataaaaggatgaattcagcaagagaacataacaattgtaaatatatacatatctgatatcaacactcaaatatttaaagcaaatattattaaatctaaaggtagagatagactctaatacagtaatagttgttgacttcagcaccctactctcagcattggacagacaacctaaacagaaaatcaacaaataaacattggatttaaactgcatgatagaccaaactgcacctaacagacgtttacagaacatttcacctgcccaacaactacataataaaccttctttccatcagcaccaggaaatttctcaaggattgacccatgtgttaggatacaaaataagtgtcaaa

SEQ ID NO: 226139 - DNA, 473 bp, Homo sapiens
tctgggttgaaacgatccttccacctcagcctcctgagtagctgggaccacagatatcaaatctacaatctcatcttccatcttaaagtagaaaaagaagaacaaagccgggtgtggtggctcacacgtgtaatcccagcactttcggaggctgaggtttctgagcaagatgcttgcatgaaagattcaatctaaggccaatgcaaaaatattgtgaaagcagcaggatcagctagccttccagttggcttcttaaatgctgcattgaaaggatgaaacagaacggatgtgaacaagagttccctgagaaaggacagctcttagagagataggataattactggactcaagaagataccaaatcatggtgtgcatttctgcgttgtgtttggaagaggaactaggattgttatgaaaaggaaggatgtgttcaacttagaagaattaaacctcaaccatctgtctcttccaaa

SEQ ID NO: 226140 - DNA, 650 bp, Homo sapiens
tctgggttgaaacgatccttccacctcagcctcctgagtagctgggaccacagatatcaaatctacaatctcatcttccatcttaaagtagaaaaagaagaacaaagccgggtgtggtggctcacacgtgtaatcccagcactttcggaggctgaggtttctgagcaagatgcttgcatgaaagattcaatctaaggccaatgcaaaaatattgtgaaagcagcaggatcagctagccttccagttggcttcttaaatgctgcattgaaaggatgaaacagaacggatgtgaacaagagttccctgagaaaggacagctcttagagagataggataattactggactcaagaagataccaaatcatgaacacttgctctggggaaagccagctgccatattgtgagcagacctatgaaaaggcccacttggtgaagaactgaggcctctggctgatggacacatgggtgaccttgcaatcaagtcttctggcttcaaccaagccttcagctgagactgcagcctcatgaaagatcctgagctagaagcatcctgccatcctaataagccactcttgaatttctgacccttaaaaattgtgagataagcacctgtgctttttttaagtgttagatttaaaaaaccctgaaa

SEQ ID NO: 226141 - DNA, 386 bp, Homo sapiens
tgtccttctcatatgcaaaatacactcatccccatcccaacagtgccagaagtcttaacccagaccagcatcaactgtaagtccaaaatctcatgtaagtatcgtctaaaccaggtatgggtgagatttgaggtatggttcatcctgaggcaaaattcttctccagctgtgaacctttatgaccagacaagaaattatctgcttcccaaacaggacaggcagagtatagacatttctagtttaaaagtgggacattggaaagaaccaagctacccatacggaaagaaccaagctacccatacggaaagaaccaagctaccatacggaaagaaccaagctaccatacggaaagaaccaagctaccatacggaaagaaccaagctacc

SEQ ID NO: 226142 - DNA, 264 bp, Homo sapiens
tgggcaaattaataaagacagaaagtcttaattaataaagtcagattggaagttacccagggctaggggaagaaagaatgggagttattgcttaatgcgtatagagtttctgtttggagtgatggaaaagttttagaaacagatcgtggtgatggttgcacaaccctgtgaatgtacttaattaataccactaaactgtctacttaaaaatggctaaaatctcatattttatgctttatattttaccactaataagaggctaaa

SEQ ID NO: 226143 - DNA, 439 bp, Homo sapiens
cagtatactttactgtcagggcgatgtaaaatctgctctgtcataatgtagtacatattggagttaattttaaaatggttaaataaggataagaaatttcatactttttccattattagtggaaaattttaaaccaaagaacatttcttagaactaataaaaggtagaagaagaaggtgttaattagtgcttaaagcaatatgtatttgattggcttaatttaggatgattgctcttccagaattaaaaataaagaccaacagaaacaaaactttaacataaaagttaattttaagctatagagtttcttgtctccctacgtttcccttatcttatgtgccaaattgaaaatgagaggttcttaatactttttgtgccatggaccccttttccaatctggcgaagttcgtggatccagtctcagaattaaaaaaaaaaa

SEQ ID NO: 226144 - DNA, 557 bp, Homo sapiens
ggcaacaggcctgggagcaccatgagcctgccccccagtcaccatgtgacatcttgctcacattgtcgcccctgctcaagacaggctcagtggttctctggtttcctgccatctacaagctctgccagagagccttccttctggccaacctctgcccctgctgttatcaccgccaactactcctgccattcccacgttgccccacctgagtgtctgcagagctcccagctggacatcatctctgtcatcacaactcttcttgctttggctctcccttgggtcacttgtcactgtcttccctgtggcatggcaggtgttttctttcccttactatactctcttttctggggcactctggctcctcctcatcttcatatgtcccaaggtgctgtgtagggcgggcacataggcagctgctgatgagtaaaaatgctgtttctgagttgttgctaagtgcctctgttgttcatgctaagaatggttggcaggtggtgctgctgagccagacaaagaagcagatgttgggcaagtcccaggccctcagctgtgctgatctg

SEQ ID NO: 226145 - DNA, 473 bp, Homo sapiens
caaaaagcgcaatgagcacttaacgatctgtgagaagtgaggtgtattatgaagacaggaccacttttttgttttgaagaatgtaggagttttcacaatcattttttttatcatgagttaagagcagttgctttgttattagaaagacttgggttccagtaccagctgtaccaattactgtaggaccccaaggagggttctcggcctcttttagcctcagttttctcatctgctaatggggataataagtctactatgtcatagaattattgttaggattaaaaggaaatgtagtaaaaacacgtagcacagttcctagtacatcataaagaaagacaataattggcagcaatttaattaatatttttaaaggataaaaggagaaaaaactcaaataaagacccaatggaaatagatgaataatagatgatagctatcagctgctgcctcagggatcaataatagtaaaaaaa

SEQ ID NO: 226146 - DNA, 497 bp, Homo sapiens
actggatattaccaagtatttggaattggggaaaaaggtctcaggtctgtcttgtataaaaaagaaataatcgtttcctttcaagacaagggaaatgatatatatttgtgaaaattaaatcacacaaaaatataacacaggaaacgtgttcttttcaagtacatactataatgttatggattctattagtgtgggtcaaatgtaaatttttgggtgtgtaagtcaaacctaaattttcaagtgcaaatataatgtcaactaaaaatctggcctaatttgactggattaacactgacattttcccctcccttgctcaggtttttatttagacagcacctgacacccaggcgctgaaccgatgtatgggttcttatgcactgcattttgaatagaaattgtcactttatgatttctgggtccttaattatgttttcctattggatgactatgaatctatttttatgtttccattttgttagtaaaggcaaatctaaatc

SEQ ID NO: 226147 - DNA, 440 bp, Homo sapiens
ccgccgcggacagcacccgggggcaggcagagcgcggcatgggtgcgcagcgccccctgccgaccagacggccccgagcgcgtccgccctccgagctccaccccgccccgtccgcgcgcgcgcacgtccctcctcagccccgccccgtccgcgcgcacgcaaccacacgggcacgccgccgcggggcccgcgagaagggcagctgtcaaggcgtccactactcttgcggcttcctagacctctaccgacaaaaaccacaccgattgttacgtagccctatctttttagataaaggttgggagatttttttaaaccctgacattcagcacaggtgttgtgatgggtaaacagaattggtattattaactactttgctccttacttgttaactctgacctagtcgtctcggaatgccatacaaatagttttcctacacttta

SEQ ID NO: 226148 - DNA, 432 bp, Homo sapiens
gaggctgaggcaggagaatcgcttgaacccaggaggcggaggttgcagtgagccaagatcaaaccacttcactccagcctgggcaaaagagtgaaactccatctcaaaaaagaaaagaaaagaaaatgtatgagagaggaccttactaagccatgtttactaagatttaatttgcatatggtaaagtctaccccccttttaggtatgtatgtactattctgtgaatttggacaaacagtcatgtagccatcttcacactcaacacagaatgtttccaaggagtcctaggcaggtggattgcttgagctcaggagttgagaatagtctgggcaacatggtgaaaccacatctctacaaaaacaaaataaaacaatgtttcagtagaattttcaaagaataagtgttcactcttaattgggaacattaaaactt

SEQ ID NO: 226149 - DNA, 796 bp, Homo sapiens
tttaagagacagagacggtttcactttgtcacccagtctggagagcagtctacgttattttcaaactcaatttcctttgggtattttatacattaaggaaaaacaatttatatattacttcttgtcatgccattttactaaaaggaaaccagtaacaatataatccataaaccacatgctacaaaaatgcatgtttgattttcaaagatttatctccaacctttcaatatgccttttttgtctgtctaaacctaaatcagaaagagaatttttaatgaagtctttaagttcccagtgaatcaaaacagttgtttaatataagcaattatcacattatctgccaaggtagttcagcccctaagaatacttccaagaaaattaatctatcaattgcactaataaaagagcagtagataaaacactttgggttttcaactttctcaatagtttctctaggatattgtacaactatgtatcacacaaaagtacttaatgtcaaacctcaaataaaggacacaatcttaaaagcaagaggaaatctaacaattatgaaaacccagcagagacaataactgatatacaaggtagttggaggaggagggtccaatgatgacgaagacagacatttgactttgagcactcttgactaccaaatttctatataggaacggctcaagggcagtcatatggctgaaactcagggctaaacagaatttttttttttttccttaagagacagggtctctcactctgtcactcaagctggagtacagtgacacaatcataggtcactgca

SEQ ID NO: 226150 - DNA, 1752 bp, Homo sapiens
  misc_feature (1564)..(1564): n is a, c, g, or t
tctctgagaggagatgaagttgaaacacttagattcagcaaattcttacttgaaatattaccataacgtattgatttttaccagactcaattgactgaaaagttgtttgtatagcaatattggccaaaccaatatactagaacaattttgttacccatagtaatcaagtgcatttctgaagtataattatactatcataaaaaataaaaccaagatacccttttccaagcaataaaacaataaaggctataaaaaaaaaagaaaaagcggctaaataaatgagatttttaaaaatgaaatttagtgtctttcaaaaacactactgcctcttcttccttcccttaagccaaggttagcagaaaatgatcaatacttcaatctcaataaactatttcaataatagttaattcgggtggaaactgagtctgaaaatctctgctcagcgacctgtgacatcctgtcatgttggctggatgccaataatacatcattgccataatggatatgagcatgtatgaagttacaggaacatggagaggtggggaaaagcaaaggtgggaaaggtacagagaaccatgagctcaggttcattccttagattcgaatcaataaaatatacattatcgtatgaaacaaacctgtaacaatgaatgctgagagaaggagagaaggaaacatacataattaattttatttgacaaatattcattgattttctgaaaacattaatatccttgcttgtcacgatactataatgcaatccagtcatatacaaatatttaattttgcattaggatgatgtcttgtttgcttctttaaaatatgatcttggctgcaaggaaaagactccttaagtgattagaaatttaaagtcaaaataaatcaaaccatcattctagctctcaggtcaattttaaaaccatttaaaaactactcttaatttacaagatacacatcatgcaaaaatatataaaggagtagggccactaacacagccacaagcgaagctgggtccagacctcttgctccctctttaagtttcacaccttcaggttggttggtgaaagaggaagtcaaggttttctgggtactatgtggttcccaatattttcaccaccaaggactcttttcattctgtttcccctaaggaattccatgttttgaaatattctgtttactaaatagcatttaactagacaatttatgtattttctcattttatacaaatgaccatcagtccttctaattttcattaaataaatcatattactataatgagctaatatgattccagctcccaaacagtaatttaatgttttagttggcctctacagtcaaatcacaagtgcaaaacacaacctaataggccacaggatctcagttaccacctccaaggaccatccccagcccactgcccagcaaatacctctttttagataaggcaacagaaaggaggagagaccagcatctttgagaatgacaattccttccctcctcttattgtctctagataggttcaaattaattcctaagtaatggtatacattcaaccttcaaaacaccntgaaggcagtatatatactacccattgtatcactgagaaaattctacctcaagtccagatcagactcttactctatcctgtgggaaggagctggagatagaaaattcagttttcaaacatcttgagactagattatctggccccaaagctgaaaatatgagtcttggcttgaataactggcattaagg

SEQ ID NO: 226151 - DNA, 289 bp, Homo sapiens
gatcgatgccagtcatggggaggagtggctgtgtggaaattaatggattttcaacatccaatcacagaggacacacatgtatatttagcaagtctaaaacctcttaaataaactgcattgcttttcattttcactttccagttataaaaccagtggatgatgaaaaggccatgtgacaatacagcatgtactctcaggaatgtttgtgtgacggggatattatatctgaagggacagggcaactgggagggtgaactgctcataactctcaattgtccaggtaatgaag

SEQ ID NO: 226152 - DNA, 504 bp, Homo sapiens
tttaattgaaggatttctgtcacatacttgttcttgttgatgtgttcctgggacctggagaaattgcccaccccctcacttctctggagaatctcagggccgcatggatggtctgatgctgcctgggctgaccattgtgaaaatactgctggctggtccctagcagcaggttccatcagcaccttagttagatggtgtttacagaggcatgcccaaaggagatacattgactattcccggttattttttgtcctgtaaatagagacattgttcaaagtcttttttcccctaacatttaaaacaacatgttaggccttttaagtgtttgccaaagaacctggagttttattggagtcttgactaacctgctgaacttttcaagctgaaaccctaagggttacagtataaaaatttagaacctaattagagcagcagtctcctcatgctgttactggtctccttaaagtcagaaacaagatctacagctgctgctgtcggtcacct

SEQ ID NO: 226153 - DNA, 499 bp, Homo sapiens
ttcatctcataaacttaagtttccaaggtaaattaccttaaaaatgtgtcttttactttctcattgtgatgcttcgaaaactgctaaattcattttagtgggctaataatggaactagttttgaaatacacgtttactatttgcctatgtaattgaaacaaccccttgttatttttttagttagcattagagtaagcatccacaatcactaggcattgtcaaggacacaaaaccatgtattactgtatgaaaatattgaattaatatttactactaccatagcctccagatgatctattgtgatgctgtcattgtatgtttctgtgtttcaccactgttttggagggtgagaatggaagaattccacgtaagcagctcatcccctgtgcccttcagcagctcggccgttcccctcatgctggaaatctaatgtcagccaggttgctatatgacaccctgtggagctgggtttccagggcagattaatcaagaaagggaa

SEQ ID NO: 226154 - DNA, 457 bp, Homo sapiens
ttaggatatttttatcaagatttaaatggccatcattagagttatagcactttctcctttggattgtcctagaggcccatgagaaagtattccctaatttcttaggagaacagtttgtgggtagtatgcggtcatgtccagttaaattgcagatatttccgatcgaagatgttccagtcctgagaacttcgtgacattagcaggacttctacaagccatctcttagggtggggcatttactgcagttggctagtactcttttctccttaactttgtcatttgttgatttttttttaactgtccccaaatactgtgggcagagtgtatctagaattgaggcctccaccattgcggagaggacatggatgctgagcagtcccctgagtgaaggttataaagaagcaaatagactacacatgtctgtaaactgctcttgagtgtcccaaatttggggtac

SEQ ID NO: 226155 - DNA, 422 bp, Homo sapiens
gtgctatgtattatgtcagtaatcataataactttatttcatcagcatgatcattatttccattttacagacaagaaaaatgaatcaacccaagaaaaagtcactttccaagatcataaagtaaatggtgcagctgagattcaaagccaggtagtctctgacccaaagtccccaccctttactaagtatggcaagcccctaagaagggcatatgatactcagcatttccaagcttattcagccagggaacctcttcatccagggccccacagagggactttgggaaacactgctctagtttgctcctagaaggcccggccctggctgactttcttttttaaattttttaaattttatttatttatttttttaagatgaagtttcgctctccagcctgggtggcagagtgacaccttgtctct

SEQ ID NO: 226156 - DNA, 586 bp, Homo sapiens
taggctttggtagagtaagagagtgaatatggtgaaattagagagggtggagtataatatattttgaagggattgtcattgaggtgaaaattgagtattgggtttacagatacatttgagctaaatatgttggtgtaggtgaactctaaaataatctgtagcagtatgttctgatgaacataatctctagaaagaatactacagatcttcaagcataagatagaactgtatgtattgacctggaaagccatgataaatatgaggaaacaaatctgaaagaataaattccaaattgttagcagtgtttactaggaggagatttgggagcactctgcctatagtctccagaaaaccagcaaacaagttcctgccaaaagctatataatttctcgaagtttaattaggttttaattaaatatacttaaatctttgtaatcatttctctacctgaagaattactgtatcacttctcagccttttggctaagatcaagtgtagtatctgttttttcagtttaatatctgatatgtcctaaattaaaaataataaaaaataaataaaggggagataagagaaaccagagact

SEQ ID NO: 226157 - DNA, 400 bp, Homo sapiens
tgttgcccaggctggtctcaaattcctggtctcaagaaatcctcctgcctcagccttccagagtgctgggattacaggcgtgagttactgtgcgtgctcacggtgcctggcccgggttccttttctgccagcttggaagggcaaccccatgactgaatgttattctgagggtggctccgcatttgcatccttgttacagtgcatccacttgaaacactgcacatctgaactgggactgttaacacacatgctgatacagtgtggggtgccaggaagtgtctgctgatatttatggcaaaaaaaaaaatctgttttgtttacttagtgtatcaaaagaaagtctggggtgaacagtagtatttttttttaagcagctgtgaaaaaaagttggagatctcca

SEQ ID NO: 226158 - DNA, 394 bp, Homo sapiens
tgagatggagtctcgctctgtcacccaggctggagtgcagtggcacgatcttggatcactgcaacctctgcttcccgggttcaaacaattctccctgcctctgcctcccaagtagctgggattacaggcacccactaccatgccagctaagttttttgtattttagtagagacggggtttcactatgttggccaggctggtctcgaacccttgacttcaggtgatccgcccacctcggcctcccaaagtgcggggattacaggcgtgaacccaataaaactttatgtactgaagcaggtggatggtcaaatttggtttggaggccttatgttgcctatcgctgtcttcaaatattgaataatatttactaagggaatatttattagaaaaaaca

SEQ ID NO: 226159 - DNA, 629 bp, Homo sapiens
tcttgccgcagttttgcctggtcccttaaaataggaacttttaccatctcgggaattttgggaggaaggcttcatgcatcagagaggggctgtagaaccagactgggttatctctcagctctgtactttctagttgtatacctttaggtataactgtatgactttaacttttgtttgggccatatgtaaaattggactgttgataacatccacttcataggttgttgtcaggaataatgaggtaatatatgtaaagcacttagaatagtatctggcacccagtaaaagctcaataaatgccagctattattgctttcttaatatctctcagaggctgggtgtggtggctcatgcctttaatactagtgcttttggaggccaaggtgggaggatcacttgagcccaggagtgtaagaccagcctgagcaacaaaatgagatctgtttctatgaaaaaaaattttttttaactagccaggcacggtagcgggtgcctgtagtcctagctactcccgaagctgaggtgggaacatctcagatgttcaaggctgccgtgagccatgattggctcgcgttgtccagcccggacgacagactgggaccccctctctaaaacaaaaacatctccta

SEQ ID NO: 226160 - DNA, 627 bp, Homo sapiens
ttgtgacaaagttgaagagattattaatgaactagaagagatatttgaggaaagtacttgtcccagaaagacaaagagatggaagatataaaaagagaggctaaaggaaatggaggatagaatgaaaagaccccaactctatatgatctgagttgtgagaaaataaagagaatgggtgcaaatggatgtttgataggagataatggatgaccatttccaaaactgatgaaaactacttattccccagattcagaaagaccaatatctctagcagaataaatatcacaaggaaaccgcaaaacatccaagacaaagaagttattcacaagcagccagagaggaaagttagattgcttatgaaggaatgacaaatagattgatagcattcaatagcggaggctagaagatgatagagtatcatcttttaaaataataaccaacttagaacaatatatccagcaaactatctttcaagaatgagaataaagacatttttagacaaatgaactctgagagggtttacaaccaaaagaccctaaaaccctctcattaaaggagcttctaaaggttgaatttaaagaaggataataatttccaaagaaaggtctaggtgcaagaagaaataat

SEQ ID NO: 226161 - DNA, 863 bp, Homo sapiens
taatatattgagtaacaaaattactcatagtgagagaaaggcaaatcaaagctatgtcaaaatgcaatttttttttaactgtcagactagcaaaatttcaaaagctcttccatgtactgttaatggagctatggagaagaaagctgtcttatactatgttagtggaattcaaagttggaaagctcccggacagggaaatttggtaatacttaagaggactagctgtgtggctaccctctgacacagcaatcccacctccaggaacttactccacctccgatacctccaatatgaaaaaagcatatgtatgagtttaatctttgtaaagctttttaaaaacaattgcaaaatagtggaaaccacctaaatgtccaagcataaaagctgagtatgctctatccacccaatggagtaatctgtattatgcatctgaaacaatgatgaggtggtctctgaatggatgcagagtgatttctagtattgttaagagagaaaagtaagatgcaaggttcgataacatacacttgctttgtaagaaagaaggagaaacattgcaaaagggaacataggaaggataaactagaagctgatgagattggccgctgagggtgaggtgtgatgacgggaaggatggcgcttttttcctgatacacatttctgtacagcattggcatttatgccacattaatgttttgcatactcaaaatataatgctagttccacaaggatggagagataagggagtgtgtataatgcaggcactagagctctgggggaattcaagagaaggagaagagtcacaactctaattattagaatttagggtgctgctattcttcattctagggaaactgtcccttgcc

SEQ ID NO: 226162 - DNA, 433 bp, Homo sapiens
tgaattaaaatcacagaaatttctaaaccatctataataatacactgtacaaaaactgaggtgaagaaaatatgttactcctcctgtaggagacagcttttaaaaaatgaaaatatattatcacttttaagttcctactatgtgacaagaattgtgttaggtaatttgcatgtcatcatatcacaatccttctagccataaagtatctctcttttttcttttacctagttcttactccttgtcattgtgcttgagggaatttggcattgtgtgctatcacttcgattagggaaacgcaagatccttaactaggcaatgtatagaatattgagttgaaaagccatacctcttctctacaagtgtcaggatcttcgaatgggaatttgatttctataataataatttaataaaagtgatttctagcaacaaaatt

SEQ ID NO: 226163 - DNA, 453 bp, Homo sapiens
attcaatgttgcaatatcatttacttccatattatgtcataatacttggtagctttctgacatgacaagtcattttattcagaagataaaatggaatttagccatctctgtgtttaccctaagtcatctatgtaccaatctgcaagaaaatattagttaaatgttagcagaaaatgccagttgtgaagtgtccctttgaaaacataaattttcttgggggaaggggaatgtgtgtgcgggcatgtgtgtgtgtgtgtataaacatacacatctatatgcatacacatctatatacatatgtgtatatattactttattattgaattagctaaataaactccatgttagaaattcaaagaaatcatttgtgtgataaataaggttgcttattactgagcaactatgattatagcagttttatgaaattttaattacattatgcacctactcaaa

SEQ ID NO: 226164 - DNA, 238 bp, Homo sapiens
aaattagacctgaagagtgtatgtgatatataaaggttttaacttttgattatctaattcattttccttgtattcttaaactttttctccctttcagtgtttacatagctttaaaatttggccgggcatggtggctgatgcctgtaatctcagtactttgggaggctgaggtgggtggatcactcgaggtcaggagtttcagaccagcctggccaacatggtgaaaccccgtctccac

SEQ ID NO: 226165 - DNA, 468 bp, Homo sapiens
gatgggtttgtctccctgtattgtgtgtggtctgtttacctgaagtgtggagggcttgtttgcacatgtgaagccctggggacctgggagtaaacatccccattcccctcaccctttcctttgtgtggcatttactgacaggtaagaggagaaaagattagctgcatgttgccttccctttcccagtcttctgtcaggttctctcttgcaaagtgaaataaattaatatttacttctaaaatcctggttcatggtacattttcccagttaaatgaaattgaaacaaataggaaaagatgcaggaaaaaaaaaagctgacatttattttgtgccaattctgtttgccaggcattacagtagatgctttacagacattatctttttttttttttttttttttttgatgcagagtctgccactgcactccagcctccgtgacaaagcaagactccctttggggggtggggg

SEQ ID NO: 226166 - DNA, 479 bp, Homo sapiens
aaaggtgtctgggctgggtatggcggctcatgcctgcagccccagcgcttggaggggccaaagtgggagggaccattgagcccaggagttcgagaccagcctgggcaacagagtgagacttcatctctacacagaaaaaagtaaaaattagccaggtgtggtttctcacgcctatagcctatagtcccaggtactcaggagactgaggctggaggattacctgagcctgggaggttgaggctgcagtgagctatgattctgccactgcactccagcctgggcaagaatctcacacaggttaagaccagcccctggtctgcagggtatgaccggcccctgggggggccgcagatactggggtggaggaggatgggcagcgacccctgggactctggggagaattagcctgcaccccagggctcgcaggttctgggggtggccgggcggttgccgacgctgctctgccgccccacaggacg

SEQ ID NO: 226167 - DNA, 423 bp, Homo sapiens
aaagaatacctggacagcctgccaccctattgctccaaaatgaaaatcctctaacagggtcaactggtggcagggaacaaaaccccgctgagactggctgaaacacaagtggggcctgtgctcagggtgcaggaagtggagcatccaaggggagaggtgtgtccacagcatcttcaccaggattagatttcatctcaagaaaccactctgctcatccgtcatggagatggcttatttccttaaacctcatgaaccaacctctactagcttcagatttttcttctgcagtttcctcacctctgtcagcctccatacaactgaagagagttaagggcttgctctggattaggtattggcttaagggaatgtcatggctggtttgatcctctatccagaccactaaaactttctatcagcaataaa

SEQ ID NO: 226168 - DNA, 341 bp, Homo sapiens
caatttgtatacattctccaaggttgtaattttatatggaaacctcgcaaataactttttgtgtctatatcctcacctggtatatgcttgctgagtgtccagagcaatagtctatcatcgtagaaaatggagatacccttgattagaaaacatagctactgaaagcacatctgaaacaataactatttggtttttaatttatcatccatcttcacatactctttttattgtcaaagtattctagactgctgcattttgttaaaatctaagaacaaagctttattgcttaagaggatgatttggctataattttgtagttatattattccttatcaacttaa

SEQ ID NO: 226169 - DNA, 374 bp, Homo sapiens
gcgtgtggaggacgatggcagcgaggggccatctctaagtttctcaggctgagaaaaaaacatcagtgtgggggaagatttgggacccctgtctgcatctacctggactctcattaaacagatgatgtgatgaagcaatcagaaagcctggccagctgctcacctccagggcagcttcttgggaagacagtgaacaattctgggggttaagaactgtttttaaaagaaaacactagggaggctggggcaggaggatcgtttgaggcccaggagttggacgctgcagctagctatgattgtaccactgcactccagactgggtgacagagcaagaccttgtctctaaaaaataaataaattaacctttaaaaacc

SEQ ID NO: 226170 - DNA, 378 bp, Homo sapiens
gagtgctctccaagaacctgcagctgcaggtgccgttgatcctccactggagccggcttccaccaggagtggggagcaaacaggaaactctgacgctcctgtgatggccccattactccgcgtctgactcctcacccagcagaccactatcgtggcttttcgtgaatttccctcagaccctgtttctaccctgactttgtctgtgaagctgaaggcagcctggggaaaacgtgcagtttctacaggacatgagctggtgacttacataatggcttatataagccccaaactcaaataagctagaattcccttggcccatcagaggcccatcatgaagttcctagttccatcaaatgaagtgtgagaagcccataaaca

SEQ ID NO: 226171 - DNA, 348 bp, Homo sapiens
tagttgattgcctgaaaatacagaagaatagtggttactggatatcaggaaaggttaggggggatggatagccaaattttggttaatcagtacaaaactaaatagctacatagaaagaattaattattttgccttgtagcactgtagggtgacaataagtaacaatgtattgtatattctcaaatagctagaagagtgggctttgaatgttcccaacagaaagaaacaataaatgtttgaaatgatagttatgctaattactctgatttgatcattatacattatatgcatatatcaaaatattacactacataattatctgcaattattatatgtcaattaaaaaca

SEQ ID NO: 226172 - DNA, 526 bp, Homo sapiens
caaggtgctgcaggctaataaagcctggggccccacaggctcgacagtcattgaatctttggagactctatttccaggacaggcaaacccagggactcggaaggtaactcccccagatttctaggaacacacaaagagacgaggtctgcatcaagatttaccatctactccaacccaccggtcccccacctgccctccttgcagagctgagcttgatcggggtggggaggggaaacttgactacctcctcaaaatacccccactcatccagcctgcttcctttgaagcaaccgaagtggacgcttctcgttaaactcgaagctcgttagaaatgacacattttacagctcagctgggttcaccctcctagcgccgagcccaggccgggcaccgatcgctgcagccgcagcagcacgcggcccgggctgttcttcccctgcttggggctcgagccattttcggaagttcccggggaccgcggagcggctagcgcgcccggccccgggttgcaggggccccgcccggc

SEQ ID NO: 226173 - DNA, 664 bp, Homo sapiens
tttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccatattgtttact

SEQ ID NO: 226174 - DNA, 464 bp, Homo sapiens
caaactaatgattaatgataatcatatataatcatatctataatctatttttagtataactattcttattctatatattttctttattatactggaagagcttgtgccctcagtctcttgccttggcacctgggtggcttgccacccacgattacctccttgtaaacgtggatgtttgatagggaaagggcacaaggagttggtctgttttgcttgcgatcaatgcccaaaatttgtgaatctaattcattcttataagaataaaaaataattaagattattattgctggaccctcttagaccctatctggcagttttccaaaaggatttcccataaaaggagataattaatgaatgtaaaagctaaaattattaaaataaaaagtaaagaagaaataatatgcatgactaaaaccttgtccactgagaaaataaaaacatagaatccctccagggatttactt

SEQ ID NO: 226175 - DNA, 758 bp, Homo sapiens
ggatcacgaggtcaggagttcaagaccagcctgtccaagatggtgaaaccctgtctctactaaaaatacaaaaattagctgggcttggtggcagatgcctgtaatctcagctactccgaaggctgaggcagagaattgcttgaacccgggaggcggaggttgcagtgagccaagattgtgccactgtactccagcctgggcaagagaacgagactcctaaaaaaaaaaaaaaaaccttctttgtaatggcccaggctaaatagagcaataggatgtcatcatcctgaggcaaagcaaagttcacctacatgaacatgaataagcagaatccggcagtctgtaaatatgaggcttgtcatgcgtgccagaaatacagtgttgagcaaggcaagcactgcccctgccctccttgcatgacctcattctgaaatagtgaatttaacagcttctggagaatggaaaagattggagtggctttttcagactgtaaatcaactccttggagatgggttaaatcctctttaattgaaaatcactttttataatgaaagaggttatttatgggcacatgcagctgtgtgaacagtatagaagcaggaaagaggttgagcacttctagtgtataggatgattaagaaaattatacctattaattcacccatctatgcattcgcccaatcaatttttctcttaaaaaatgggcagagttcacagagaaggaacagaaatgacaataacatatgaaaaatgcctaaatt

SEQ ID NO: 226176 - DNA, 486 bp, Homo sapiens
ctccattagtgtgaacttcatgtgaccaaattatgggtttaagagacaaaaaagggtatgagatacaacgggagcagcaaggacaacatggccaaaatgttctgtgaagttggtaaagactcctcagaacagctgacattttgaagcaggaatatgactttcctggagataaaggcaagaatactagagcaatcactctccatattaccagacaaggaagtacaatttaggcttactagtagcaagaactcctaaaaatggctttctgtgaaaacaagtggtcttgaaattcataataattatagtctactcttgataatccatgttgaagaaggggagtacagttgtaaggaaaacatgaagtttttcacaaattgtaattaaaatgtaaatctttttgtatatacttagatactaaacttgaattctggttgggaagggtatattatttggatgccaataaaatgagatataaatctatgagga

SEQ ID NO: 226177 - DNA, 434 bp, Homo sapiens
agtccatagtttatattggggttcactcttggtattgtatattctttaggttttgataaatatttaatgacatttatctaccattgtaacatgatacagaatagtttcactgtcttgaaagtcctctgttctttgtcccttcatccttccctctaccctaatgcctgggaaccactgatctttttactatctctgtagttttacttttccagaatgtgaccgtcacgtaagtggaatcatacagtctatagcctcttcagattggcttctttcacttagcaacatgtctttttatggcttgctagcttatttctttttagcactagttaatattctattgtctggatgttccacagtttatctctttatctgctgaaagataccgtggttgcttccaaatttggggaattgtgaataaacttgctatgtgcatg

SEQ ID NO: 226178 - DNA, 659 bp, Homo sapiens
gttgactttaagtaaagattacccttgataatgtgggtgggtcacattcagtcaattgaagcagttagagtcaaaacttaggcttcccaaagaagaagttctacctcaagactgtaacatcaacccttgtctgagcttctactccattagcctatgaattttggacttgcatatacccacaaattaagtaaaccaatagcataaaaatatctctctctatctcatctatctacatacatctcacactgtacattctgtttctctgggaaacactaatacatcatcttaccacttaatttttttaaccaattaaaatctgtcactatcttcctaggatttgtatcacttaatattcactagagaggttagtttaatcaattataaaattctcatttaacaagaacaactaagacctggtgaagagagaacttttccaaagtctgactataagctggtaattgaattcaccatcaaattacaaatcatttattttaaagaatctggggttaaaattaacctggcaggcaccaatatttttctgttttgcaaaacagaccacatatttaatgttatttctctaatatttatggtcatctgatcttgccatgatttaaactgtatcttcccaaatctccatcagaacctttgacacacatttt

SEQ ID NO: 226179 - DNA, 750 bp, Homo sapiens
atagtaataatgtctagcaagaattgtacatgtattagctacataaaatcaaaaccaggctggcatgctggcattgctgaacagaaaagacagaattttttataatctttatttttagttaatttcttcattcgctaaaattgccaggttgttttttaaaagttgctagccaaactgctttggcatgctaattagatataaaaacgatggactccgtggaaggggaaagatgaggagggatccagggcagatcttcaaggagagcccagagataaagggcagaacttaaaggagctattttcagtgacttcccttatcaacaaattcattatggatacgtgggatgaagggtcatgttcaaaacatgtaacaactgatatgtcgtgggcatcaacaagtcagaatagcccccagctagaagctactagaacggttgtacgtgagccctgcctgtgattaagccatcagctctgggctcttgcttttaaaagttaatatcatttgtaaagaaaaggggtagaacacagaaaagaacaagggaaagaaaaataccagcacagaagcgaacagcgtgggagtccatgtgtcttccgctttcagcataactccctgatcccgcttcccacccaaacctccctcgccagggaatgcttgtcttctccaaatatcacattttcatgtaacaccctaaagtataagtaccaatgctttaaaaaagattaaacatcactgcaataatcaataacaata

SEQ ID NO: 226180 - DNA, 196 bp, Homo sapiens
aacaacatagagagaaaagaaagcagttaggaaggggattgccttagcaaaccaaagctgtttcacgttacttcattaattacttaaatgggaaaattttctcagatgcacattttagtactttaaaaatgaagcaaatgttttaacatttatgctgtatgtgataggtttgtatagagtgagagaatatacattg

SEQ ID NO: 226181 - DNA, 564 bp, Homo sapiens
ttcatttaggtctttaatccattttgagttaatttttgtatatgtagtgagatagaagttcaagttgattctttcgcatgtggatattcagttgtcttgtaccatttgttacaaagactattctttccccattgaattttcttggcactcttgttgaaaatgaattgaccatagttacaaggatttattgctggactcctaattctattccattgatctgtatgtctgtcctattgccagtaccacttgtcttgattactgcggcttcttgattactgtggctttgtagtaagttttgaaattgggaagtgtgagttttccaactatgttctatttatttatttattttaagagattttggctattctggtgcccttggatttccatgtgaattttaggattagtttgtgaatttctgcaaagaagccagctagaattttgatggggttcgtgttgaatatgtagaccaattaacaatattaagtctttcaattcatgaaatggagtatctttcagttatttaggtcttctttaatttccttcaacaatgcactatagttttca

SEQ ID NO: 226182 - DNA, 308 bp, Homo sapiens
atgtgaaaaagtgaacttagtctctaccttcaagggagggaccattccctctcctctccctctcctctccctctttcctttcctgtctacattattattcaggctttcttgtgtcagcactggagggacaatgagctttcccttctgttcacatatcactggccaaaacttgatctctacattaaaagaggaaagtggacaaggaacaaggaatggtatctacctcatacctgtgttttcaaaaaaaatcttgtttcaattattttaaagggtagcaaatgcttataataaaaatttcaaaaagtaaa

SEQ ID NO: 226183 - DNA, 550 bp, Homo sapiens
ttttctgagcaaaggaatcaattacagggtgtggctcccaagtgaggaagcattttcagaaggcatccaaggcagtttgtctctgaacttcatggttgcacctctgagcttgagacttagagggggagtattttaactttaataacattcatggttttacctgtacttttgtacatatcagatgtgctaattaggaagtcacttatcttttccttaaagtaggtttcctaaggacatgtatttggcaatattggtttagcaagaattactgtatgtgcttgaaagtaactgtacttctttaaaaatatcacccgttcagaagtgttgccagtgaagcctggcctccccccactcctattagttctgattagggaggtttgatgcccgtcactggtgtaatctggaccttcctttgtgactcattctttctctcattttctcagagcaaatacaaatcgcccatcaaatgacaagtgaaagcacagggggaggcgaggggagggaatcagggccgaaatctgttagctatttggagtaattggttatttgc

SEQ ID NO: 226184 - DNA, 542 bp, Homo sapiens
caggggaactgcttgaacccaggaggcggaagttgcagtgagctgagatcgtgccactccactccagcctggtgacagaatgagactctgtctcaaaaaaaaaaaaaaaaaaagaatctaatatatatgtgtatatgtacacatacaatcattcatttgtctattcactcatttagcaaataatcgagattctgtcaagtacaggtactcactatgaacaaaacagcttacacattatcgtgtaaggaaaagaaatataaaatagctaatgacattcgattgtttcattactcttggggtatctgctttgaagaagtgccgggaagcatctgataggccacttgaatctggggaccatggatagcttttgtgtcaataaatacagtccctgaaacatcatacttatgagctgcatagcagttcattgggtagggcataccatgttcttttcaaccagtttcttgttgggcttagctgggtgttctgcagtttgggctgggcttagctggatgttcttctgcagtttgggttggccttactta

SEQ ID NO: 226185 - DNA, 345 bp, Homo sapiens
tcttaaaaggtatgtaatatttttatagtttaaaataataaaatgagcagtcgtgaacctactatccagtttaagaaagaaaacatcatcccatgtgcccctcccagactcatccctccccttccaggtaaccattaccctggagtttgtgttcactgttcttcaattttctgcatagctttcacaaactgcgtgtgttcctaaataggatatttagtcatgcccatttctgaaactgaaatttaaatgtttccactctatatatgtgttttgcaatatgctgtttttgctccatattatgctttcagaaatttacccatcataatgaatataactgttaattta

SEQ ID NO: 226186 - DNA, 302 bp, Homo sapiens
gagcaactgtgttgtgcgagcatagtaaaggtaaacacctaagatgaaaatagtaagataagcaagaaccagatcacatagagtttgtaaaggactgaagtgtgtgatcctcccaagaacaatgggaaataattgaaagtgttttaaagcagaggaataacatgattaaatagcttgagaagactattccacaatagctataggtggaaaacatgttagaagaggtcaaaataagttattaatgttggtgaaaagggattatgtggattcaactaataacacagatagaagtggatagattc

SEQ ID NO: 226187 - DNA, 1028 bp, Homo sapiens
gggtttactcctggactcttaagttatgttccattgatatatatgtctgtttttataccagtaccatactgccttgatactgtagcgttgtattaagttctgaagtaagaaagtgtgagtcatccaacttgttcttttttcgagattattttggctattctgggtaccttgagaatatgaattgtagggttaacttggcaaggtctgtaaataagacaactgggattttaatagagattacattgaatcttttggccatcctaatacaaagtcttctgatccaaaaagatggaatgtcttcccattgatttagatctttgctttctttcagcagtgttttgtagattttattgtacaggtgttaatacttttgttagatatatccgtaagtgttttattctctaatgctattataaatgaaatcattgtctccattttgagatcgtttagaagtacaattgtttttcgtatattggggcacatggcttttactaatagaaaaatcatatgtatacatgcttgtttactaagttttaggcacttggtcaatgctgttgattttctgtttgtaacatttgctcgttggtcatcacttccttttctgattggaaaattattgtagcagttctgctgagcatgtactttgaagtactttatcttctagggaaacctgaaattcttaagcagctcactctgggactcagctgtctgtgctttactctgctctgatagagcagtttaccagatgtgcatgtggccatctgagtggaacagctgtgcagttgagatgaattgctgttagaggtgttgtcctggaactgtctggttgcaggagcaatggtgccttccagtgcatctgatgagattctaactgaatatgtgaatatctggtatccaagctagatttcagtagaaaccgcagggaaagctgtctgctcatttagaatgttggagggctctgtttgaagtttgcatttctctttgaacagatgctccattgcaaaataaaaggtttgaagatttcaaca

SEQ ID NO: 226188 - DNA, 856 bp, Homo sapiens
tcctaaaaccagaatgggactgcagttcccaaaccccctacctcctcctgacctgcatggttaggtgctgcctttctgcaggagcctggatgtcagcatctagatgcctcaggaccagctgtccaatcccccttccaccaatccctgttttaggtcctccatgaactttttcttaggggaaagcagaaatcctatcccatcctgctgcactcacaggaagagtttgacagtggttaagagatcattctcctcattcagcacctcggtgaggtgtgaatttgcacaagatgattcaatatattttctttgtgtattcttcagtatattcatgctgtccggtgaatttttgacatttcggtgtgctgctctaagctgcccgtgttggggacctgatcctgaccctgactatggcttttaagcaaggagagccagaataaacccagacaaatagtcctttgcagtgtgcactggtgcccaggtagcccttggttatctgctgtgttcagtcctccggagggagtgatgaaaagggcagtcggccctccttccaagatagcttgtaagcagtcctgccttgaggctgagggtagacgagatgacccctccagtcccatccagtcttggtatcctgtgatttctcacgtgagtccattttgtgccctgggctcacgtacatcaattaaaaacacaacagtgtatgcttccacaggagggaggaaaatgaaccatagcagtcttcctatccgaaccagaccccatttttccaagtcaccaccttactctcatctgtaaagcgctaaatagcctgagacccagttatctttgtgacaatctctccccaggtgccccatcacgg

SEQ ID NO: 226189 - DNA, 541 bp, Homo sapiens
gatgataggcatgagccactgcacctagcagttatttttattgatgctcaatttttcccttcgttgaatgctggtgcagtgaatgctgggtgcatcttcatgttggtttctgagtccttttgacatgaccacatggtctggtgttgtacgagagagcaaaataaggaaactggtgttctatgcttatcttgtacattttccccacacttggaatcagccattcctccagggagtgcaggttcacagtctgggctctaagagaattataaggtcaatgtggtcatcttttagtattaagtcagatattctaaattattatttacttcctacatttggcccaagagtctaaccagatattttgggaaagagagaaggaattaaataaataaatctcatggttagaactgaagtgataactatactttcacaaggaaatataacttataaaccatgcagaatagaaaattatttttgttcctttagatttctaaaggaatgaaataagctgtgggaagaaactttaactggagcatcttaccag

SEQ ID NO: 226190 - DNA, 473 bp, Homo sapiens
tgaaataattttgtaatggataaccataacaagtaccttatcattgatttaaaaaacaaagcattacgttttctcatcaattgagtggagttttttaattatacaaatatagtgaagaattttaggataaagcacattccagaatacataattctaaaaatgagcaaggctgtttgccacttggaaggtgggaaattagttttaattgaatgattagaatattgccagcagtttcttaaacaaattttaattaaataatttttctcaggtttgccaatttaaatatttctcaaggctgagaaaaaaatattaattctaaaaactaacacatgtgagatcttctgtatgttttgtttttttttcagaaagtgatataaaatgtggtggggaatattcaagaatgtaaaatgtaataaatagcattatttggagtgtacaaattaccagtaacttgagtaaagtaatctttcttc

SEQ ID NO: 226191 - DNA, 506 bp, Homo sapiens
caccccttcagggtagggtcccctccatgcagaccatagagcacaggtgtgccccaaagaggagcagagagaaggagggagagggcccacgagagacttggaaatgaatggcaggattttaggcgctggacttgggttcggggcacctggcctttccttgtgtatttctcctactgtctgcctaactatttaatacaataaaagaaaaccagcccctggttcttgtggtgtttccaccctcccgggtccccgctggctgcctggcttcctcccgcagctcctgctgtgtgtgtatgtgtgtgtgtgtgcacatctgtggggcgtatgtgtgttcgtctttgtaattgaggctgcagagtggagagagcaggggttttctctggggacccagagagaaggaggcgttttcaccacagccgaacagggcaggaccccagcacccgggacccagcgggactttgccaaggggatggacctggctgggccacgcggctgtttgtgtaggg

SEQ ID NO: 226192 - DNA, 238 bp, Homo sapiens
aagatctacattgtatcgggcacttgacctattatctcagttagttctcattgttaccctgtagcagtgattctcaactggcattatcttttcctaggagacatctggcagtgtctggagacatttttggttgtcacaaatcaaaggggttgctactgacttttagtgggtatagtccagggatttgttaaacatcctataatgcctgagacagccctcctagcaaagaatgatttgg

SEQ ID NO: 226193 - DNA, 324 bp, Homo sapiens
atgcaaatgttggttcaactctcttagtgtgtgtggtgtgaggggggcagtgttgacaaaatctgtgctgagagtttacagtttttataggccatggttaacgcctagttgagaagagggttccgaggaacctgactgaagtttagtcaaggtgagagtctttgtcaagtggcacgaaatgtttatctgagttcaacaatgaatgcccttggctctgctctttcagaagcatgggcaccacagaattcatgttacaccaccaacctaaactgactcataacatttgtctgtggcatttcctaataaaggccaaaaatgagagag

SEQ ID NO: 226194 - DNA, 350 bp, Homo sapiens
tgtcctctgctatttcttagcagaattttgaaaatgtgccaagtgttgacttggttcgatcacttgtgagaatggagggacccataatgttaataatcaatgaaggttgttggagttacttacccaaaaccttatgaacttagccttccctagcagattgagtttcctaatttgtccggtataagcaaacactaaagagggattggggaaagttgtgagttgagtagttgggaaaaaggtagtttgcagttttatttacgtctcacagcttgacattttttgtttgccttggagggggtacttttaaaaattcctcttttgaaaacaataaaatcttagattttggataa

SEQ ID NO: 226195 - DNA, 533 bp, Homo sapiens
gatggagaaaatgagaactagggaggttaagtgacactgagttatagaatcttagagttagaaaggcccttaaatgtcaccttgccccactgcccaaggtcgtacagctaattagtataatagaatgtgcctctcgttctgcagccgtgcccattctcaaaccttgagcgctgcacgcatttatctcaagttcacaaaaaggccatgcactatactatttgtgcaagagtgagtctgttagaataaaattgtctttactgctaccctctgggaccctcacagaattgagatgttgatcgtatgaagcaatcttattgaacaaaaaaacttccaaggaaaaaagttgtgtcccctgagccagccagtctctgctaagggggacctgctgctttgcagagtgagcagctgaaagccaggagggaatgattagagaggccaaccattggttaaaattctccgaacataaatgatctccttgttctccctttgatggattcggtctctcaaaaataaaatgcatctgtgaacatcac

SEQ ID NO: 226196 - DNA, 538 bp, Homo sapiens
agaggtgcgcgctgcgcgtgggatcagcccggcgcccgacgggtggctccgaggagctcgctccttcctcgcccccgccccctcgccgcgcggggccagcccggccgctcctcccctgggtgggtccctgctccttttctggcagggtctatttgcatagaggaaactgcccaaagtggccgctgtggaggagctggctgcggcgaagggggcgtgcgcggcgatccgctgctacccggaggctaacccccgcgcccggcggacctcgtgcctcgggctgtcccgcctgctcctctcgcacccagcctctgccccagcagcaccgccccctcggagagtccacgcgcgacgaacgcgccatgggcccaggcgagcgcgccggtggcggcggcgacgcggggaagggcaatgcggcgggcggcggcggcggagggcgctcggcgacgacggccgggtcccgggcggtgagcgcgctgtgcctgctgctctccgtgggctcggcggctgcctgcctgctgctgggtgtccaggcggccgc

SEQ ID NO: 226197 - DNA, 396 bp, Homo sapiens
ctatcaaaatttgttttgttttgttttttatttttagattggaacttttggcagaaagtcaaaactgtcttcatatctgtatccttagaaagaggtgagttacaggtcaggcactgtggctcatgcctgtaatcccagcactttgggaggccgaggcaggtggatcacctgaggtcaggagttcgagaccagcctggccaacatggtgaaaccccacctctacaaaaatacaaaaaattagccaggcgtggtggcaggcatctctaaccccagctacttgggaggctgaggcaggagaattgcttgaacctgggagacaggggttgcagtgagctgggattgcactattgcattccagcctgggtgacaagagcgaaactctgtctcaaaaaaaaa

SEQ ID NO: 226198 - DNA, 446 bp, Homo sapiens
gtccgcccggcttgaggcccgcggggagcgctgctcatattcgtcggcccgcgggggggcggcctcccggcatcttcgcggcgaccaacgactaccaggaaggggagcggctgggatggcgcgtccgcggccccgcgagtacaaagcgggcgacctggtcttcgccaagatgaagggctacccgcactggccggcccggattggaacttttggcagaaagtcaaaactgtcttcatatctgtatccttagaaagaggaagacttctgtgaaaatgtgacacttcagcagagttggatgttctgaggaaaaagtaggaatgagctcagcataatcaaggaaaagcaagaaggcaaatgaggcgcagagtgagcgagctaggacctgggggagaaggacagaagatgaattcagattgatgaactcccagagggcgctgtgaagcctc

SEQ ID NO: 226199 - DNA, 365 bp, Homo sapiens
gagtaatgtagtcctttagaaccctttgctatttttacttatagggaaaacttcaatttagcagtgggaatgattcttattttagtatggtattacataaaatcttatctttatcctaatttttgatcatttacaaatttgatttctgaaacttttagtgttcatgaagattttctgtggttttgtttttaaaagatttttttgtcctctaatcccatgtgcatctatctttacacagtttatgaagtattaactgctgctgtttcccattaaaatcaacttttgaacagaaactaaatatagttgctttctctcctaaaatagaacttttcagaaagctctgggaaagtttcaaaaattaaaaa

SEQ ID NO: 226200 - DNA, 391 bp, Homo sapiens
ttgtagtatctatcagtatgtatggagataccacattttgttaatccatttatcagttgatcagcatttgagttgttttcacttttgcctggtaagaatagtgctgctggccaggagcagtggctcctgcctgtaatctcagcaatttgagaggctgaagcaggcggatcacctgaggtcaggagttggcaaccagcctggccaacatggtgaaactctgtctctactaaaaatacaaaaattagccgggcgtggtggcgcacacctgtaatcccagctactcaggaggctgaggcaggagaatggcttgaacccaggaggtggaggttgcagtaagccaagatgatgccactgcattccagcctgggcaacagagcaaaactccatctca

SEQ ID NO: 226201 - DNA, 376 bp, Homo sapiens
ttatatatactatctcatttattcttcataaaaaccctatatataggcactgttattatcttccttttacaaatgaagaaacaatcataaagaggttaagtaatttgcgtaaagccacaaagataagtgaaagagctgggatatgtacccaggcagtcatatctcatagcttttgctagttaccacctcactgtactgacagggagaaccctggatttaagaggcagaagttcggctgggcgcggtcgctcacgcctgtaatcccaaagtgttggaattacaggtgtgagccaccgcgttcggccgagtaacactttatacccatccttgaaaaagaaaaagggcctttatgaacactgacacttaaaaaaaaaaa

SEQ ID NO: 226202 - DNA, 436 bp, Homo sapiens
gatatataaaagccctttccagtccttctaaatgtttttactgtcaacagggcacagttattttaatgtatctactgttcccactgactcatcgggtctcttgcaaaactcagggtcaggctgaggagatatacgggagggtgaaactgctgttgtaataatcaagctgtacacctgtgatttatgaacttttctgtgtgtgtgtgtgtgtgtgtgtgtgtagctttgcacttaaaaaaatttttagaaagctagcaagcaaacaagccatgggtcctggcattattaaaagttttatcaggcatccaaggaaaaataattcgagtcttctgcagtcagtctctcataaggaatagaaaaccaagtaactactacctcagttttgaggcttttgcaaccttgataaccaaaacttaagaatggcaacatgagatta

SEQ ID NO: 226203 - DNA, 466 bp, Homo sapiens
caatagtcaggcacagacccagcaggcttgccagcgggagctgaatgcaggctctgggcaccaagtccaaagctgcagccccaccccaagccctgtaccaagggggctgctgggcaccaaggatggcaggtgggctctggctgggaaggaaggctgagcctgcacaggtggagagggaagagcaggcagcgggagtcccggcagaggcacagggctgcccaggcccgagagcgcccgattcagaggggctcggacacagcagctgttgggagcccaccccagcgactccagccacctgtgctgtcactgcctgacctctgcccagggccagtgtggacacttaagctaaattggtcaattacaggatacttagatccctccccggggcttcccagcctcactgcattctgggctgcagcaccaggaagcctgttgaatcagtaacctcattacagccggcggccgc

SEQ ID NO: 226204 - DNA, 310 bp, Homo sapiens
gatagggccgtcagaaaatgcttgatcgagtagggcgactggctcccaggatccggcgctttccactccccaaagcccgtcaccctagttgcttttgcctctgatgcttataaaatacgattataagattcgtttttacgctgtgtgaacaagactcctttctttataaccaaactaagtgactttttttctgtctatgtagtttattttatggcagggttttcggacactcttctttactcaggcttacccagcgtaatgctagacacggaggtggcactcgataataaactctagatgatttttctaa

SEQ ID NO: 226205 - DNA, 312 bp, Homo sapiens
gatacattgtaatatcatgcaggattgctagagttgggtctcaaattaatttctaacatctttagaagtaagtcaaagatagaaactcaataaactctaccacattcgtagtgactacaaaatttaatttaaattttccctggacccatagctgtccttggccctaaagcctggaattccatatacttggagttccactctgcagtactattaatacagtaatgaattttacagctatctcttggagcacagctcaaagtaaattaaagagggcggtcaggaaacctgatttcataaaagcatcaaagtacc

SEQ ID NO: 226206 - DNA, 491 bp, Homo sapiens
agaattcatttcatgtcaatgtcagttctagtgattcttgccatgctttcttgagaaagatcctgaagccacatccagccatagcagaaaacagctcccggatctgctacagctgctgagatggagaatggtgacatgcacactggggataagcgttttccccacagcataaagaagttttacagcaagacttaggtataatgtgactgattaattatgaaatgcaactgacatgaagcaatctattctcaaatgaaactagtcctctctgtgtaaaagaaaaacactctgcagacacatggcaacgcagctgtgtatctgagtgaacttgtattttatcatggcaatggataataagggatagtgacaagaggcaatttaaattaagctaccctgaagtggcagtagttagtacacagtaagaaacttttttttgtttgagacagagtctcaccctgtcgcccacactggagttcagtggtgcaatctcg

SEQ ID NO: 226207 - DNA, 349 bp, Homo sapiens
aatccgtagggtcgtgtccccccagtccagtccctggtactaagcccggagctgccggaggtcatgcagcctttccgcgcccaggtgaaaccgcctttgcaaaatgatgactgaaacagtgaaagagatctaactcagccgactctatcttgcttcgagcgtacattcatgtcatgatactttaaaatgtcatctttgctagcacaagaattcagctgactccctgtgatttcctccctgaccaatcggctctcctggctcactggctctccccacccgccaagttatccttaaaaactctgctccccggcactccagcagcctgggcgacaagatcaaaacaatctca

SEQ ID NO: 226208 - DNA, 387 bp, Homo sapiens
atacaagagcgatgcacaagaatgacatagagaattatgtaatgctggccaagcaatgtaaaggatgcaccattttgggagaaaacccgtcaagttgaaatcactgggcgtatgtgaagaatataggcttaaacggtgctactgaggtgaaacatgaggttcccatgaagacccagtgagatactcagggactcaagtttgaatcaccttgggagaataaaccaggccctgtgccccctgtgcccccactaaaaatcaactgattgccaactcaatcctctagactcaggaaatatgaaaataagcactttgattaaagttgaaagatctatgaagaaggtttaaatataatattcctttaagtattgtaattattatttttgcata

SEQ ID NO: 226209 - DNA, 424 bp, Homo sapiens
ctatcccactgacacctgcttactcctgcctaaggcctttgtataatgcctggtctgcctggaaggtcacccccagattcctgcatggccccttccctcacttcctacgggtgtctgcttaaaattagaaaaccctggactgggcgtggtggctcatgcctgtaatcccagcagtttgggaggccgaggtgggtggatcacctgaggtcaggagttcgagaccagcctggccaacatggtgaaaccccatctctactaaaaatacaaaaattatctgggcatggtggtgcttgcctataatcccagctactagggtggctgaggcaggagaatcgcttgaacccgggaggcggaggttgcagtgagctgagatcatgctattgcactccagcctgggtgacagagcaagactctgtctcaaaga

SEQ ID NO: 226210 - DNA, 452 bp, Homo sapiens
agcaaatgcatttaaaaaggaaactatattacttccacaaatgaaaagcttatgttatttgccaagaaaggaggtcttcataaaataaatgcaaaaatattaaaattaacaaccacaatgcacttaaaacctaaactcatcccttggaccacctgaggtgcacacaccacactttccttttattccaccaagcaactcacctcagcccacctttattgctgcaaatctcaccagcgagtcttttccatgtgtatgtatttttccagagttggtcatcttgtacatacttttgtaaatactttaaaatatatatatgtacatatatgtatatatatgtacatatatatctatatacacgtatatatatcctgagcatttccgtatactttcaaatactaaatacttattttctttggaaaggtaattcattaaatgatacaaagactatgcag

SEQ ID NO: 226211 - DNA, 357 bp, Homo sapiens
taagtgcctagagcccaccacagtgacctcagaggagaacacagagcttactagcacaaatctttgcattcaggaagacctggggttgaatgctgcccctctaatttattagctgtgatatatcctctccgcagctcaattaacattgcacaagccttagtttactcatctgtaaaatggggacaatgataccaacctcagttaccgtaaggcttaaaacagacagtgttaataaagaaccaaatataagcccttaagaaatagtagctgttgttttactgctgtaaatggcaacagcacaaggacaatgctgtgtccacaggcacttgtatgtagaaggaaagagccaaattaaaa

SEQ ID NO: 226212 - DNA, 291 bp, Homo sapiens
ggaagcctaggctgatatatgtgtttgtgtcttaggttttaacagaaatgtttaaaaactaaaaaataaaataaaaatttttaaaattgaaaaaaatgcttatggaataagtatataaagaaagaaaatatttttatacagctctacaatatgcttgtgttttaggctaaatgttattacaaaagagtcaagaagttttgaaaattttataaggtaagaatgttgccattagctaaggttattagtgaagaaattattttttaaataaatttagtggagcttaagtgaata

SEQ ID NO: 226213 - DNA, 1273 bp, Homo sapiens
  misc_feature (20)..(20): n is a, c, g, or t
gtcctcccagtcctatcctntccagctgttgagaaacacagtttttgtaaatcatcataaatgttcttaaagacacgtaacagttcccccaaagtgggaattcaacgccatacaacaagtttttggtgttgcaaaccacacagaagactctagaagtagcaattccctgctgatgagcacagcaggactggtccatagaataagagagatttatgcagcccagaagctccagaacaattgtgcatcccagtaaacaggcctgtgtatactactcaagcaactatttagcaagtgggatactcatattcttggacaatgctagcttctcccaaggcaatggctctaaattaagttagttctaggtcttggaagtagcaagtcaaggaagaaacagattggggacccttgcctatggaaccactagtaacttttcttctgatccaggctagaatgggtagtacataaccctgactacagctatcacttattactagatctactgaacactgacatttaattctcacagtaatcctatgaaaacaattgtttgaatctttagtttgaagaaatgaaaatgaggcacagagtttaggtaacttgtccaaggtcacaaaactagtgagttccagaaacaaatcaaggtctgattctaaatcttgtttgtcctcccagagtcagacccagaaaactgtaaaagacaagtacagtagagtcacatcttaacacaggagttaggtccgaaggtcagtgaataaggcatatacgctgtcaaaattacccttgcaaatcctagaaacagctcctaaagaattctcatttttgagatcttttatcacagaataatacattcagattttaaattatttaagtgtttaaccacttacaacacttcatcatttttattactctccaacttttcagctcttcttttcatgttcattattttcattttctgtatataattttatctgtccctctttggtcagtgctactttctgattacttatttaactctctatcttattgatagaggatcttgtggaagcaatttccaattatttccctgcctcctaaataatggcatttcattttatctcagtgagtaagttctgtaagagctgatccattgtccatgaaggtctaggatacagtagctgtcatttaataaatatgggatgaatatggataaataataaggaaacccttaaaatcattaagccatttcccctcaggtgttagaaacacgcactgaggatttcaagcttgatgaggt

SEQ ID NO: 226214 - DNA, 500 bp, Homo sapiens
atgagattgaaaagtaaaagaccacttttttgtaagccagctcagaaaggatgaaaagaataataacccttgtttaagaaagtacagggaactacatacttccatactgctgtacgaaatgtctgaaggacaatttgccaaaatatatcggaagacttagaaaggttatgtatgctcttgagcgtgggaatcccacttgtgggatttttaacctcaacaaaaattaagggaagatatgaggaaagagaaagggcatgagcaaaggacatttttgcagcatgtttatgatcttgagaaaatggaaacagctggggtgtgcggcagaagaagtggggaaaatgacaacggttcattaaacctcacgatcagatgctgacagcccctcacaggttgctgcagacaaaacagggaacgacaggaaaaagatgaccgtgatacgctctgctaaaagcaggtcgcaaaacaggatgtagataatgatcccattttgcttttttaca

SEQ ID NO: 226215 - DNA, 442 bp, Homo sapiens
aacttgagcttattacacccctatttgtgaccctttactgccttttttggcatcactgactcttcttcccaagaaagaatgaaaaaagggcatcaagcgtcataggtctctgaagtcaatgtgtaatccatgacacacaggtttacagattatttcccttctgtttattaagagtatcaaagataaatagcatatattgaaaacagaagaatcaataggttccttgggttggagaatgattattttgaaacttaactttgtgcatttttacttataaaggtttttggattttcttcttcttctaaaaaccaataatgactctattcatggtggcagggtaatctaaattctgaattttcctgaagtttgaagttaccctgaatacgtttctattttaattacattttttggttatattaataaaatttactttccaaattca

SEQ ID NO: 226216 - DNA, 502 bp, Homo sapiens
atagacattagtggaaaaactactgaaatatgaatagtctcaagtttaatagtagtgtaccattattactttcttagttttgacaaatgtaccatggttatgcaagatgctaacaatacagaaaaataaggggtatttgggacctccctgtattatccttatgcccttacttgaaagttgtttcagcaatagaagtttatttaaaatattgtgaagggcctgagtatttttaaatcaactgcagtgactctcttttgtgtatttgtgtacagatgagtttttctgcatcgaattttatctcctttccttgcagaagaaagagaattagccctttacagagataacagttgcctaagccagctcttttctcctctttttgatgttcttctttttctctcagtttgaaaattgtaggttatttgagtttttaaaatgtctattgctacatacacattctagttatattctagtccaaacaatctagtaaaatatctaaaagaaa

SEQ ID NO: 226217 - DNA, 267 bp, Homo sapiens
ggacctgcatggttcaaacccatgttgttctagtgccaagtatacttccataatgcccaaagtcattaattaataagagatgtgttttataagttagaaagaccctggctttgggagtcatataatcctaggatcaagtgctgatgtttacagtctgtgtaaatttaagcaaatgaatttacttaactttagttttaagataaatctcacaaatgggctagtaataatgacctacaagaattttgtgacaattagcagtaagatgtg

SEQ ID NO: 226218 - DNA, 370 bp, Homo sapiens
gaaatgctaaaacatttttcacagcaagtattgctgctaaaacctatcatccttggtcactaaccgtaatatcctttcctttacctgtctatcctttcctgtgttctcatctttgtaactgctcaatgcttcttccttttcccaacgttttatcccacaaacctttccaccgtgcaatttggataacaaactctcccacatccccagcctttttacataacctatcttcttgccttagctgaagcatggttcttgcctgaggacatttaacaagtgaaaactcttaagtaagaggtatttccgtaaccattttgagattgcctcacaaatgatgttaagacaggagcaataaagatagactattcattct

SEQ ID NO: 226219 - DNA, 207 bp, Homo sapiens
agcaaagactcagaagttagttaacttaccccaattaatagtagtactggcagagatgtgtctgcagtagttagaaaaggtagtttattgagctagtaagatttattcaaagcctttaaaaacagagacagtaattaagaaacgtttatttttgatagtttttttaatataataatattgtgactcctggcgtattatacacaagaa

SEQ ID NO: 226220 - DNA, 444 bp, Homo sapiens
aaaaaaaaaaaaaatcattttaacatacaggcccctcctttccatgatgaatgcattgggggtaggcgagtagggaagatgatacagatacatttgaacaacagacaccatgctgtagtaaggattgctcctaccctgccactctgacatacatagccttatttgcctgtttccttaagttgaaatcatctcatatatacatatgtatgtgtgtgtgtgtgtgtgtgtgtgtgtgtgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacatttttttttagcaataaaattgagtgtcaactattta

SEQ ID NO: 226221 - DNA, 424 bp, Homo sapiens
ggtcctgccccatacctgagaggaaggattgttgtacaaagaggccaagaatcatctaaacagttgcagtctgttcccattaggtcataccctttttgttcaatcacatttccacacagctgtctattctttattgaacccaagcataaaaaatggatagctttattagtcgggcatggtggtatacaccagtagtcccagctactcaggagctgacacaagaagatcacttgagaccaggagtttgaggctatagtgagctatgattgtgcctctacactgtagcctgggcaacagagtgagaccgtctccaaaataaataaataaacaaataaatatagttttccctgtatctttgggtctgcattctgaagtctcccatgtcatataaaagtatgattaaataaatatgttatgctgttca

SEQ ID NO: 226222 - DNA, 575 bp, Homo sapiens
ctataatcttgcaggttatccaactggtagtgctgcctgcacttttcctgttagtgcagcatgtctattttgcaggatggatcagaacatgtgggcaccacctaaggttcttccatgttaatcctggaaccagtagatgttttggacttaattttggcctcatggcagcacagattcccatgatcctaagcactgatagagaaacctccaaaattaaaatagcatttcttcatccttcaaagatgcctgaaagactctggatggcagaggtcacggggttacctccaacttctcaatcagttgtggaatcagtagtcataactcttgacctttgttctttatcaacaagtgtgggtcctaagttgatgaaagtataaactagttcccctattggcacccacttctgcagctgtctacaatatacaatttaggaagagaccctaagctgtgggcatcaatttggaactaatctgaaatctaatgtataaatgagaaataatccatagccaaaacttcaaaagctctagtaacattacaggggaagatgaaccagtatagaaagttacagttgagcc

SEQ ID NO: 226223 - DNA, 427 bp, Homo sapiens
gctagatttttttaaccatgtacacgtattgccttaaaattaaacaatcaccgtggcttctcagtggaacctggactgcgagagatgagaggagatttgggctgggacctgtggcagaggctgcaggctgcccacccaatgtcatttcctctctccctatttcctgactgacagatcctagactgtttgtttttccaagtgaccatttacactgcatgtctcagctaaatgactacatttcccaactacaggaggccattcagaggttgtagagtgggacttatgaggaaacggtttaagagagacatacacagttgcttggaggattgcttgaacctaggagttctgggctgtagtaagctagatcatgcttgtgaatagccgctgcactccagcctgggcaacagaaggagactatgtctctaaa

SEQ ID NO: 226224 - DNA, 526 bp, Homo sapiens
gcttggaaattatagggaagccctggggtggttgaaccaacaaagggatcaccgcagtggtttccaatctggggattcttgaggggtggtaacggggccacagggtctccaggggggtccctgaaaacctaggtggacagcatcatcttcacttcttccccagcagcatccagccagacactcgcacagcagtcactaaatgcatattgaataaataaataaatagacagatctgtgggtaaatcaatccaggaatacatggatgaatgtgctaacccatcagaaaaccccataaacgaatttaaagggtggaactcaatgtgctgaggctgcctttcttacgtctcaatggctccccaattttcctcgaaataaaacccactagtttctataattgtacaacataagtcacatgagatgttaacatcaagggaagcccggggaagagtctacgggaactctgtgtaattttcatttcaaacaaaaagctaaactacgttaaaataaatctatacactttgacact

SEQ ID NO: 226225 - DNA, 391 bp, Homo sapiens
ctcggtttccttggctttatatgatacaaaacttttccccagcttttgttgttgtttgtatgtttgattctatgtaaactaagttctccttatggccattctgatatcttgctggtgttttgtagggttgctatgactacagaacttgtggggggttttgggatttaaacaatgagaacacatggacacagagaggggagcatcacacaccagggcctgttgggggtcggggggcaaggggaaggagaccattaggacaaatatctaatgcatgtggagcttaaaacctagatgacgggttgataggtgcagcaaaccgtcacggaacatgtatacctatgtaacaaacctgcacgttctgcacatgtgtcccagaacttaaagtaaaaaa

SEQ ID NO: 226226 - DNA, 585 bp, Homo sapiens
  misc_feature (571)..(571): n is a, c, g, or t
ggagaggttatactagatgtcttccatttgcctttcagaacccctcttcatcccactctggaccccagcggtgctgacccacatggactgcagcatgaatggctcccttgccctctgacttcagcttctgtttatccaattattaatatccaaagaagatgagaagatataaggaagagatggtcagagtactctggctttctcattgccaggtcacatgggttgtctgtgtccctttagcaaagaccacagctcttaccaagcagccccctctagcttctggctccttctctttgctccttcacatctaggaatagaaagaaaggagaactcgagagctgggtgcggtggctcacgcttgtaatcccagcactttgggaggccgagacgggtagatcacctgaggtcaagaattcaagaccagcctggccaacatggtgaaaccccgtctctactaaaaatacaaaaattagctgggcatggtggcgcatgcctgtaatcccagctactcgggaggctgaggcaggagaattgccagaacccaggaggcagaggttgcagtgagccaagnacctgccactgcac

SEQ ID NO: 226227 - DNA, 339 bp, Homo sapiens
tttctattgattccaggtctttagctaataactctttcaaccaattgtgaatcagaaaatcttttgccaggcacggtggcccatgcctgtaatcccagcactttgggaagccaaggtgggcggatcacctgagattaggagttcaaaaccagcctgaccaacatggtgaaacccctgtctctactaaaaacacaaaattagctgggcatggtggtgcatgcctgtagttccagctactcgggaagctaaggcaggagaatcacttgaacccaggaggcggaggttgcagtgaactgagatcacgccactgcactccagcctgagtaacaaaagcatctc

SEQ ID NO: 226228 - DNA, 385 bp, Homo sapiens
tagctcttgttgcccaggctggagtgcagtggtacgatctcggctcactgcaacttctccctcctggtttcaagcaactctcctgcctcagccttctgagtagctgggattacaggcatgtgccatcatgcccggctaactttgtatttttagtagagacagggtttctccatgttggtcaggctgatctcgaactcccgacctcaggtgatccgcctgcctcggcctcccaacgtgctagggttacaggcgtgagccaccgcgcccggcctgaaatcttcactttttaatttaaaaaactaaatttatcccagagtttagaaaaactagtttttcaccaacccgaaagacccctctgctgagtctcttgaggagttcttcattg

SEQ ID NO: 226229 - DNA, 408 bp, Homo sapiens
ggttgtctgtatttatcaagcaaatacattttatcaagcaaatagaaaagccatagcatttatcaagcaaatccagtcacttttaagacagaaaggaggagttaatcagacaaaacagcaggacagagggcgtaatctgggagattgtgtatatctaggggaggaggacgggggattccagtaaggtttttggtttgagctatacataaatatcctaatgttttcaatataaaacccaatgccttttacatatttataaacccatgaagccaattacctagaacattacacagaatacttccggtgtatgagaatactgctttaaagccgatcgtagtttgaaaaatgagcattaatataattaattaaaaccaaatctcctaaatggaacaagacttaaaaacccag

SEQ ID NO: 226230 - DNA, 333 bp, Homo sapiens
tgaggcagagtctcgctctgtaggccaggctggagtgcagtggcatgatctcggctcactgcaacctccgcctcccagactcaagcaattctgctgcctcagcctcctaagtagctgggattacaggcgtgtgccaccatgcccggctaatttttgtgttttttttttagtagagacagagtttcaccatgttggccaggctggtctcgaactcctgacctcaggtagtccgcccgcctcggcctccgaaagtgctgggattacagatgtgagccaccgtgcccagccgtatctccagttttctagatgactgaataaatcaattttaggttg

SEQ ID NO: 226231 - DNA, 341 bp, Homo sapiens
aggtcccttattagggatatttaaccttagcctagaagacttggtctgcaggtataatttcagacactgtaacatttgatggtaaagggtgaccaaatacttttggtcagcagggagtcacaaagcacaccatgtgaaggcaacggtttacccagctctgtttaacagcaccctggcatagaagctttcactctcttacactaaatttaacctaatctaaacttaatccttagcattatttttaatttctcatctacatctttttcaattttccttaaaattgtagtaaacacagtcctcaattttatttgcatttacaataaacagtatttataagtcat

SEQ ID NO: 226232 - DNA, 377 bp, Homo sapiens
agtgtgtgctgattggtccctgggcaggaggaagtgcgtgctgagtggtccatgggtggacctggaaaaaacaccatttcattggctgaaaggcgtaaaggaaattctccctccaggttgtggattccagctagaaggagcagccaggttttcaggcttcatgctgtgtgtgccctgaaggttgggtttcactggggacctgtcccaatctgcctaggaatttgtctgcctcctgccactatcacaattttatttctgaaatacacaaatatttaaagctgttaggaaggtgtcagtagagagacttggaaaatacaggcaagatgaaagtaaattattctggtaataaagtgacccattcttattagggaaaatga

SEQ ID NO: 226233 - DNA, 598 bp, Homo sapiens
tgaactatcccgtgaatcatggaacataactacattattaggtattgctttagtattggctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagtta

SEQ ID NO: 226234 - DNA, 604 bp, Homo sapiens
tgaatacacagaaaatgtcttttatatttaccctttctcttactccttgtttcttcttccatatgtgagtttctatctggtatcatgccccttctgcctgagtacttttagcatttcttacagtgcacgtctgctgtagactaattctctcagctttggtctgcctgaaaatgtttttattttgtcttcatttttaggggtgtctttgctggatgtagagttctaggttgacattgtttctttcaaggctttaaatgtgtttttttcccattgccttttgacctccattgtttctgtgagaactcagcaatcattcatatctttgttctatatagtctgcttttttcttcactggttttaagatgttgcctttgggttttagtagtttgactatgatgggctttgatgtgctttttttgagtctgtgggttaatatctttcattagttttggaaagttcttagccattatttcttatatttcttcccatttctgctctcctctccgtctggaaagctaataacatgctctttgatactatttgatactattccttagatcttaatgacctgaatttttttaattcttttcacgatttttcctct

SEQ ID NO: 226235 - DNA, 505 bp, Homo sapiens
agccctatgtctttatggctactgggtaaaatagtcaagtgagaaattagctcatccatcctttgggcatagagtttgctgccacaaatttaggtcccctgctttctaactcttcagaaataggagagacatgagatcacttttgtccactgattctgtcctacacacgtttataagagaaatgggtgagggacaaattgctaagaggcaatgccaaggtttgagtagattccaagtgtgatttcggcaggtctgtggagttgctttctctatgggagaaagttgacgctgaatatttattttcaaacaaccgtatgtgtttatattgaagcatctgttagactgttaaatcaaaaatccatgccttttcctattcccaggtcatatacggaattttttcaagttgtaattttttggttacaatatatatactaagaccatatggttttctcataccattctttgtattttctaaatgcatattaataaaatgttggaggcaaca

SEQ ID NO: 226236 - DNA, 408 bp, Homo sapiens
aaaacatgttgaattacaccatgtatattcagtgaacaaaatgctaactgtgggactctaggttaaatacctggattcttcagcagacacgtttaaggaaaagaaagcgtggaaggaatcctgtagacaagagacccaagatacatcaaatcaattgaaaaacgtagttgaggccgaggcaggcagatcacgaggtcaggagttcgagaccagcctggtcaacatggtgaaaccccatctctacttcagataaaaaattagccaggcttggtggcaggtgcctgtaatcccagctctcgggaggttgaggcaggagaattgcttgaacccgggaggcagaggttgcaatgagccgagatcgcgctatggcactccagtctgggggacaagagcgagacttcatctgga

SEQ ID NO: 226237 - DNA, 655 bp, Homo sapiens
ataaaaatcaattaatcaaacaaacacaacgtaaaaaaactaaaacctctcaataattggcctagaaagtgatagaacatggaacgtgaccacattgagcaaactgatttactgtgatccactaaatgtatttatcataaggtaggtgaggtacaaaaagttataattttctaggacaactgggtggagtccctaggctaagccacaggttgtcctttcttgctgctgcaagctgtacacttgacttgtggctgtagcaacacagagaatctggagccaaaagcactgttacagtgctttcagtctttaggaaactctttttaaaaagttaagcattgttgagaaaatctcagggaacaccgtgtgactcttcagtataccacatggtgatgtaaactgcattgctctaaagagggtcaaggaaaattacaactattccaagacttaaatcttgtgaaatgtagttagaaaccaaaaattatagtactgaatatgtatgtctaggaagagattttacatgaagtactaaatgtattttaacaaatgccacccaacatatttgattgtgtaattttctgaaagaattacctagtacagtcatgttttatatatgtctttgttgatccatggacaggacaagccacagataattaag

SEQ ID NO: 226238 - DNA, 467 bp, Homo sapiens
tgtctttgtatgttctctgaatatttctgcaaactctccggcccccaaacacacattagggtgaaagccctaaaaatcactttttctcaatgtgacacattctataccaccacaaattacagccaactatcaaagccaccctgctggagaatgggctgtcttggatggcagtgagctccccaggcaatggagatgtataagaaagagccatttgaccttttggttataggaccctctagcaggggccacagggaaagttctgtagaactaataaccactgcccccagctctgccactaacttgccacagtcttggcttctcttgtttccttcctgtaaaaagagattaatgacttctctcctatttgacatagttgttctgagatttcaatgagatgtgtcattgaaagtgaaagttgtaaataattacctaaaaacaaaaataaaaattcctagatgatctctaag

SEQ ID NO: 226239 - DNA, 388 bp, Homo sapiens
gcatcctacccgttccatagacctgtgcttcccatcccgcccgtgggactctatgccacgccagtgggatatggcatgtaccacctgtcctaaggaagaccagatcaatagactccatgatggatgtttgtttcaaagggtttcctctccctctccaagaaggcaggaccagccaatactcctgttctgcaaaccctgagtgcaccaccctaagcggctaggccggcagggccacacgacacagctgaagtttgttctttaggcggaggcaccaagccttgttttcttggtgtaatcttccaggtgcccccttctcctttcacaaagattggctctgatggtttttatgtataaatatatatataataaaatataatacatttgtata

SEQ ID NO: 226240 - DNA, 375 bp, Homo sapiens
ggggggaatcatgtagccagaagacagtgttatttgcccctctttatagctgaaaagtgtcaaaccagtgtctgaaaagatttcaatcaaggaagggagtttctttttgtgattgttcttgttgataggagtactacatattcttccaagacaattgaaaaaagaaaagcaaaaaggaaataaacactatccattaacctcccatctggagacatctgctataaatatttgtatttgtattcttccagacatttaagaaatgttttcctctctccaaaaacacggtatctactgtgcacagttttgcaatgtgtttctttaatgtaaaaatgtatccaaatcatcttttcatctcattaaatattattctacaat

SEQ ID NO: 226241 - DNA, 395 bp, Homo sapiens
catagaaaaggtacagtaaaaatatggtattataagcttatgggaccactgttgtatatgcagtccatcattgaccaaaacatccttatacagcacatgactaaaaatatcagatgcctggttaaacttgaatcttgggtgaagaatgaataatttttagtcccaaatattatgagacatacttacactaaaacaattatttatttttaatttgaaattcaaatttaacttggcatcctgtactttatctggcaacaatatttgtagggaaattggcatttcacaattgggctgtggccccatcttaattcctgagcctgaagacatgtttctctactgggaaagtttcatttaacagtctctgaaaggaaaactcttgagcaattagagaagaa

SEQ ID NO: 226242 - DNA, 421 bp, Homo sapiens
acccaatgataatatctttcataaaggaaaagtaatttttcaaaacaaaagctgacagaatgtaatgccagcagatctgcattatatgaaatgttaaagaatgttctacaggcagaaggaaaaccaaactgtggatctacacaaagaaatgaagagtgctgcaaatgacaaatatgtagctaaaatactccccccccccctgtttaatcccttaaaaactagttaaaacaatatttatacatatacaaaaataaaatgtatgacaacagtagtataaggaacaggaagaggaaaatagaggcatacagttgtaaggtttttatattctacatgaagtgatatattaagatagactgtgatataataaaatacatgtattgcaaatcttatagcaccccctgaaaaacaagagttacagcca

SEQ ID NO: 226243 - DNA, 196 bp, Homo sapiens
gtgtgtgtgtgtgtgtgtgtgtgttttcaatatctggagtgcccatgtgggatgcacatctacctgtacacgcagacttccctgctacattacttcatttccttttgctttcttcctctccacctgctgctgagcacgctcatagccctgaaggtgtgtatgaggtgctcccaattctgggaaaccacctcagccg

SEQ ID NO: 226244 - DNA, 495 bp, Homo sapiens
atgtacagcgtgaagagtaaacgtgaatgtgcactgtaagctttgagtgataatgaagggtcgagatttaacatcctacttcacaagatgctcatagccttgatccattacagccgctacctcatccatctctgctcatatccttgatccaatacagcagccacctcgtccatctctgctcataacctaaactaatagaagccagagggaagaaatggaagccaacactccagaaagctgtcactcacctaagagtttgcaatttctgtctgggggaaaagaagagaaagttgactgtgaaaataagcattaccatagagccttctctatggcaacatcaaaaatgaaagctgattctcatcttcctaacaatctgcaaagacaagtgaaacacaacctactgagcatcaagttaaagaaggagtgaatttgagtagcacgggaggaaaccatgtcttcgccactagggaaataaatatgaccactgttcctctg

SEQ ID NO: 226245 - DNA, 503 bp, Homo sapiens
agaaggtcccttttatgcttttgaaaaattgtgtggggtgctagtggcctctaaagtggtaaggaaaattttccatcatccagacaaaggaggttaagaagaacagcggcagatgtgcaagaataactacaataattagctaggggaacatatatactgctaacattttaaactttacccaaacaggccatgcacggtggctcacgtctataatcccaccattttgggaggtcgaggtgggaggattgcttgagctcaggagtctgagagcacctgggtgacatagtgagatcctatctctacaaaaatgaataaataaataaaaattagcctagtatggtggtcctagctacttgtgtggctggggtgggaggatcacctgagtcccagagttcaaagtagcagtgatccatgatcacaccatttcactccagcctggactataaagtgagatctaagaaagaaggaaggaagggaaggatggaaggaaggaaggaaggaga

SEQ ID NO: 226246 - DNA, 481 bp, Homo sapiens
gagcagtgcggcctctctgggcacacgctgttctagagtatgctgagttcttcccgctccacttggaaccactgtgttcacacagtgagggaagcgacttttccctttctgggggacagtgctgctatgtaagatgctgtgaaggaggcgtgtgcgtacgtgcatgtgtgtgtgtgtacgtgtccacagcgggtgctggaggatggagtgtgttttcttccctgccttcacgtgtaattcggttgacaagaactattccatgatgtgcgtgcgggcttcagtgtgaaagatgagtatgtacgtacagtcttgctgtgcatcacggcctctcccacagtacacagcaccatcttttctggcaaccaagtttgatgtcatcaaaaagcttctatctccttccatctctgcaccttcttggtcatccccctcctccacctctttcaagttctttctcctttgtctttgaatattgtctcacttg

SEQ ID NO: 226247 - DNA, 429 bp, Homo sapiens
tcgagccggtacctagactatacggtgtccttgatcagttgaatttcagtgactcaaaagagagatcatccttagtgcgcctgaactaatcaggagcgtctttaaaacaaaggggcccttcctgaaggtagcgatttgaagcatgagagagattttcctgctggctttgaaggaggacctgagggcagcctctaagagctgaaagtgagccctggtcaataatcagcaggaaaacagggacctcagtcctacaacttcaaaatctgaattctgccaacaacgtgaatgaccctgaaagatgacgtcttcaaagcagaggtgccagctgagcagctggcagagccactggcctcatcttcgactctgggcccccttctagctgcaccaccctatcctccagagactttaaagttatgggtgccttcctga

SEQ ID NO: 226248 - DNA, 442 bp, Homo sapiens
acaacggcacttgtgtattagtttgccattgtttacacaaaaccatgtttctttcattgtatgaaagacatagggatttttataggtaattttccccacccatgcttgttagcagcttacagaagaatgtaaactcctttacgacccacctgcaccaaataaagggtcacgtggcttagagtcctgaggcctgagctccagcacgaccactgcatttgagctgcataactaagaaatccttctcttttctatgtgttgagtttccttatctgccttatctgtaaaattataaatgtcacctacatcacaagttgggttctgagatttgaatgaggtaaagatttttggaaactgtgaacccctgtgaatgtataataacaacccacctaagtctgtcttgcaaaataataaataattccaacatctctgtaaagtcagcctg

SEQ ID NO: 226249 - DNA, 491 bp, Homo sapiens
ttgctaatttttttaatttatgtttttgtagaaatggagtctcactatgttgttcaggctcatctgggacttctgggctcaagtgatcctcctgcttcgacctcccaaagtcctaggatgataagccaccttgctcaccccctccctactttttattttgaaaattttcaaacctacagaaaagcttatataagaatagtacagtaaggccggctgcagtggctcacacctgtaatcccagcagtttggaaggccaaggtgggcggatcacctgaggtcaggagtttgagaccagcctggccaacatggtgaaaccccgcctctactaaaaatacaaaagaaagttagccaggcatggtggtgagtgcctgtaatcccagctacttgggaggctgaagcaggaaaatcacttgaacctgggaggcagaggttgcagtgagccaagatcacgccactgcactccagcctgggcaacagagcgagacttggtc

SEQ ID NO: 226250 - DNA, 420 bp, Homo sapiens
gcaaagggagaagtatgctgcctaccacctgcaagcacagagaggaccatcctgtacagagtcaactcagagaagacagcaaagcccaaactcatctacaattcaagcaggggccccaccctggaccttgcatcctggtctttcacagcaaataaataataacctcagctgggcgtggtggctcatgcctgtaatcccagcactttgggaggcttgctcgaacccaggagttcaagaccagcctgggcaacatagtgagaccccatctatacaacagataaaaaattagccagtcatggtagcgtgtgcctgtactcccagctacgcagtaggctaaggcaggactatcacttgaacccaggtatttgaggctgcagtgaggtatggtttcaccactgcactccagaccatgtttctaaa

SEQ ID NO: 226251 - DNA, 151 bp, Homo sapiens
ccaggttccctccactccccggtccctcttaccctgcccctcattggtcgggggcaggggctgggttttcttgctgcgggcactggagggggagggtcctgccctcccttctgaccttcgggtgcttttgttaacgtgttctggcttcttc

SEQ ID NO: 226252 - DNA, 238 bp, Homo sapiens
tatcatctttgttctctttcaataaaagagcagagttcgtgatattttaaaaaaaaaaaaaaaccccaggattacaggcgtgagccaccgcacccggcctgtattacatgtttatggtaaaaagatctataggagttgagctcaaactggtaaacatagatcttgtgtcttggattattggcaatgtgctattatctttgttctctttaaataaaagagcagagttcgtgatatttta

SEQ ID NO: 226253 - DNA, 278 bp, Homo sapiens
gggataggcagatccctatgtacggagccagttttgaattacacatgaattcaattaacacatgaattaatgcatgaattgaattaacgcaataacacggagctccttggattacaggcgtgagccaccgcacccggcctgtattacatgtttatggtaaaaagatctataggagttgagctcaaactggtaaacatagatcttgtgtcttggattattggcaatgtgctattatctttgttctctttaaataaaagagcagagttcgtgatatttta

SEQ ID NO: 226254 - DNA, 601 bp, Homo sapiens
gtgaggatgctgttgcatgaatgtgattctccctttttgaacacataaggagtgctgtagcactgaggtttgatgacgtagttatttgtgttcagacattatgaaaacacaatgctaacctggtaagtttggaagttatcatgtgaaagccttttctgaagatgagatttttccaggtctctgagacctaacacaaacccatttttcagcctttgacagttttacagttactcaaaataattgagactgttgtgaagtaagtatattgaaagcctaaatagttgatctcttctggccagtctgcaaaaatatgctggcctgtttctggaaagtatgcccaactcagaggatgggaatggggaagagcagaagcgtgcagagggaaataacagtcaggctgttcttgatgtcaactggaggaagggcagtgctgtatatggcaagaaaatagatgtttttaaaagacatgacatgaaaaatctccctcctgttagtccccagttccttctcccaaattaatctctgtgaaacttttttgggccaagcatggtggctcatgcttatagtcccagcactttgagagacagaggaagattgttcg

SEQ ID NO: 226255 - DNA, 683 bp, Homo sapiens
tcgaggctgcagtgagctgagatcccaccactgcactctcagtgacacagtgagaccctgtcaaaataataataataataataataataattgcgaaagggactctgaagtaaacaaaacagagaaatatgatagagaatgactgaaagttggggaagtagatcagggaaaagatattacaagcggagggaaagcaagtgcaaaggccactggcagaagtgaacaaggcttgggtccctaacagcttaacagtggctcacacctgtaatctcagcattttaagaggccaagacaggagaatgcttgagcccaggagttcaaggctagcctagcaagaccctgtctctgcagaaaatttaaaaattagcgggttgtagtggtgtgtgtctgtggtcccagctacttaggaggctggggcaggaggatcacttgggcccatgagttggaggctgcagtgagccatgcattgcaccacggcactccagtctgggtgacagaacaaaacctgtctctaaaaaataaaataaagtaagctggacacgtctgaggatggaacaaggtgagtgaaggagcgtgtcaggacctgaggtagccagggacctcaaaggccagccttgcttcacccacacagtggcttacagtggtaaggcctctgtggcaagaacagagatgtaggaaaccat

SEQ ID NO: 226256 - DNA, 494 bp, Homo sapiens
actcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggc

SEQ ID NO: 226257 - DNA, 318 bp, Homo sapiens
ctaattttccgatacaggtgctagctttttaagataccaatgctcactcaaacttgttgtaacatagtcttcaaagctaatcactgcataaggaagacggtgggagcatcctcacatgtatgtcaggaatagatgttactgttttatcataaagctaaaacaagtataagctcagctttcctcagaatgctgtattttaaatatttaattttcatgtttaatcacaagcaaagtcacaaagtttttaccatgtatgattatttgtccttatacatctctgaggaaaaaaaatgtatagattacatctatacttaatgc

SEQ ID NO: 226258 - DNA, 481 bp, Homo sapiens
tgcttaatcatcagattgttttcctaatttacccaatctgcaggctttgcaataatggcatttggttatttattcatttaagagacatcaacttagtcactaatatgcaccagattgttccatttcccaagagagtcatgctgtggctaaaatttgcaaactgttcaacaggaggactaaagtagggcacccaatctggactggagtggaaatcaaggaaggctttacaggaagatgacaactgtatgaagtctctaaaggcctgtaggagtcagccagttgaagaaggggattgagtgcaaagtcatagtgcaaagccacagtgtccacagtgcagcaggctttatgttcttggatttcaacacagcctagtataggtgatgcaaataaaggagttaaaacttcatcacaggggtcaggccagggatggcttacatttggcaaattaggaaaacaaattaatcctgatagcaacagggag

SEQ ID NO: 226259 - DNA, 559 bp, Homo sapiens
gcttggtcagctcatgtagtcagaaagtaccagacttacctataatgcatcatattaaccaacagtccctccagcttgtcaatacttgttcttcctttcctcaaacttccacatccgtggaggtcaggctgatgtcagttatggaaaggcatgaagactggctatggatgccctgtgaactagacaggagagaggcggggcagacatacagcacaataaagagcaggggcaagaagactggcagccaaatcatttgcactgtcttaacaagcactaattaaatgccctgtttgaggtaaataatagctgaaaatagcctactgcagttgtttctcatcaatgagtagagaaataggtggaatcacttagtgctgtttcattcattaagctgcagcacactaagccttcttcagaggagaggggcaccaagtcgagctagcctctaaagtaccatttgctaaatgcccattctagcaccctagatggtattgtgctgacaagaatcacatccagagagtaactgcatgtactacaaactgaccctaataaacaatttaaa

SEQ ID NO: 226260 - DNA, 798 bp, Homo sapiens
ggacagttaactactatgattttggtgatccaaatttctataaaacaaaattgtccatgatagttaaatatcttaaatctttaactatatccttcttggccaggcgcggtggctcacgcctgtaatcccagcactttgggaggctgaggcaggaggatcatgaggtcaggagatcgagaccatcctggctaacacggtgaaaccccgtctctactaaaaatacaaaaaattacccgggcatggttgcaggtggctgtagtcccagctacttgggaggctgaggcgggagaatggcatgaacctgggaagcggagcttgcagtgagctgagattgtgccactgcactccagcctgggcaaccgagcgagactttgtcttaaaaaataatcattctgcggtcctcttagctgtctcaaattatgacgggcattttcctggtctgtttgtggctagccgtcagagttttcactggaaaagctatagctaattgctatacacagttcttaatgtggaccttctccagggagttgagaacccagggtgttttgaagagttggagctgcagactttttatacttttgcctgttctcagtgatgagtcaaagcaaagaaggagggtgaatgctggatgagggggcggcctcagagagcctgtggctgcattaggctttcctgagtgtaacctatactggaaattgtttatccacaagtgagtaggtagtgcatactgaagagctgactactgggagtgtagtacctataggacaatgaacagaatgtttagaaaattagatcaag

SEQ ID NO: 226261 - DNA, 453 bp, Homo sapiens
aaaatatatatatccttctcctacgtttccctgcatcattaatcattctgcggtcctcttagctgtctcaaattatgacgggcattttcctggtctgtttgtggctagccgtcagagttttcactggaaaagctatagctaattgctatacacagttcttaatgtggaccttctccagggagttgagaacccagggtgttttgaagagttggagctgcagactttttatacttttgcctgttctcagtgatgagtcaaagcaaagaaggagggtgaatgctggatgagggggcggcctcagagagcctgtggctgcattaggctttcctgagtgtaacctatactggaaattgtttatccacaagtgagtaggtagtgcatactgaagagctgactactgggagtgtagtacctataggacaatgaacagaatgtttagaaaattagatcaag

SEQ ID NO: 226262 - DNA, 435 bp, Homo sapiens
gactcctgaatgtttgctcaatgtcatttagctcccattgtttcctgtcaccatagcagtctactgaaatctctcagcatatatttcagaattactctgatagtgaaagatttcctatcctatgtagtccaacaattattggtttattatgtgaaaaataaagcaagtatgtagcatttacagagtaatccagctccactgttaatactgtcatttgaagagttagcaaggaatgtgatgaagactgaatatcttgaaacaaagtttggttgtgcagttgctctgctatgaattatgggtctgattcccctttttatatgtggcttttggattttcttctgcccttgaggtaatctgctcctcctttcattcaccgtgcttttaggtttggtttcagatacagcatcccttctgctacattctttaaagttaaaa

SEQ ID NO: 226263 - DNA, 664 bp, Homo sapiens
ccaccaggccacttccactgaccaccctgttcactccaacaaggacaaactacctgcatcacttccttggtggccaggctttctggccttaggacctgctgttctcttctggcagcattcccagagtccccaccccatacactcaggggtcaactcaccccctctcccctcaagactcaggtagaggtcaaacaaaataacatttcttgatgactcaggttttcactgtgaatttctccattgtattacaatcaggtaaaactctcctagttcaacaaggctttcaaaggtggttttcttcaaagggctttggccttaagatgacagtgacaactattagtcttaggtctgctttaagtgtttttctgtctcttctttgctttcaggtaactgggcagcagtctaaatcagtgattataataagagctctgggtacgttggctcacccctgcaatcccagcactttgggaggcactgaggtgtgggaggatcatcataagtttgagatcagccttgtcaacagagcaagatcctgtctctatgaaaataaaaataaaaaattgggcatagtgttgcacacctgtaattccagctacttgggaagctgaggtgggaggatcactggagcccaggaatttgagactgcagagagctatgatcgcac

SEQ ID NO: 226264 - DNA, 139 bp, Homo sapiens
cttacttgctgtgttaaaatattaagagtatttgctttgtaacagataaccacattaaaaggaactcaaagcaataaatactggtggaatttcatgtattttggcccttgaattcgcatcatgggatcttttaggactg

SEQ ID NO: 226265 - DNA, 351 bp, Homo sapiens
gtcacaaaatggctgccacagcataaacatcaccgtacctcacagatatgacaatgttcagtggaagaagaaaaggaagtttcttcatctgtgtctcttttaacgagcaagaaaatattagagattcctcatcagtctctgtttcattgttcattcaacatttctttggccagtccctttcctaaaccagtccctggcaagggacataggatttctaccatgaatttagtatgggttctgttctacagagtaagggtgctttctgctacatgtcctttgacatgtggcctaggttattattatctcaagaggcaaaactgctttatagtaccaatctgcagtctaataagt

SEQ ID NO: 226266 - DNA, 390 bp, Homo sapiens
catcttgttcaggtcaccttcaggggaaaggaggattttggaaaacagaaggcagagaataagaacatctgggggggagggggtgggggcgggggcgcgggtgcagtggctcacgcctgtaatcccagcactttgggaggccggaggcgggtggatcacctgaggtcaggcgttcaagaccagcctggccaacatggtgaaacgccgtctctactaaaaatacaaaaaattagccgggcgtggtggcggctgcttgtaatcccagctactggggagctccagagtctgaggcaggagaatggcttgaacccaggaggcagaggttgtactaagccaagattgcactacattacactacagcctgggcaacaagagcaaaactccatctca

SEQ ID NO: 226267 - DNA, 427 bp, Homo sapiens
tccacaccattacctacattttgtcattataaagtaatttaagtccttgcctgggatttgttgagcgaaactttaactttgagaccatgtagaatctatagatatatctgtagaaactatataccaatatttgaatattaaagaaatattagttaacctactttattttacatagtttatatagaaattgtagatatagcattgtgtaccctgtttactcccttgagggagcaaattttgggagatagggcagtgaacatacataaccaggtgttacagtcagttatgcaaaccagattcagagagaggaaacaacagtatattcaaagataaaagtttcaggaaagtggtctgtcatgcgtttatccctcgatctaacccactcagtagaagctgggtttcctttgtcagaaattagactgagaag

SEQ ID NO: 226268 - DNA, 602 bp, Homo sapiens
ctccagagtcagagggcaggtgcctctggaaggtataatagctaacgtggattgagtgtttacgaccagcccaagccccctacatggcttaatggatcagagcagccccaggaggtaagggctctttttatcactcacattttacaggtgaggaaactggagagtaatttgatggagatctcacagatagatttcacaggcgattttgaccatgcttctacactggctctgtggccagccccttggcaccagcaccaccactgccatcgatttctggtccacggccagattgctaattctggctccactggctttgccacttgtgagctgcgtgaccttgggcaaatgacttaacctttctaagcatggtctgtgaaatggagagaaggaaacatctccagattttgcccagaggagtaaatggaggtgggatatgtgaagtggctctagacccaggcagtaaacagtgctcagtgtgtgtccttccctattgacactgacagaccctgcctggcaggcctgagcacaacagaagcactagaagtccttttccagaaattccttgctagggcctctcactgtggactgagaggatggaggca

SEQ ID NO: 226269 - DNA, 386 bp, Homo sapiens
aagccccacagaccacgtttcgtcagagcaaaccttgccagggcttctctgcctcttacatcagagtgggccattggggtcgtcggacaacagcctgggcgctggtaattgcctgtctctgttgagggacgggtacaggccacagggaaggtccgcgtttcctacactatctggagaatctaaattgctacaatattttaaatatgcctttagttgcaggaaggtgagggaaaggccactaaaacgtgggttccacaagggaaggagccttttttatttggttctgaggccctagaacagcgtctgacacatcatcattgtcaataaaatgtattaaatgaatgttagctgtgaaataacactaagataattaaataccctaattt

SEQ ID NO: 226270 - DNA, 458 bp, Homo sapiens
gaaaggagcttttccttgtcaatacgaaaatctttgagtacaaatcgataaagctagagattcaaagactgcctttataaaactggagaagatgcactctggccataggcggagggggcagcccggggcccctgtcaggaagccaagaggcccgggacatccctggaaggctgccgagggggcagcgccttctctggggacggcttcgtggagagtccgggacgggcgagacagaaaaccgagccctatttgttattagtattttttttttatactctcaaatgccaccggcacattcttttaaaaaaaattgaaaggaaagaaagaaagaaaaagaaaataagagaggaaaaggtcctgagaaatgacggacgcttgaacctcgggcccgggaagaccagcgccctttggcggctaggcctcgggggcgtgcggagggcgggcccccgcgcggccgc

SEQ ID NO: 226271 - DNA, 437 bp, Homo sapiens
aagagtggatagaatgttaaaagtcccaaaggcattgaaatactgctgctaagggaggagagtgtaactacattcccacaagaggttttggaagcctttgtggaaacttagatgctaaactagggagactataagacatcgtcctttcagggaggagagaagcattgaagttcagtgagttgatatgatgaaatataggttagattaatttttccaacatttcatttattgcatggtgcaatgtatggtatgtagttgatgttaaatattttttgtatagatgaattcatttttcattgagactgaatgatctgacaagggtccagaaagtaaactggaagtgaaagagactaggggcatagttctgtggtatttgggaagctttaggagagtttaaactggatatgattaaatatcttaatatataatgacagtgg

SEQ ID NO: 226272 - DNA, 583 bp, Homo sapiens
ttttgtttgaaatctactgttcatagaaagaagccttcagaggagaaagccttttctctcctgtctgcttcctctctattatttttatttttgcaaaatgtttattttcactgtcacctgggatttctttgcctcggttgaatgtattgaaagattatatcctttatttaaagatgtctcattttacccccttgcactttcacttgatcaggttgaacctaaaatgcattttgtattataattttaaacgaattgtaaacataacatgtgctcattttagaaaatttaggaggtggccaggtgcgatggctcacacctgtaatcccagcactttgggagtccaaggcaggtggatcacctgaggttgggagtttgagaccaacctgaccaacatggtgaatccccgtctctactaaaaatacaaaaaaaattagccgggcgtggtggtgcacgcctgtaatcccagctacttgggaggctgaggcagcagaatcacttgaaccagggaggcggaggttgcagtgagctgagattgtgccattgcattccatcctgggcaacaagagttaaacaccatctcaaa

SEQ ID NO: 226273 - DNA, 195 bp, Homo sapiens
gaaaagccttcacagaaaagggattttcagggctggcggtggggggtaggtaggaggaactggggaaggacagccagcaaaagggaacaagatgagcaaagacacacatgtttagaaacccaatgtgtgattgaaaagaccaagaaaccttgaggaggagtgacaggaggtgagaatgtaccagtgtaaggcaca

SEQ ID NO: 226274 - DNA, 281 bp, Homo sapiens
gccctgtgcccacaatcctacatagcaacaaactgtcgagccaggaattggggcgccctttgaaggagcttgggcctccttgtccaccacagccctgactcctgaggttgatttttctgctcactggactgctatttgttttctgtgccccctctatgccccccaccccacccctgccattagaatgcaagctccacgacgcaagggcttcatgtggttcactggagcccgcactgtgcctggcacataataggtgctcaataaatcgctgttgaatgagt

SEQ ID NO: 226275 - DNA, 274 bp, Homo sapiens
catgtcaccagccccatctttagccattttccttttcattgatttttttctcatttctcatgtgggacagtgtcacccttccaccccagggtctttgaatatgccatttccttggctgaaaaataatctttcacccttgtatgaatgcactgttctgtcttgtccttgagatctcagctcaaatgtcacttccccaggggagtcttttctgaagccccaaagcatcaggccccccttatagattcccagggtgctttccgatttgggataccct

SEQ ID NO: 226276 - DNA, 394 bp, Homo sapiens
gtattctttttgcttccatgtgtggtgcagacaagggctggcctcaggctagaagcgatgaaaatgagaaaatcactcccgccattcccttttaccactggtggtttacttgccagtttctgctaacttttgatcattccccagtgacttccggtagttgttcatttttgtattttctctagagtttatagctactatctgtgggaagttgatctaatggaagctaacttgtcccttaccaggagtgaaacccaagcatgtaaattttgtcaaaattagaaagccttatcctatactcatgtcaaggacaagtttccaaagtaattagacaattctaactagaaaaggtttaccctaatgctttctcaaatattcatttttccaaaaattctta

SEQ ID NO: 226277 - DNA, 407 bp, Homo sapiens
cctgccctttcccttgcaagtatcaggtttttaattgcgtgtgctaatatttattagtgcagtatcattgctgtgatgtagtaggggtaagatgttgagcacactgcacactgtgtatggtaaggccaataaatagtagttagcatggtcatttgtctctgtaaacagtaaaacaaatggtagtaatgtatttctactgtacgttagttagagtacatcatagcccctgccctccagtaggtgaggctgacaaatgtatgactacagagcagattataataggcattttaataaaaataccaagtgtctcgaaataaaggagcaagggaggctaatttaactttctcctcgtccccagtcatggtctatttcctattgaagatggaattgagtaagtgttttcaata

SEQ ID NO: 226278 - DNA, 492 bp, Homo sapiens
atgtattagagtataaaatgtttgccatgtatacacctgtatgtgcacatacacacattacacacacacacagaatgcacatttcacacacatatacttattattcaagttgaaactgcactctaatcaatctgagtctattgctgtttcaactcttaaaatcaatatctcctacattagtagatataaacataattcaaatatttaaatatttaagaggagaaaagtaactagaaaaccaatgaaaagtgaggccatcagaaatagaaaatgcctggcacgaacagtctatctaaattctcaatttcacttcaaattagagaatccataatggactagaatataaattacaaacacatacacacatcttcacttaaagttgttttaagttctttgaagttctgacatgtttttagccagggttatttgttcaggttcttccttgttaggattccagactggaaagttggaagtctcaggaaatgcatgttt

SEQ ID NO: 226279 - DNA, 427 bp, Homo sapiens
agattccagactcagaaagagttggaactgtggtgtggttttagagtgcaggaggagtgagaagggattgggaacagatctggacctgacaatgaaaatgcctctgggcacctccctgctctgtttccccaaagactcagtggccttgcttgcttcatatacacagatatttaactctatgtggcaactggacataaagcattctgaggaaaagcaaattaaaactcccagaaatcaaacagaaagtaaaatctttaagaaaaggaccaaaattaacaaaaaatacagaatttaaaactttggtcacaatgaagagatggcgatatgacagaactcttaggttaacaatgtaaaccttcactttcaatttctcatactttttgtctccagctgaacaaaataaaagctcaggaggaagcgcattggg

SEQ ID NO: 226280 - DNA, 527 bp, Homo sapiens
agtctccaaaacccagagattcagttcagtggctccaatctccttagccccaagggaaacaagagcacgtccagctggggtcagagctcacgggctggccctctgccctcctgtggtcaccacggccccgaagctggccgtgctcctcgctcgttcagccagaattctgcagacgcatcccaggcctacgctgctctgccaggacctctgacaccacccaccaggctggccctgtccccatcaggcccaggagtggctgcaggagccgagggcaggctgtcaaggagacgggctccgagaggcagcggctcaccattcagcaaggcgagggcaaaggaacctcagagcctagccaggggcgcctgccatcagtggagcctctgctctggggctgccggtcgggccgtgtgtgctgtgtctctttaaggaccaggcctcttcaaggcaagttccctctgcagtccagtcctgcctctgcccgtcctgcggcagagagtgggggctccccagcgccatctggcggccgc

SEQ ID NO: 226281 - DNA, 500 bp, Homo sapiens
cactttttcccaaatagatttaatcagttacatgggaatacaaaaaatgactgacgacacaccgatattagtgatcaggggaactgactctaacagtgtctcttacatgttacttgtgttttctgtatcttaaagataatgtaggcattgttcctaagtcatgcagaggggttgtgtaagcatggtcatttgcatcattatcctgcacgtctgatacagccaaactccacgccacctggtttgctgtaagtattggattcatttaagatccataacaatgctatttactgaccctcttgtcaactgatgctgtgacactgctgtaaaatgatccctatgtcaccagatgctgccctgaaacttaggaagttagcatgaaggtaatacttcattagaagtttgcaatttatgggtgaattaataatgcaagagaaaaggaatagaacagacatagagagaagacctttgaggtttacatcaaaccccatcaaaagagattt

SEQ ID NO: 226282 - DNA, 525 bp, Homo sapiens
gggagggtcgtgggcccttatgaaagaaggtgggaccagattgtcatcaagacttgcactgtcagtgctagtaatcctagcattttgagaggccaaaacaggagaatcacttacagccaggagtttgggaccagcctgggcaaaatagtgagacttatttctattaaaacaaaaaaaaaaagaaaagcaaaaagacttgcattgttcagtagagcaatagagtagcaaccagacacatgtgggtcatttgaatttatattcaaattaattaaaattatattaaagtaaaaatgtatgtcttcagttacgctcaccacatttcaagcactcaggagcccatgtggctagtgatcatcatcacagaggaatatttccatcctcacagaaagttctgctggaaagcattggttcaggccaaacaaagaaaccaaacaatccttcatctaaaatttatgagcatgttaagacctcatttaaaccattatatattactcagagtttcaaaaagtcaccaatgcacaaaaa

SEQ ID NO: 226283 - DNA, 343 bp, Homo sapiens
agaatttaggatatgtcagtttctgtgcttctatcccagattttaaaacataatttcctaggcaaatttttagttttgtaagtatttgcaaaatatataattagtctagacatgtgataaacttgttgaaaataaaggcctttctgtcataaaagtcagaagaaggtagtacatgacatccttgctttgttcttctgtttaattttaattattgatgatttttttcataaaaattatatttgtcaaaaacattataagtaatcaattcaaacaaaaagaactttgcgtttttaaactgtggctttgttcttaacctgtttttggaacataaaatagttttgaa

SEQ ID NO: 226284 - DNA, 248 bp, Homo sapiens
gaaagaaagaaattacatccaaataggaagagaagaagtcaaactatctgtctttggtgacaatatgattctatacatagaaaaccctaaagactccaccaaaggactcctggaactgataaatgacttcagtaaagtttcaggatacaaaatcaatgtacaaaaatctgtggcatttctttacatgaataatgttcaagctgagaaccaaatcaagaatgcgatcctatttacagtagccacagaaa

SEQ ID NO: 226285 - DNA, 868 bp, Homo sapiens
ttcaaaacaacactttattaatctccacttagattcagctctttccctccctctacctgttctttcacttaatagtcatattttgggagtctttgtgagggaaaatgcctcttctttaacataatttcaaagccatactagcccagggacagagcaagtgagaaggtggtatacaactgctctgaggctaaagagatggtacttttgaatcatagggctcttcgtagaattcagagtgtgaccttcatcctgaagcatctgcagctgtctctttaattcagattggctgtgaaatttccgaaggaacttacatggtgaatgcagtagtacaagggggtgatggcctttgacttctctcttccaaatccagataccagttacctcccttcactttcatcaccttaccagcgttagtgctttatgtaggttggagattgcagctgcaatcattcttcagctttctttgtacagtttgagtaggctgagttcattagaagagctctcccagatgggctttcatttcaaactcatcagctcttgcttttattcccatttttctaaagttctttttgatcatccggctccaactcccatttacgacctgattgttgatctgttcaagagaaagagacaggcctccagcaaaagggaggaaaaaaaaatgctttggtgagagaaagaagaaaaacacacacacagggtgttacacaaggatgaagtcctcctcacaccattgtcctttggaagacaaagctgaagaaaataattctggaaatagaaaaaaataggaggtgaggtgggggaaagtgtgtgatggaaaagcaaacatggaagtcataaaaaaattcttatgattataattctccaa

SEQ ID NO: 226286 - DNA, 484 bp, Homo sapiens
gggctttattcacacaggggaatggcaagagtgaaaccaaccatggtggtggggcattttgcggagtatttggagtgataaaataaactggaggaaaatatggaaaataaattaaacagaaaacaacaacaggaacaacaacaaaataaaacccagcaacttgaagaagagatacatacagtttacatttctggatttctctgctctcttctatgggctgtgtcctcaccgatgctggctaacatttactgaccaccaaataaggacccgttgacaacatgtcaattgcccaatggcaaggaaccaactctctgagatgatgcatataacttgggggagcagcactcgtgggttgaaagttacgttctgatctgggagggttatcatcaggaccttgtcttgactcacaagagaaaaagccatccttccttcctttcctgagctctttaaaattaaccagtgagttacctgtgggaactttcct

SEQ ID NO: 226287 - DNA, 308 bp, Homo sapiens
taccaccacacagatcaaaagttaagccctacaaacaagttacaaagaatgtcaaaatgtggaagagaaggaaaagattagtttcagctatgaaaatcaaaaagaatttatacagcaggagcagtaagacagaggacaggttttccccacaacgcacacgcacatacatacgcaccatagtatgttttattccttattacaattaggggagaaaagacaaaagtagaaaatgaaaagcatttggactggtgcgatcaagaactaatcctttttttaaaaaaagaaacaatcattaacagcttagctcc

SEQ ID NO: 226288 - DNA, 289 bp, Homo sapiens
cccataaagttagaagccccaatcactcctgggcaagactgactctcttgagtaagcctgcacttcccttccttgagcatgtatttttcactttgcaataaacctctgtactttttctgacttgtccttggattctttctggcagcagtggcaaaggcctggacactggctgggatcaacatcctaatggcatttgggtacctcccctagcccaccggtatcatttcttggagtactgtattttgtgaggctcctgtgcatatgcaggtaataaatttgtatgccttta

SEQ ID NO: 226289 - DNA, 180 bp, Homo sapiens
tttcacccctacaaagggataccatggaatttctcaaacagtgaatacattggctccaggaaaaagggtcgacctcttaaatagaaatagagaactagagaacaataatgaggggagtaccttgcagtcagtaataagaagctgtctttactatcaaatcagacctccagtgggagagtt

SEQ ID NO: 226290 - DNA, 676 bp, Homo sapiens
aagataataagaacaatgcatctgacaaagctgttagatcgtgaggtcaagaacaagtcttctctatttctatatatccaaggactatgcttggatatatagaacactcaattgttgatgaaaaacagaatcagtaagtctcaagtaatactttcttctgaaagtaatattttaagatacctgaaacagtttgtttttaacagaaaatagagctccacatttccaaaagaaaaaaaaatgtttttggtctgcagataaacttcctacctctcgatctttgagtttcatggcgagtaccaactgatgcctgtggttagtgagagcctcccggtaatttcctttggagaagaatgcagagcccagattcccatgagctcggcattctcctgtctggtcacctggattgaattgagaaaaaaaaaaagaaaaaatttctctaagttataatgttatttataacatataatggtcatcttaatttaagagccacagatttattagctaagatttcacttatcttctattagaaaagtatttgtttcttccacaagaccctatgtggggagttactgccctagaatttaaatctctggataacaactgcttttattgtcataacatacaactgcagacagggacttaggtgtcttagaaacaaaaggttaaagaccttaac

SEQ ID NO: 226291 - DNA, 469 bp, Homo sapiens
  misc_feature (29)..(29): n is a, c, g, or t
tgctgcaggtgattcctagaggacccctnaagaggtggtgtctcccagccagtgtccatctggttctccaaaaggccaagaggtcatggtcaggcattcacggagttctaactgactctctggaacagtgtggtgctgcctggggtcagggctattctgtgacccctttgttcctcatccacaacaaaataaatgctgaacccgaaaatcagcgtttggaaatttttatagcaattaagtattgctgcaatattcgagcatgtgatcagagtagtcgtctcatcaaatggggtatagaccatggaggcactatcaaactgttgtgggctgagcacggtggctcacgcctgtattcccagttacttgggaggctgaggcaggagaattgcttgaacctgggaggcggaggttgtaatgagccgaaattgcaccactgcactccagcctgggcgacaaagtgagactcctc

SEQ ID NO: 226292 - DNA, 499 bp, Homo sapiens
gcaatgacctaaaattagaaaaatttctttaatatatattaggaccactcctaaactgcaaaaagtgccttgttgtgtgtacaagtataaccacaaccaaaaaatcgaatgaattcaacaaaatgattgtgcctttacaatcagtttatgtcaaccagatgaccctttggttcacttttatttatgttttaattataaaatgtgtccactgttcatatttaaatacagaaatgtataaagataaaaagtgaaagtgttttctctctgctaatcttaatctgtttaatgtcgctgtattagtccatcttcacactgctataaagaactacttgcgactgggtaattataaagaaaaagggtttaattgactcacagttctgtatggctggggagtcctcaggaaaattacaatcatgggagaagtctaacgggaaacaaggcacgtcttacatggtggtaggatagagagagcatgcaggggaaactgccacttttaaac

SEQ ID NO: 226293 - DNA, 499 bp, Homo sapiens
ccatcccatcacacacacacacacacacacacacacacacactatagacactatatttaaaattggcaggggtgatattatgaactcctgtaaaaccaaattgatttgtgtttgtcaggaatgtgtgggtctgtgtcctggaatgctatatatttccactgtgcactgcccattgaccatttctactaggatgccttgaaggcacctcagactcaacaagttcaatttgaaattcattatgtactccccagttgttcacgctaggagccttcaggccacccgtgacttttctctctccttgagtctctccttagcttcccatggatcagtctctgtaccatgttgattctaccttctgagtatcctttctgctctccctcatctgcacttctgttaccactgcctgagttttggttatgggcttcttagtcttttagtcttttctctcccccaacccagccatcgccaccagcaagaactatctttctaaagcaccaat

SEQ ID NO: 226294 - DNA, 440 bp, Homo sapiens
gaggttgcagtgagccaaggtcacgccgctgcactctagcctgggtaacagagtgagaccccgtctcaaaaaaaaaaaaaaaagttaaatcacttgatatgcattctgaaatatttaaaggaaagtatatcaatgactgcaatgtactttgaaatgcacgatcaggctgggtgcagtggctcacacctgtaatcccagcactttgggaggccagggcgggagtttgagaccagtctggccaacatggtgaaaccccatctctattaaaaatacaaaaattacccgggtgtgatggtgatctgtagtgatctggtgcctgtgatcccagctacttgggaggctgaggcaggagaatctcttgaaccccggaggcagagatctcagcgagcagagatcgcaccattgcactccagtctggcgacagagtgagactctgtcaa

SEQ ID NO: 226295 - DNA, 386 bp, Homo sapiens
gtgaactggttcatcgcaagaggcactttcagctctggatagaggacagctctttgctgctgcaacctgatgtagtagcaggggcatttgacaaagtgggttaagatcccatttgggctagatgtcctatccaatgccaaaattctcaggtcttttctcaaacaggggatccatcactttcttggcctcctgcttctctgcaacaacaggggccagggccaccttcttccccttggccttctttccttttggcatcttgggtggctggaggagtgaaacttaacatttatgaagttgaataatctaaaggaatttcttcagggttaacataaagaagccaaataaaaatattaaatttctccacagggttaaaattttacttatgc

SEQ ID NO: 226296 - DNA, 467 bp, Homo sapiens
tagactgaatttagggcccaacagttagacaattggaacttgataataacgttatctcagcagattgcgtaagtcagaaatgttctccctgtcactgctttctttttccttccagcaagaagtggacattaaggagaaagtgaaggtggcaagttatgagtgatctgtttaagacacagtttagttatggcaatgataacaactcacatttattaggggcttattatgtatcaggctgagcaaagtacgtaagattcttgatctcatttaattctcacagtgtagaggctaatgagtggtggaggtgagaggaggacgcagcctcccttggctccagggcacacactcttagctgtaacactctattgcctccataaagtatgcttaattgtaatacatgttgatgagatatgtgataaacataatttatgtaaaatttaagaacaagatctattgtataaattata

SEQ ID NO: 226297 - DNA, 521 bp, Homo sapiens
cattttattatctctttcctgttcctttctttgaatttattttgttattcatttgtaccttctttagatggatttgctgttagcctgttaatttggggactttctttgaagctacagcctatggttcttgttctgatagttggcttgagcaggaagaggcagtaatgatggggtgatgtgggccatatggctggttaggtgtcgattcttgacaagatcctggtttttgttgtgagtggtgggttaatgggtgctgaccaggtgaagagcagcatggagcagtggtagcagcgtcctgtgtgctggagtggactgctcagaatcctcagcacacttgaggtccacagaagaaagaaaaagaaacataaactaaatagtaagaaaaggtgcatattgcagagtaaaagacttcccatctccgtttctgctctcaatcttacttaaacatgtcacactattaataatttcttataattcattccaaaaagatgtttgtgcacataccagcatctttctgttct

SEQ ID NO: 226298 - DNA, 315 bp, Homo sapiens
ctgcccccatgtgacaggttggggaactgaggccctgactactgtgccacctggcccctgtggcccggcccctccccagtgcacttgccctcccacaggccttgagcgtgagcccatgggaggcgctggcactgagtgctgcgccgtggccttcgcgagcccggctggattctctttccctttaaagtgcctttaggctgggcgcagtggctcacgcctataatcccagcactttgggaggccgaggcaggcagatcacctgaggtcaggagttcaaaaccagcctggccaacatggcaaaaaccggtctttact

SEQ ID NO: 226299 - DNA, 324 bp, Homo sapiens
cctacagctatctgatctttgacaaagccaacaaaaataagcgatggggaatggacttcctattcaataaatggtgttgggatagctggctaaccatatgcagaagaatgaatctggacccctacctttcaccagatacaaaaattaactcaaattggattaaatatttaaatataagacctcaaactataagaatcttagaaaataccattctggacatcagccttcggaaagaattcatggctaagttctcaaaagcaatcacaatgaaaacaaaaattgagaagtggggcctaatgaaactcaagagcttctgcatgcaag

SEQ ID NO: 226300 - DNA, 401 bp, Homo sapiens
ccttgcaaagcttatgacttatgactgtatggaacatggtttacctctggtgaaacagaccgttttgatgaaaatagaggaggatgtaataaacttttgaagaaaatagaggacttgccctggcctacttgcctcttctgattgccttgcaatgcatttattctccactttctctgcaacgtttagttctttccttgcagagtgttggagacaaggtaaacgtgatcagctgcctggtcttgggtaaggtggtattttctctctgttaaatttgtacagattcttacgtttgactgaaacactgcccaatgcaaaaagaaagactggggcaaagagatgaaatattagatataattactttcataatcttatatgtaaataaatctagttgccaaacctca

SEQ ID NO: 226301 - DNA, 332 bp, Homo sapiens
tgttgaactcttgatcagcttgaaggatgaaatttatacatttgaacttcttagatttgggagcagtggagtctattgctgcatttttgtcaacctccagcttgggatgggccagctcttagtgaaaggtatctggcccatttctctcttaggtgggaaagttctaatcatctagaatgattcaaagcttgtgagagactatagctgatcctgttggttggcaagagagccattctctaccctcttctccattgtcccctaggtctcagggtctcagcatctaaactaggtaggcttgtcaaggaatttcctccggaataaaaacagtctca

SEQ ID NO: 226302 - DNA, 164 bp, Homo sapiens
aaaatactgtaaagtgggttgatggtcagtgccagaatgtaagctccatgagcatagagacttgtctattttgttcactgccatattcccagcatattaaatgaacatctgttgtacttagcattcattcattcaacagatgttcatttaatatgctgggcggc

SEQ ID NO: 226303 - DNA, 719 bp, Homo sapiens
ccagttgttttaggatttattcttcaagggagggtttgcacttaaagggacattatctcttccaactaataccaatgaacaagagtaatgaaacaaagaggcataatttctaccaccagaaaactcttacatatgtagtttttaaaatgtacactatgcagtaaaagatacgaaatccaatattagactaggtatgtaaaatcagaaatatttttctccagagacccagagaacttgaggtagtcattgtcctcaaagccctttgcacatcaagatatgcaaggtccaactgcttcacttggaattcaagtcttccaaaatatagtcccagctttatgtgctactaaagatctgcattcaacctttcaaggtccttaacactgatatgattatgatgtctcacctctatcctccataaatataaaacaggatcacaagcataggcaacaaaaacaacactagacaaatgggactatgttgaactaaatagcttctgcacagcatctacacacaatcaacagtgtgaagagacagcctggtgaattggagaaaatatttgcaaactattaatgtgacaaaggactaatatccagaatgtacaaggaactcaaacaacccaacagttgaaaaaaaacccatataatcccattaaaaagtgagcaaaggacatgaatagacatttctcaaaagaagacatacaaatggccaacaggtacatg

SEQ ID NO: 226304 - DNA, 453 bp, Homo sapiens
gaagcccagcattttgtttttctccacatattttaatcaatatttaccaagccataacaatctggctttcactgtcaccctagggttgagtttcatgagtaactaccttttccactggctgcagaaataatgactccatgtatgattggcagaaggtcattcatttgagcataggaaaacaagcagtttcaagaaaagagctggcatctctgcatgagtgaatcagtgcacatctaaaatgcagttactgaaattatagaagcctctcctcggccaattggcctcctttggaagatatggcctcacaccattccatgtgcatgtgaaatgtctagacgtgattatagagttttcttgagagctgatgcatccaaggaacatttaaagtaagaagcaaagtaatgaaaaacgtttctcagaaaataaaaattgttaatatggtcttaccacatt

SEQ ID NO: 226305 - DNA, 190 bp, Homo sapiens
aatcaggaaaataagcaaaatgaactcaataaagagatagaaatcatacaaaagaaccagacagaaattctagagctaaagaactcaatgattgaactggaaaattccatattgcatttcaatagcaaaatagatcaggcaaaagaaagaatcagtaaacttgaacacagatcatttgaaattacccaga

SEQ ID NO: 226306 - DNA, 305 bp, Homo sapiens
aaaagaacagcacccccaccccctgcaaaaaaaagagacgaaaaaggggtggcccatgaggtaggagtagaactaggagagtgtgatgtccagaaagctacatttaagaagtgtatcaagaatgagaggatgggcaacataatgagacctcatctctacaaaaaataaaaaataaattagcttggctgaggtgagaggatcgcttgagccctggaggtcaagactgcactgagccaagataagtgccactgcactatagcctgggcacagagtaagactctgtctcaaaaaaaagtagaaaaaaa

SEQ ID NO: 226307 - DNA, 1298 bp, Homo sapiens
ggagacactgacaacaggcttaactgggaagctgtgccccaaaaggagcttcaaagaagagccccctccacatcctcaggagaaggactcttggttggaaaaggcctggaagtgaccagtatctatggtgcttcgtctctttctcaggcccataaggacagaatttacatttgaaaagaagaacaacacagaaacttttgcaaagggctgccaatactttttctctgaggaacgtgcaatgtgatgaacaaaatttttttcccagaaagccagaggctgggcaaaggcagaggggcctggaggctgctcccaggttgggatttccagttccttgatgaagagaagttacgagactgggcatccttgctttgttcctaaacaggaggtgaaaacattcagtcttctgccattaggtctgccttattattttcgtcagtgttgtgcaggagaatccacttagaagcctgggtaaaattgtattacatgatcttgggtttggtccctgagaaagagccagattaacgctggcaggaaagaaagcaggagtgcccttcaaacacgctgctgaagggcaactggaggttccggggaaatgtgaagaaagaaacgcaaacacccctaggaaccagattgcatcttggaactgaggaggttctggaagctgtacacccaaggaagacattctgtgccggagagagagtgggagagatgtgactgctgctggctgggtgaggacagggcccagaggacagcatcactggcaccacacccctgcatttgggtcctctgcacttcagctcccagcatctgggcctcctccctgctgcctcccctcctcatcaatctgtctccactcaagaggctgatgggcaggtctccctgcttcttcaaatctttcaaagggaaacttcacaaagacaggagccctgacccatccaccttggcctcaccccaccccagcacggaagccaggcggccagtggaggccggtagtgctgaatggacatggggctggatgaaaagacttccgcctgcctctctcagccccggaatcgccatgagctgctattccggagattctatgctacagaagtacaaggtgaagaatgcataccgattacattggcaagggagagaagagcctggtgctagcacttttgcttctttggtctttcaataatgtctttccccttgattatacatgatatattcctattttggaaacttcgaaaactataaaaaagtcaaaagaataatattaccactcagaaataaagatcatcaagttttggtgtaaa

SEQ ID NO: 226308 - DNA, 552 bp, Homo sapiens
aactagtcttttagcattttagcactcaatttttttgtaactacccccttgataaaacacagagtaagtcagctctaaatcagttcattcagttcctagttattaaaaataatgtttttttcaaatggcttttcttatcaaattttaaaaatagaatttgaggattaatggtggatttttgtcacccatgtgatctgtgcctccatgagcacgcatcattgcaagtttactggatatcagcactactctcttcttaaagttttctttgtcccctagtacaaccatgacacatggccacaagcacttgagcaaagatgtggcatcacccaaatagatattgccaagattttctatgtcttgtgagcaaacgacaaacacaaatcacgttggtaaaggagggttcattcaacattcttatatttagcacatggagcaagggtatgtcactgcgcatagcagatctcagaacaacacacatcaaatggtgacgcatgaggcttggacacaggacctctaattttgcaacacaaataaaggccacttgaactgcaa

SEQ ID NO: 226309 - DNA, 457 bp, Homo sapiens
tgtgaggtccccagcaggccccagacaggaacgtcaccttccaagtgatgttaagtactgactagtccaatactgactacaaaagaagtttatttttatttttgaaaagtgtccaggtgccaaagattcacagacttttctttccgttttttttttctttcttttcttttctttctttctctcttttttttttaagagacagggtctcattatgctgcccgggctggtctcaaactcctgggctcaagcaatcctcctacttcagcttcctaaagtggtaggattgcagttttgagccaccaagcccagccagacttttttttcttcctcttcttatttttttggagacaaggtcttcctttgttgccaaggctgaagtgcagtgagctgagatcgtgccattgcactccagtctgggcaacagaactagactcttttttaacaaaaacaacaacaa

SEQ ID NO: 226310 - DNA, 485 bp, Homo sapiens
agggcctggtatggagtcactgctcgacaaagggagcttttcttaaggtgaccgtcttgagctaggccttgagggacagggatgtttgaaaagagggagcgatctttatggctggagaatgcagcattctgattgtacctgggattttattatgactgagtgacaacacagaaaggtcagtgccattgaaagaagttttaggccaggctcggtggctcacgcctgtaatcccagcactttgggagtccgagggcaggcagatcacctgaggtcaggagtttgagaccagcctggccaacatggtgaaaccccgtctctactaaaaatacaaaaattagctgggcatggtggcaggcgcctgtaatcccagctactcgggaggctgaggaaggagaatggcatgaacccgggaggcggagcttgcagtgagccgagatcgcgccattgcactccagcctgggcgacagagccagactccgtctaaa

SEQ ID NO: 226311 - DNA, 737 bp, Homo sapiens
tcaagtgattcccatgcctcaacttcttgagtagctggattacaggtgtgcaccactacacccagctaatttttgtatttttagtagagacggggtttcatcatgttggccaggctgatctcaaactcctgacctcaaatgattcaccagcctcggtctcccaaagtgctgggattacaggtgtgaatcaccatgccagggctgtatttttgtaatttaaaaataaacaattactaaaataggttattcctattctctgatagattttttaccttctttatttaaaaattaatgtaaacccaggctatgaaagtatagggagtaatagaatcacttcctatgcaactgtcatccagtgtgcaaaataaatttgaggtcccttccttctcttttcttccttgacatgtctgtcatttccatgcatgtttttatacctttaccacatatcatggtatagttttgtcttctgttaactttataataaatgatacatgctcttctgcaactttttttgttctatattttgagatttatgtacgttgatatatgtaatttcagttaattcattttgctgcacttcatcagttctagcacatttcctcctaacattttaacatctttgaaattgggatgcatcttataaatatataatttgggatatgagccacacttgtactgcatgctttggattttatgactaagccacaatatccgccttttctgacaattagattatt

SEQ ID NO: 226312 - DNA, 741 bp, Homo sapiens
tcaagtgattcccatgcctcaacttcttgagtagctggattacaggtgtgcaccactacacccagctaatttttgtatttttagtagagacggggtttcatcatgttggccaggctgatctcaaactcctgacctcaaatgattcaccagcctcggtctcccaaagtgctgggattacaggtgtgaatcaccatgccagggctgtatttttgtaatttaaaaataaacaattactaaaataggttattcctattctctgatagattttttaccttctttatttaaaaattaatgtaaacccaggctatgaaagtatagggagtaatagaatcacttcctatgcaactgtcatccagtgtgcaaaataaatttgaggtcccttccttctcttttcttccttgacatgtctgtcatttccatgcatgtttttatacctttaccacatatttctgcaactttttttgttctatattttgagatttatgtacgttgatatatgtaatttcagttaattcattttgctgcacttcatcagttctagcacatttcctcctaacattttaacatctttgaaattgggatgcatcttaaaatcgatgatgtcttgacctaacaattggtatattttctttttttgtggtacataaatatataatttgggatatgagccacacttgtactgcatgctttggattttatgactaagccacaatatccgccttttctgacaattagattatt

SEQ ID NO: 226313 - DNA, 737 bp, Homo sapiens
tcaagtgattcccatgcctcaacttcttgagtagctggattacaggtgtgcaccactacacccagctaatttttgtatttttagtagagacggggtttcatcatgttggccaggctgatctcaaactcctgacctcaaatgattcaccagcctcggtctcccaaagtgctgggattacaggtgtgaatcaccatgccagggctgtatttttgtaatttaaaaataaacaattactaaaataggttattcctattctctgatagattttttaccttctttatttaaaaattaatgtaaacccaggctatgaaagtatagggagtaatagaatcacttcctatgcaactgtcatccagtgtgctccatgcatgtttttatacctttaccacatatcatggtatagttttgtcttctgttaactttataataaatgatacatgctcttctgcaactttttttgttctatattttgagatttatgtacgttgatatatgtaatttcagttaattcattttgctgcacttcatcagttctagcacatttcctcctaacattttaacatctttgaaattgggatgcatcttaaaatcgatgatgtcttgacctaacaattggtatattttctttttttgtggtacataaatatataatttgggatatgagccacacttgtactgcatgctttggattttatgactaagccacaatatccgccttttctgacaattagattatt

SEQ ID NO: 226314 - DNA, 392 bp, Homo sapiens
aatggaaacttttcttactaagtggaattcaaaatggttaactaagtatgagagaggggacatcaaaagtaaggaagagaaatcccattataaaaagtgtgcacaggccaggcacaatgattcacacctgtaatcccagcactttgggaggccaagacgggaggattgcttgaggctaggagttcaagaccagcctgggcaacatgttgaaaccctaactctacaaaaaatacaaaaattagctgggcatggtggtgcacgcctatggtcccagccactcaggagtctgaggtggaagaatcacctgtgcctgagaagtcaagactgcagtaagccatgatcacaccactccaccactccagtctgggtgacaaagtgagaccctgtctcca

SEQ ID NO: 226315 - DNA, 327 bp, Homo sapiens
tttgggaggccaaggtgggaggatcacttgatcccaggagttcgatacctgcctagacaacacactgagatcccgcctctattttgaaaaaattttaaaattatcctcgtgtggtggcatacacctatagtcccagctgtttgagaggctgaggcatgagggtcacttgagccaggaggctgaggctgcagtgggctatgatcgtgccactgcactccagcctgggtgacagagtgagactctatctctacaaaaaagtgaaaaaaagaaagaaaaccgcgcgcaggtgtgtctggatagtgtgaagcagtgggaccctgtctctac

SEQ ID NO: 226316 - DNA, 736 bp, Homo sapiens
  misc_feature (6)..(6): n is a, c, g, or t
gccagngagctgcgcggtcgctgggagggagtccagggcgcagttccgggcgcgtctgagcggttctcgaggcgttctcgcctcggtctctggcgagtgcacggatcaaaagcagcatggatctgcctgtggatgagtggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgaggtgagtatcaggatacctggtatgagtggacaggatccggagggcttcttactggaggactagaccttcatctctgcttcttccatagaacactaaaatcatgtcatgctgctattggttgaattggaagcacattaatatctacctaaagtcggaccgggcgctcattgcctgtaatctcagcactttgggaggtcaaggcgggcggatcacctgaggtcaagagttcaagaccagcgtggccgacacag

SEQ ID NO: 226317 - DNA, 3720 bp, Homo sapiens
  misc_feature (6)..(6): n is a, c, g, or t
  misc_feature (1261)..(1261): n is a, c, g, or t
gccagngagctgcgcggtcgctgggagggagtccagggcgcagttccgggcgcgtctgagcggttctcgaggcgttctcgcctcggtctctggcgagtgcacggatcaaaagcagcatggatctgcctgtggatgagtggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacntgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagtggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtgagtccctttcccacttcacagggcacacactgttcctttcctaggctcttctgggtattactttttttctatggtgtttttaaaagcatgttgaaacttctttatttcctctttaggagagatctttgccttctgttttgctaacaaacataacgctttagaatttcctcctgggaggcggagcttgcagtgagccaagatcgcgccactgcactgtagcctgggcgacagagcgagactccatctcaaaaaaaaaaaaaaaaagaatttcctcctgggagatatggggaaagcttttagatctcaagtgagtttcccagagagaacttggccaggcagccccacccacactccagtatagctctccttctggttgttctctggttcgtcacagcccctttggctgtctcattcccagcactctcagctccaggctctctgccttctccctactctgcatcctcttccttttaaagcatttgcttgaaccagggctgattttacccccagacaacatgtggcattgcctggagacttttttttttttttttttgagaaggggtcttgctgtcttgcccaggctggagtacagtggctcggtcacagctcactgcttcctgcaactcctgggctcaagcgatctctggagatattttggattgtcatgacttggaagggggttgctgctggcatctattcgaaagaggccagaggtgctgctaagcatcctcccgggtacaagacagtgccccccccaccaaccccagcaaagaaggagccagcaacagtgtcaatagtgtcagggtcgagaaaccctgcttttttgctgctgttgtttgttttttgttttaaatcccctgttctactttgaaggttaaaaggaaagaacagcacgctgatgagctgatgccaaatccacttttgctactgagaccatttagggcccaatttcaggatttccgggtggaacctccaaccctggtaaagctgcccttggtgtatgtggctatgagaaagtgcttaaagcttcaacctaaggctgtgctgagtgggcctggtacccaagacacagagacattctgtttggtcagagagagagaaaagggctgcagagttaggtcagaggtcagccctaagatggtcaccctaaaatgaaaactgctatgtaaacctgtggtaaataccagatgaaaactttgaggccgggtgtggtagctcacgcctgtaatccagctgcccaggaggttgaggcaggagaatcacttgaacccgggaggcggaggttgcagtgagccgaggtcgcacaaatacctgggcgacaagagtgaaactcttgtctc

SEQ ID NO: 226318 - DNA, 3727 bp, Homo sapiens
  misc_feature (1268)..(1268): n is a, c, g, or t
agggtgttggaatcacagctgggaaatcagggacgccgtcccggaggaggtgccatttgagccgagtcgaagaacgtgtgggaattttccaggtggactccataagccaggatcaaaagcagcatggatctgcctgtggatgagtggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacntgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagtggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtgagtccctttcccacttcacagggcacacactgttcctttcctaggctcttctgggtattactttttttctatggtgtttttaaaagcatgttgaaacttctttatttcctctttaggagagatctttgccttctgttttgctaacaaacataacgctttagaatttcctcctgggaggcggagcttgcagtgagccaagatcgcgccactgcactgtagcctgggcgacagagcgagactccatctcaaaaaaaaaaaaaaaaagaatttcctcctgggagatatggggaaagcttttagatctcaagtgagtttcccagagagaacttggccaggcagccccacccacactccagtatagctctccttctggttgttctctggttcgtcacagcccctttggctgtctcattcccagcactctcagctccaggctctctgccttctccctactctgcatcctcttccttttaaagcatttgcttgaaccagggctgattttacccccagacaacatgtggcattgcctggagacttttttttttttttttttgagaaggggtcttgctgtcttgcccaggctggagtacagtggctcggtcacagctcactgcttcctgcaactcctgggctcaagcgatctctggagatattttggattgtcatgacttggaagggggttgctgctggcatctattcgaaagaggccagaggtgctgctaagcatcctcccgggtacaagacagtgccccccccaccaaccccagcaaagaaggagccagcaacagtgtcaatagtgtcagggtcgagaaaccctgcttttttgctgctgttgtttgttttttgttttaaatcccctgttctactttgaaggttaaaaggaaagaacagcacgctgatgagctgatgccaaatccacttttgctactgagaccatttagggcccaatttcaggatttccgggtggaacctccaaccctggtaaagctgcccttggtgtatgtggctatgagaaagtgcttaaagcttcaacctaaggctgtgctgagtgggcctggtacccaagacacagagacattctgtttggtcagagagagagaaaagggctgcagagttaggtcagaggtcagccctaagatggtcaccctaaaatgaaaactgctatgtaaacctgtggtaaataccagatgaaaactttgaggccgggtgtggtagctcacgcctgtaatccagctgcccaggaggttgaggcaggagaatcacttgaacccgggaggcggaggttgcagtgagccgaggtcgcacaaatacctgggcgacaagagtgaaactcttgtctc

SEQ ID NO: 226319 - DNA, 3374 bp, Homo sapiens
  misc_feature (915)..(915): n is a, c, g, or t
tgattttaataagcatgtggttgtaattgttccattttttaataatccttaactttcctttagatttttggaaacattttcagtaaacattgaagaatagggaccaagggtcattgtgggattttctttctgttttcagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacntgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagtggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtgagtccctttcccacttcacagggcacacactgttcctttcctaggctcttctgggtattactttttttctatggtgtttttaaaagcatgttgaaacttctttatttcctctttaggagagatctttgccttctgttttgctaacaaacataacgctttagaatttcctcctgggaggcggagcttgcagtgagccaagatcgcgccactgcactgtagcctgggcgacagagcgagactccatctcaaaaaaaaaaaaaaaaagaatttcctcctgggagatatggggaaagcttttagatctcaagtgagtttcccagagagaacttggccaggcagccccacccacactccagtatagctctccttctggttgttctctggttcgtcacagcccctttggctgtctcattcccagcactctcagctccaggctctctgccttctccctactctgcatcctcttccttttaaagcatttgcttgaaccagggctgattttacccccagacaacatgtggcattgcctggagacttttttttttttttttttgagaaggggtcttgctgtcttgcccaggctggagtacagtggctcggtcacagctcactgcttcctgcaactcctgggctcaagcgatctctggagatattttggattgtcatgacttggaagggggttgctgctggcatctattcgaaagaggccagaggtgctgctaagcatcctcccgggtacaagacagtgccccccccaccaaccccagcaaagaaggagccagcaacagtgtcaatagtgtcagggtcgagaaaccctgcttttttgctgctgttgtttgttttttgttttaaatcccctgttctactttgaaggttaaaaggaaagaacagcacgctgatgagctgatgccaaatccacttttgctactgagaccatttagggcccaatttcaggatttccgggtggaacctccaaccctggtaaagctgcccttggtgtatgtggctatgagaaagtgcttaaagcttcaacctaaggctgtgctgagtgggcctggtacccaagacacagagacattctgtttggtcagagagagagaaaagggctgcagagttaggtcagaggtcagccctaagatggtcaccctaaaatgaaaactgctatgtaaacctgtggtaaataccagatgaaaactttgaggccgggtgtggtagctcacgcctgtaatccagctgcccaggaggttgaggcaggagaatcacttgaacccgggaggcggaggttgcagtgagccgaggtcgcacaaatacctgggcgacaagagtgaaactcttgtctc

SEQ ID NO: 226320 - DNA, 2469 bp, Homo sapiens
  misc_feature (6)..(6): n is a, c, g, or t
  misc_feature (1261)..(1261): n is a, c, g, or t
gccagngagctgcgcggtcgctgggagggagtccagggcgcagttccgggcgcgtctgagcggttctcgaggcgttctcgcctcggtctctggcgagtgcacggatcaaaagcagcatggatctgcctgtggatgagtggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacntgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagtggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtttgcagtacccgaagccctgagcacaatacagaaagctgaggaggttctgtcgctgcactgtggccccatgggaaccgatgacaatccag

SEQ ID NO: 226321 - DNA, 2703 bp, Homo sapiens
  misc_feature (6)..(6): n is a, c, g, or t
  misc_feature (1261)..(1261): n is a, c, g, or t
gccagngagctgcgcggtcgctgggagggagtccagggcgcagttccgggcgcgtctgagcggttctcgaggcgttctcgcctcggtctctggcgagtgcacggatcaaaagcagcatggatctgcctgtggatgagtggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacntgaaagcaacaatcaggtcaagacacttaattatggcctaggggagagtgttgaaatgggccatgagctcttcaaattggcccagatctttttcaacgggtgagtccctttcccacttcacagggcacacactgttcctttcctaggctcttctgggtattactttttttctatggtgtttttaaaagcatgttgaaacttctttatttcctctttaggagagatctttgccttctgttttgctaacaaacataacgctttagaatttcctcctgggaggcggagcttgcagtgagccaagatcgcgccactgcactgtagcctgggcgacagagcgagactccatctcaaaaaaaaaaaaaaaaagaatttcctcctgggagatatggggaaagcttttagatctcaagtgagtttcccagagagaacttggccaggcagccccacccacactccagtatagctctccttctggttgttctctggttcgtcacagcccctttggctgtctcattcccagcactctcagctccaggctctctgccttctccctactctgcatcctcttccttttaaagcatttgcttgaaccagggctgattttacccccagacaacatgtggcattgcctggagacttttttttttttttttttgagaaggggtcttgctgtcttgcccaggctggagtacagtggctcggtcacagctcactgcttcctgcaactcctgggctcaagcgatctctggagatattttggattgtcatgacttggaagggggttgctgctggcatctattcgaaagaggccagaggtgctgctaagcatcctcccgggtacaagacagtgccccccccaccaaccccagcaaagaaggagccagcaacagtgtcaatagtgtcagggtcgagaaaccctgcttttttgctgctgttgtttgttttttgttttaaatcccctgttctactttgaaggttaaaaggaaagaacagcacgctgatgagctgatgccaaatccacttttgctactgagaccatttagggcccaatttcaggatttccgggtggaacctccaaccctggtaaagctgcccttggtgtatgtggctatgagaaagtgcttaaagcttcaacctaaggctgtgctgagtgggcctggtacccaagacacagagacattctgtttggtcagagagagagaaaagggctgcagagttaggtcagaggtcagccctaagatggtcaccctaaaatgaaaactgctatgtaaacctgtggtaaataccagatgaaaactttgaggccgggtgtggtagctcacgcctgtaatccagctgcccaggaggttgaggcaggagaatcacttgaacccgggaggcggaggttgcagtgagccgaggtcgcacaaatacctgggcgacaagagtgaaactcttgtctc

SEQ ID NO: 226322 - DNA, 760 bp, Homo sapiens
cttgttcaaggttatgtaactgctaagttattgttgtaagatttgagtctagaacaggctgttgggaaagcctgagtttttctgatatggtttgttacttagggtttgaatcaggctgttgggtttttctgttatagtttgttacttagggtttgaatcaactggccctgtctctatcagatcaagagatatgaggaacatcatctgtcttcttctccttgtcttctacccctaagcatcctaggtctgctatcaaaactcccgttcacttcagacaatgacgtagtctggttttgcgggtagcgagacgggggaggtgggggagcagcatttgtgggggtggagggagggcaatagagtacagaagaacagatttctagttttgcctctgtcactaactgagccatgttgagtgcatctttcccaatctccaggcttcattttttctgcctgtaaaacacagatgcatagcttagttgttaagcagacagacaaaagacagactggctctaccccaactctgctgctcactagccctgtgaccttggaaacatttctcatctctaaaatacagatcatcataatatctacttcatgggactgtgatgagagtgaaagaagttaatacacataacactcttaggagagtgtctggtgtaggtgttttacgagtattgctgtcattattctccttaaatgtgtaattaatgaaattctagtattttcaaataaatatatgggaaataacacagaatttaaa

SEQ ID NO: 226323 - DNA, 484 bp, Homo sapiens
agctgcccgcacaggcctcgcgccacctggccgcagcttcctcccctttatccactccgtatttgtttgtccagcctaggccttgggggttgtgggggagacacaagtacccgtgactggtcggacaagtgcccgttgttgggggcgtgggcgctgggactgacgcgggaggtggctctgatcatgtcgaggtgaggaggaggcgttgaggctcagaaagggcacgcagcgtggacgtgaggacgtcggggaggctggagcagtgaggccgacaggaaggaccttacggggctcacatgctatcccacgacgaggacggactcaggacggcagccctgatagatgcggctgggggctggcgggtcggggtcgcacaccacaggatggaggggcagcggtgcctggctccgccttaagaaacatgggcccttgggggacccggatttctgatacttcaatacacaaatatggatttttattgaaa

SEQ ID NO: 226324 - DNA, 337 bp, Homo sapiens
agggttaggttacctctaatatagaggcatgccttttcagagtctgtgttgaaagcatggggtattcaacaaggtcttttcactctagcttagctgctaggaattttaatgtctcccggacctgtgcttacaagcttaggtagttgtttggttcatactgtttagttgctctttccctagatgttattctttcactggtctgatggagtattgcgtgcacatgtgcagcttagtctctaggcaaagattccggagatctctctaaagatttctgaaactttgtctccacagctcccttcttctagttttgctgctcaaattccagcaaccttagtag

SEQ ID NO: 226325 - DNA, 182 bp, Homo sapiens
gtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcat

SEQ ID NO: 226326 - DNA, 511 bp, Homo sapiens
cacagcaagcaggttctagagccagcctcagaccatccccaccgtgagtcccccgtgcgagtgccccttgaaggaggttttctaacaggtgagtggtctgattctgtctctgtcctgtgggatggatgggctggcacttgatggctctccttccccctcaccctccacggagaaggctggaaggtgcatttctcagacttccttgcctgggaaatgggaagtgatgcagaggatcccaacgtctcctcggcaggcttggtggtggacgtgctgggccatgttccaggggccagctgctggctccgtgggtgctgagaggaagggggaaggctgtctattttttggccaggatgaatccagcagatgtggtaggtcctggccgcttgctgacccgtgggtctaccgggtgctccggagctaatggtccccagatgctccaccgtcctgatgtggcagaggcatggcattttggcgggccagtttggtggcatcctgggaaccgttttggagg

SEQ ID NO: 226327 - DNA, 408 bp, Homo sapiens
gaagcatgcatattcaaatgtatatgttaaacacactagaatagctgcttatgggaagagaagggaaaaggagtgagaatcagaaagaaagaaggggaaataataacgtacaagagaatcctcacacagaatatagtgctaatgtggtatctactgaggaatattactaacttagcaaatacacaattttacattctaaattctttttgttttttgaggaagcactccaaaaacatttggaatggattaatgaaaagacatcaatttaaaattagcctttagatcaggtgtggtaactcacgcctgtaatcccaacactttgggaggccgaggcaggaggatcatctgcggtcaggagttcgagaccagcctggccaacatggtgagaccccatctctactaaaatac

SEQ ID NO: 226328 - DNA, 450 bp, Homo sapiens
tgggattacacgtgtgagccaccgcaccaggccaatgtgatgattatctatggatataccctgatcatcagcaggaggaaatgaagaggtgctgtcatctatatgatctcagtattttaaaaatcagcttccagcccatgtggtggttcatgcttgtaataccagcagttgaagaggcttaaatgagaggattcctggagcccaggagttcaaaagcaacctgggcaacctagcaagacccagtctctatcaaaagttaaaaaaaaaaagtgggcatggtgatgtgcacctgttgtcctagctattttggaggccaaggtggaaggatcgcttgagcttgggaggctgaggctgcagtgagcagtgattgcaccactgcattccagcctgggcaacaaagcaagaccctatctcaaaaaatatataataaaaatgaaaatcagttctcaa

SEQ ID NO: 226329 - DNA, 609 bp, Homo sapiens
attagacagcagggaaacttttgagtctggctttcttcgcttagtgtaatgctttagaaattcatcaagttctgtgaatgagttgctctttcttttcgttgctgtgtagtattccattgtacagatagatcccaatttgtttatccattcaccttttgatgcatatttgggttgagtcctgaggatggttttcagtcacagaaaagactatttggaagtttatttctggagtaaacaattagtttctatttattaaagttactagttcaaaacactactaattctttcttaaccttaagattcaacctattggccaggcgtggtggctcacacctgtaatcccagcaatttaggcagccgagacaggaagattacttgaggctaggagctggagaccagtatgggcaacatatcaagaccccatgtctacaaaaaattaaaatttaataataataaaatatttaaaaagtataaataaaattcagcttacaaaccttgtttgaaaatctagattttagcaaatgcttctaaggggctttttacaactttatatcttcaaacgtaaatgaataggtttgattttctttttcagtatctcagtgtggaaga

SEQ ID NO: 226330 - DNA, 503 bp, Homo sapiens
agtttctcctagccagacgtgtttcttgtacctgcagctcctcccagaggccacttataagcagccctgccatgtggccacacagcactggtcatgccatacccatgcacagtcatacatgtccacacacatgcacacgtgtgcccaaacatgcatgcacatatatggccgtacttatacatgtgtgcacacatacacatgtatctatacacatacagttaacacacacacacacacacacacacacacacacacacacagagtaacacactctgtcttacctgtgtgctgactgctgacctattttgtaatccctgagctaattcagggacaaaactagttgatttcgtactcaaattccctcaaatccgcatcatcaatgctaccacctctgagacgttgtcatctccatttcttccaaagtccatttttatcccttccttatttttaatgttgcatgactatttactttttccctcttgatcaagatctggcaccaaagg

SEQ ID NO: 226331 - DNA, 477 bp, Homo sapiens
aaaaaaattcttgcagatggattgaatgtgatacacgaaagaaagagtagcagagtcatggcagagaagccctgctatttactgagaaggctaactctgcaggaggggtgggttgaggggatgagaaagaagagctctattttggacatgttaaatgagaaataccaattagttgtcttggtagagattgagattaatatagttcaagttcctgacataataggtcctatctaaaatgttagtttccttagcttcccttttgtggtatttgacgtttttaacaactccctccttctaaaaattctgtttccttagctttggcaacatctttctgtctttattccgtaatctttgacacattttatagttcctcttcttggatactttccttgcacgttgcccttttccagtattttgtttttgaaactcttctcaggtttaacattttgttgcttatcctttcagtcttttacttga

SEQ ID NO: 226332 - DNA, 516 bp, Homo sapiens
tcaagacgtagttcaaatgttacctcttccgtgaagtttacccgacttcctctcccatccgcattccactggaatccccggttcttttatctatatttctgttgatctttgatactactcttttataacacatgagattgtaattaattggatgcacctgaccacaatcaagtcctaccctgggagccacaatatcattgggcaaactttagtctattgtccaaactgtagcatataaaagccgtgtcaaaaaaggaaaagctaaaacatccgctctacctgtgagtgctcttctttgaatgtccacattaattaccctgaacctggaacactttgttttaagacatggatgatcagacggtggaataaaggtcaagatgaaggatagagggaagaaacaaagatatgttctatttagtaggttcagggcaattcgtttcagaaaagtttcttacatttatatactacatgcatgactatatgcatatgatctatttattaaaattgtttttattc

SEQ ID NO: 226333 - DNA, 291 bp, Homo sapiens
tatccggccggcccaactaaggtcgggagttcaagaccagtctggccaacatggtgaaaccctgtctcaactgaaaatacaaaaaaatttgctggacgtggtggcgggtgccagtaatcccagctactcagggaggctgaggcaggataatcgcttgaacccggctctcagctcaggaggagctcatagctgtgcttctgtgtgcattccctatagaacccactcatcctggtaggcccagtgctaaaacgagtttggacaggggaagagtgggggcaactaacttattga

SEQ ID NO: 226334 - DNA, 452 bp, Homo sapiens
cggtgagcggtcgccggaggtccaggtgggagacgccgcgccccgcaccgaggtatgagagctgcagcagcgacaaccaggcggcctgaagtgcagacgcaaaacggatcccggggctaggacacgggggttccgaaagcaggatgacgcgcccggaggggacgagacggtccagagcacgcccgggagagagggcggcccagacggcaccggcctgcgctccagccctccctccctcacacacgcggaatctcaaaacatgcggacatgccagcccctcccgcacacctcgggctgcaccacctgctcccggcgcctccccgcccccggctcgcccgcgccggttctcacgcgcggccagcgcccttccccgccgctcccgcccctttcacttccgcacagcttaggagtcggggccagcgcctccgctcccaccttcccagcccctctgc

SEQ ID NO: 226335 - DNA, 431 bp, Homo sapiens
agaaaagctcaacaaagaaagctgatgaattcccaagaagacaagcctcaaaatatgggttgttttgtttttgcaaaatttcccggctacctgacttcaagtttatattttacaaaaccacaccgcagtggctaaagcactttaacaaatcatttcatcaattcctccttgtttaagtatcaaaatgttactaagaagatgcttttgtctgttattccagcaatctgagtgctgtacaggagcacaccatcacaccatcattcataattttttttttttttagcaacgcacctactataatccataatgttttgtttgttcgtttgtttgtttgtttgttttgcttttgcttttgggtcttgacctccagcaactcattttttgtgatactggttctcaagatataattaaaacataattaaagatcaaga

SEQ ID NO: 226336 - DNA, 372 bp, Homo sapiens
ttttgtttacccctgcatcaccacaaacatatgagtaatgccttacactatgacatcatgacagctaagatggcactaggccataggaatttttcagttccattataattttatgggaccaccatcttttatgtggtccattgttgactgaaatgtcgttatacagtgcatgatggtaatttgatgtggcattctaatacgctggcaaagctgggaactaatatttgagctcaagttactcatcctataattgtttcaagtaaacgtatagaaaagattagacagttttgtggttgatggccgaataattttgctgttttctttataagatttgattgcaacagaaccaatattttgttttcttaaacttca

SEQ ID NO: 226337 - DNA, 391 bp, Homo sapiens
catgcctggcccactaggaagttttatgtaatatccgtttctagtcatatgtaagatacattattgtatcatttactccttcctatatctcacccaactccatagttcatttttctttctgatctacagggttctctaatcaacccacttctctctactgctaccacactagtgaattaccatcatttcttttctgagctactatactactttcctaatgatctatctgcatccattcttgtctcatcacaaatgtagtgagtgaacatttcaaacataaatctcataatgtcatttctctactgaaaacccttccaaagtataagtgagaagctatcatgctctacaaggctcaacatgagatctggctcctacctacctgtgcaatgtc

SEQ ID NO: 226338 - DNA, 869 bp, Homo sapiens
tgggagttgcggggatttttcaagaagcagcagctaccccggcgtcggtcactgggccggggtaggggaaagagcaaaatcccagtgggtttgcgcgagggatcttctagggtcgaggcgggtgtggggggagttggaaccgggagacaccgcttggcgcatctctccctcggtctctacctcctgtcctatgccagctccccctttaatttttttcctctcctttaatctaatttcttccaactccacctttgttgttaccggcgtcacacccggaccagccaatccccgccacgcaatcagcttgtcaaaaagcctcggccatccctaggaaagcaggccgcaggcgctgccccccggcggcggcgggcagccgcgaggggagcccagcacccggttctcgctgccccgggtggcagcggggcagcctccgacaagacgtcccttggttcactgtcctgcaggccggggatgaaaggcctggacagggtccaccacccactctcccactgccacggccgtggttgactgtctttgcctccccttttcagaggaaaggttatcaggacaggacgcagggagccagaagaccatctgaaggaagcctgcttccaacgggcccagcctccagccaccgctcctggggcagcgccattgctcctggctctcaggctgccagtctcccacaccgacgctctactgcccgcatctcggccagctgggtcacccagcccctttcgactctcccctggcacgcagccttctccttcactcggcctgcctcgctgctgctgtaattcctcttgtctcctgggagaaatgagattgctttcccaggacttccacatcccacttctatcaggtttcac

SEQ ID NO: 226339 - DNA, 450 bp, Homo sapiens
caggcgcgaccccgcctggcccgcgcccgggagctgaccccgcgacccctggccgacccctcgccccttccccgactgccgcgtgtgcgcgcgcagtcactgcgctggccccgcgacccaggccgagggactcggttaccgaaagagtccccctcataagacccgcctggccgcgcccgcgggcaagcaggggcttccaggcagggccctccccggtgaccgcgggcagtgtggccccctcgcccagctgggccccggcgcggccgaacaggcacttctgccgcccgaggtcctgggcctggaggtttgggctgttttcggggggcagctgtaactcatccccatctgtgtttgaagtggaataaatacttcgaacaataggaatataccagtagatgctacttagcattttctaccatgtgtttattacagtaaatattttttaatggc

SEQ ID NO: 226340 - DNA, 399 bp, Homo sapiens
acagatgctcttcaacctgctgtggagtttcatcccaataaaccctttacaagttaaaaatactgtaaaatgaaaatgtatttaatatgcctaacctactgaacatcatagcttagcccagcctgccttaaacatgcccacaacactgacattagcctacagttggtcaaatgctgggattacaggcgtgagccactgcgcccagccaatataatgttttccagattcctccacgctgccctgtgtaacagttgttctttcttttttatcgttgagtagttgtctccattgtatggatggataggccacactggtttatttattctcctattgatggatatttgggttgtttccagtttttggctactatgaataaagatgctatgaataatcctgtgc

SEQ ID NO: 226341 - DNA, 254 bp, Homo sapiens
cgtgtcttttttactgttgtattctcagagcttagtacaataactgacacagggtaaacctgtaagaaactgttgaaataatagatgaatgcgtgaatggatgtatgactaataagcaatacatagaactttgtggtcgggcacactggctgacacctgtaatcccagcactttgggaggctgaggtgggtagatagcttcaggccaggagtttgagaccagcctgaccaacatggtgaaaccccatctctacc

SEQ ID NO: 226342 - DNA, 603 bp, Homo sapiens
atggctcactgcagcctccacctacctggtccaagtgattttcccatctcagtcttttgggtaatgggactgcaggcaagcaccaccatgcttggctattttttttttctttttgagatggagttttgttcttgttgcccaggctggagtgcactggcgtgatcttggctcactgcaatctctgccttccgggttcaagtgcttctcctgcctcagcctcccaagtagataggattacaggtgtgtaccaccacacctggctaattttgtatttttagtagagatggggggtctctccatgttggtcaggctggtctcgaactcctgacctcaggtgatccacccccccctcggcctcccaaagtgctgggattacaggtgtgagccaccatgcctggccttgtattttttttgtagagtcagggtatttgccatgttgcctaggcttgtctcaaactcctgggctcaagggattctccaaccctggcctcccaaagtgctgggattacaagcgtgagccaccctacccagccccaagaaagtgttcttagtaaagtgtttttactggagtctctcagttcttttatgctggttacattgtga

SEQ ID NO: 226343 - DNA, 465 bp, Homo sapiens
gacatggagccaggcataagccagccttgcttccggccccaccagaagcaaacatgagaccagagtatttcgaatttgagattttctttttttgaatatttgcatatacatcctgagatatcttggagatgggccctaagtctggattagtctgttcttgcactgctataaagaaataactgaggctgggcgtggtggctgacgcctgaatcccagcactttgggagactgaggtgggcagatcacttgaggtcaggagttcaagaccagcttggccaacatggcaaaacctgtctctactaaaaatacaaaacttagctgggcatggtggtgtgtgcctgtaatcccggctactcgggaggctgaggcaggagaatcgcttgaacccgggaggtggaggttgcagtgagccaagatcgcgccactgccccgcagcctgggcaaaaatgagactacgtcacaaga

SEQ ID NO: 226344 - DNA, 391 bp, Homo sapiens
agggagtcatttaggaaggctggagatatatcttataatattccagggcagagtgtccattgctgctagcagcaattatttttaaaaagatactgccaggctgggtgcagtggctcatgcctgtaatcccagccctttgggaggctgaggtgggctgatcacttaaggttaggagtttgagaccagcctggccaacatggtgaaaccccgtctctactaaaaatacaaaaaaattagcctggtgtggtggcatgtgcctgtaatcccagctactcaggaggctgaggcaggacaatcgcttgaacctgggaggcggaggtagcagtgagccaagatcgtaccagtgcactctagcctgggtgacagagtgagactctgtctcaaaaaaaaa

SEQ ID NO: 226345 - DNA, 281 bp, Homo sapiens
cgactttcctttccaaacccaagtttttgatagagagggctcccacagcgtgtcctgctctgctcctgcacagcacagccaggcgctgagtttggggtccaacattgattggcagccaggagagctggtcctaaacacggaagagaacagagcgctggaatgaatgcagcttcccacaaatgggagggattagaaccagggcttcttgctctaatccaccttttgtgtatctgtttcactgatatatttgttctgtattatggaaagtacagaaaagcaga

SEQ ID NO: 226346 - DNA, 365 bp, Homo sapiens
acctttgtcatactgttttctctttagaaatgtaatattacctaaaaaataacttgaaatgtggattaaatttatgcataaacaagttcattgaatctttattcacaaatataaatatgtatctatttacaacattttaggaatggttaagaaaattatcttatctcaatataacagaatattaaacaacccattaaaaatgaaatttgcaaactaaaaacacagaaataccattgaacataaacttatttaccttccctccctttcatttttagatttatttatgtatcttcagtatttttaccatctttctcaatggaggaaaatgttgaagaagaaaattcaatataccatgatattaactg

SEQ ID NO: 226347 - DNA, 443 bp, Homo sapiens
cctgaaagggcttgttccataaacctgaattaaggactaacttttaagaaggactactgaccataagctggatctccagacaaatcaggcaggaatattctaattaaagtcttcgtatcaagttgaagttggaacaaggaggtaatcatgaccgattactgagagatgctaaattatacctaataataatgataatgacacttacgctgtgcttactacttgccaggcattattctaagcactctctctatattaactcctttaaccctcacaacaaccctgtcgggaagttgagtagttgctacgattttccccactttatagatgttgaaagggagggtaagggacttctctgaagttgcaagcctagaaggtgaaagagccaggattcattcccttgcagtcttggtccagagcccgtgcttttatccactatactataa

SEQ ID NO: 226348 - DNA, 418 bp, Homo sapiens
ggaaagcgccagaagaggggcactgaggcagagggaaagctaagcagcctgtggctcaggggactaccttgcaactgcttgaatgtaaagcaggcagagaaatcctcctgggaacctgaggccaggtgtatgagtgggatttaagagaggccagcgccccttccggggtggccccagcccaggaggagggcgtgagaggcacacctgggaagtgtcagagcctgacaggcgtgagctggaggcctggcaggagagtgctctcaccacctgaccatcctggaaagctgtcaaagtcccagtgcccatgccacaccccacaacaatccaatcaaactctttggaggtaggacccaggcgtctctgatttttaaaatttccaggtaattaaaatattcagccatgcttgaaaaccagtgct

SEQ ID NO: 226349 - DNA, 387 bp, Homo sapiens
tattcattctttagcttttaaattctttttcatttccacctagccttgtttcacttctgcttgttgtgattttttttccctttataaaagaaattttactcttttataaagagtaaaagagtggctcacgcctgtaatcccagcactttgggaggctgaggtgggtggatcgcttgaggtcaggagttcaagaccagcctggccaacatggcaaaatcctgtctctactgaaaatacaaaaattagctggtgtggtagcgcacacctgtaatctcagctacttgggaagctgaggcaggagaatcgctttgaacctgggaggcggaggttgcagtgagccgagattgtgctaccctagcctgggtgacagagccagactctatctca

SEQ ID NO: 226350 - DNA, 339 bp, Homo sapiens
cctgccagaagccgcaagtatcgaatcctgtttcttttcccggaaccgttctgaatgctatcatcagctcacctagattaagccaggggtagcgaaaggtgacgaggctgttttcggagagccaggggtcccagcggcccgctttcctgctagaggagggggcggcgcgtagccggagacttcagcgcggcggctccaaagatctcccttcacttttcacccctgatcatccccaaagctttgagctgcctttaaaaaccttgaccttcaacaggggtatgaaaacaaccccaggcgtttctaaacaatcaccctactacactagcagcaagcagtagg

SEQ ID NO: 226351 - DNA, 399 bp, Homo sapiens
tggtcctctgtgtctgttgtgaaatgtaatactcgcagaatttggtgttgccacttgtatgtgtgttctcagagttcgtgaggtggacttatatgtatttgataaaaatagtttgtggttctgtgtgtatttgagtttatgtggcttctgtgttttgtattctgggagatgtgggaggttcagtgcatgtatttggaaacagagaggctgtgtaggttgtgtttggattcaagaatcatggattcctgtattttagagctgtgggattgtatgtgattctttttctgggtgatgcatgacacaagtgttgtataccttgtgatttttttttttttgagcctatgcctataggattttcattatgtactgttaacaaatctactgaaaaggattttctta

SEQ ID NO: 226352 - DNA, 602 bp, Homo sapiens
catctgcagaatggagaagatgctaacaatacctccctcatcgaattggtgtgaagaattcaatgtcttggtgtttgtaaagggcttaggatagtgtctgacatgtagtccatgggatgtcttgatgcaggtcatcatctcacccttgttcattattggatggagaaaccagggtcccagagacactggccggctggggcaagatcaccactcattcctatcaacagctgggttaaaggtgcagaagacatgcttattcgatttgcaggtgacccaaaactagatgcagtggctggtattttaaatgaccaaacaagagcccaaaatcccctaaagcagatgagatgatggactaacccctctacggatggatgtaaaattaaaattttttgcatgaaagagattttggctgaaggttcattgcacattgagatggttgccccaaatgattgtggtctcaggctgagtctgtagaggtacaggttgacgatgagggaggtgatagctggagggttgtgctcaactctggttgtcgtacatttgaggagacagggagagaccagagtccagtttgtggagggtaaaggatagtgaggaactgg

SEQ ID NO: 226353 - DNA, 457 bp, Homo sapiens
agggaaggataggaagtatggacagaggcaatgaaaggaaatacctggcgtgtgataagtatccaacatatgacagctattattatgctgggttctgtatggaagggtttgtttctttttctctataataagtgagtagaatacatataatccttttatcattttccataacatttagcaagcctggcactatagttgagctcttttagctttgaggtaaaacatatatgctgaaaacttttaaatatttactgcaaaaatttctagggagttagtgaagcttcttcctgtattttgaaaaatagtatcgtatcattatatgttctaagtctgtgttctactgtattctgcagtaattctcaccataggaggaatttattattctgcaggaattctcacagtaagaatatcttccttccttccttccttccttccttccttccttccttccatccat

SEQ ID NO: 226354 - DNA, 484 bp, Homo sapiens
caggttagcatgaggattcagatgaaacaacttgtgagccagtgctgtcatgtatggtcctgcagagtgtgccccgatggcaacacagctgctgttttaacaaatcagtgcattacaagggtttcccaacagatagtactgcagtgttttgaggtagggcacttttgtctaattcatacaagatgctatatggactatccctgctttggttagaatatatttggagactgagggtgaacaccaggcagagataggaaatggaaactggcttaaggctctgacaaaaccaagtaaagttaaaaagccattaaattaaatttgggaacaagatttgcaattagaagctaaagggaagtatgcaggaaaccagtctgaggaataaaaagtagttattatgttgttattattttgctctgaaagataagactttttgtagtgtaagcctatcctaccaaagaataaaaatttttaggtaataataata

SEQ ID NO: 226355 - DNA, 414 bp, Homo sapiens
aattttactaggtagagaatgtgcaggtaggatatattagggtaaataaaatgtatcactaaaattaactccacctgcttcttttgattttagtttggctactagaaaattttaaattatgtatatggctcaagaacatatttcttttggacagttctagccttgaggcatagagataagctattgccgtaatcgaggcaaaagatgatgaatgcctggactcagacaatggcagcagggatcgaggaacagtaaaattcaagagatatttctaaggactgaattgactgatggaggttagtgattacatttgatggggaaagggtgatggagcaggacaaatcaaagattgctccaagttttctaacttggataatattgattgggaggggaagccatatatcacattagaga

SEQ ID NO: 226356 - DNA, 414 bp, Homo sapiens
acagaaaatacttgtgtgtccaaaattaggcactggtaggtaggagttatgtggcacctgagccagaactggcttcccccattgtgagagtgagataggttcttctgctgacatagcacatgaccttggcaagttagttcttctctgagcttcagtttcctcatttgtaaaataggagtaataataatacctaaaggggtgttagtgagaattaaatgagatcatggatctgaaaaatgtttttaaaaatctgtgtggatcattatgtggtactttcaataataataataggccgggtgcagtggctcacacctctaatcccagcactttgggagaccgaggcgggtggatcatcagaggtcaggagttcaaggccagcctggccaacatggtgaaaccttgtctctactaaaa

SEQ ID NO: 226357 - DNA, 578 bp, Homo sapiens
agaaaggagtgggacaatagagacacacaagttgctgggaagagtaggtgcctttgtggagagaaactgggtcaccatgaaacaggggtaaaaagaaaatttgtttttccatttgtaacttttaaattttatacttatgcttatagtgcctattcagaaataaatatgtagacagataaatgaaatttatagttgtccaaacaaaaatatatgtatcagaattgtaaatggaagatcattcttcttgacttgtaaaaatctagtttgggagattctgagtttatgaaattggaaaagctaaagggtttcccagccatcctgtctccattgctcactcctgcacttccgcactccattctatttccttcttttggtcactgtgaggcctctctttatttgtactatggctgctgtccagccctcttccatctctatagcccaactctttgcttcccaagtatcgtggcctgtgtctgccagccacggagccactgaataggcagcactccaaaaacaagcgtctatgaggccccagatcttggtgaatccaggtgccaacatggttttcactacagttt

SEQ ID NO: 226358 - DNA, 460 bp, Homo sapiens
gaggactatttcagatggtgtgtgatgacagaggatgacaaaagcttggatcagggaggtgatgttagctatgaaagcaaacagtcaggatatatttttgtggtaaaattaatggaatttgctgatggcttaactatttgggggatggagaaagatgttaccagcaatgatgcctaagtgtttggcttgagcaccttggttggttgtactgagttggtgtctggggaaataatgaagactttcacttaaattaaaataggaatgctagcctaatatgcaaatcctcattatattaacccaaatcatcaaatcaaatatgcatcactttctaattttttattttatttatttacttatttttcaattgttttaaataataaaaaatataatctattttatatagttatatttttcattaaattaaatttttcaaatcttattaaaataaaatttggctaaa

SEQ ID NO: 226359 - DNA, 565 bp, Homo sapiens
atactttgcccagaaatgtgactaatcactcaagtatgcctgtgaactgtaaagaaatatcagatgctacctatcataggtgttagagagttcagtttgaatctggccaatgtaactgctaaatttattttttaatgtactctttgtcagggagtataatagaatccaggatctctatggcgtatctcacaatgtatgggatacaatccaaaatcagtagacatatgaaggaaaatggaaatgtgattcattcttgagaagaaggcaactaatacagattgattgtgaaatgaagaatttaggattttaaagcagttattataaatagaatataaagggaaatatccttataatgaataaaaaaattagaaatcagagtagagaaataaaactatgtaaaagaaccagatagccattctagaattaaaaaaaacttacatgaaataaaaatttctacatggccttcacagatttaaacataatagaagaagtagtgaacttgaatcagatcaatagaaattatacagtctgaagagcagagaatgaaataaaagaaaaacttcag

SEQ ID NO: 226360 - DNA, 454 bp, Homo sapiens
tgcctccctgctttcatatggacaattgactttttaaaagtctttttaagtgcagttcaaattcaaattcccagttttttggagctagaagcatctccctaaagggatgctgagatggcttcttgccagctctctttctacatacatacatacgtatatatatatatatatatgtttctattaatagatcagtgctaccctaacttcaacctctgtgggaaacacatatggacttgttaaaaatgcagattttggccgggcgcagtggctcatgcctgtaatcccagtactttgggaggccgaaggaggtggatcatgaggtcaggagattgagaccatcctggtcaacatggtgaaaccccgtctctactaaaatacaaaaaattaactgggcatggtgatgcatccctgtaatcccagctactcaggaggctgaggcaggggaattgcttga

SEQ ID NO: 226361 - DNA, 230 bp, Homo sapiens
aatcacattcctgtgtggcctggatctccacacccaccgccagtgccttctccaggaccctcatggcaccaggatccccgcccgcatcatcgatctttccctggctcctggagtcttccagtagcgcttctgtgtgcttacattgctctctcaaatgaaccaacaaagcctgcaaattctgcctggtccctcacacaccaggttgtctctcatctttctccttgtcataa

SEQ ID NO: 226362 - DNA, 533 bp, Homo sapiens
gtaagcacaggtaggtttgggtataaagacaagtgccagaatttaaggagctaatagcttagagcaaaaggaggccaaatcaaaaaacaggcattttggctgccatgacatgtacacattcctacaatctgcccatttgttcattaaaaaataatagggcctcaaaaccgtggcacttcaatcagagcatcagcagaaacaattaaccatcccaataaaagggattgctgggctgactctccaccctactgtcgcactcacccagtgtcacagccggtggatcctttgtgtccttaaaccttgtgtccttttgaaaggtagatctctgagcgcattctcctctgatagagaatggtttcatcaaagttacaaatctaatccaactgatttttgtttttaagtacagaggaagatgaattcagtaaggttgcaggatacgttatcaatatacaaaaatcagtagcatgtccatacacaaataacaacctagctgaaaaagaaatcaagacaacaatcccatttatgatcacatc

SEQ ID NO: 226363 - DNA, 179 bp, Homo sapiens
gctgaggatgagttttgtggaaacatgggggaacctgcggctgtgagggtatcagctcttgccccagccttccttccttccctccttccctccttccctccctctctccctttcttcttctctctctctctctcctcacctccttccgtcactccctctgtgtccctttttttccttct

SEQ ID NO: 226364 - DNA, 496 bp, Homo sapiens
taaaggtggccactagagaatcccaaaggcaaagcattccctgcctcccactatttaggcccttgtgtatttctttctcacatgttatcagagttagtctatacgaccagtagagtacagcagattgatggtatatcaatcctgagtctagattttgacagacaaggcttctgtcctgctctttcttggatcacatgtccactactatgtcatgagaacactcaggtatccccatggagaagcccatgtggagagaaactgaagcttcctgccaacagccattaggaacccaaggcctccagtcagaaattaggcgacattgtggatgtggatccttcagcctcagtcaagatttcatatgactgtaggactggttgacagcttgactgtaacctcatgaaaaaccctgagccagaatcacccagctgtgcagctcttggattgctgaccctcaggaatagatgtctgagataataaatatttgttgttctaaaat

SEQ ID NO: 226365 - DNA, 361 bp, Homo sapiens
aagttatttcatttgctctttattctttatccaaaagaaagtagttctaaagtttaattcagtactgttgaatatatattaccaaagtaattcagtggttccttttccatttcagatagattagtgatatttctgttcacgcttagacatttttatattgatgaccgtaatcctttaacttattttgagccacagattaaaataacttcttaaggttatttgaataaataaatgttatttataatttacataaatttttatgtaaagcatattgccacatgggcaaaaaatgtactttcatataaatcaataagcttcagaaactttggcacatttaattaataaaaatattaaaatggaa

SEQ ID NO: 226366 - DNA, 324 bp, Homo sapiens
gcccaagatgtaggacatcgatgtcaaaggagattgttctggagctttaagatgtaatataatcccagcagttagaaaggccaaggcaatagggtcacatgcgcccaggagttcaagaccttcctgggcaacatagggagaccctgtctctgtgaaaagtaaaacaaattagcctggcatggtggcacacacctgtgatcctagctacttaagatgctgaggtaggagggtcagtagggtccaggagattgaggctgcagtgagccatgatcgtgccactgcactccagtctgggtgacagagcaagactctgtctcaaaaaaa

SEQ ID NO: 226367 - DNA, 402 bp, Homo sapiens
gggctccatccagacttttaagaatcctcatggctctaaaataattgaaatagtgacttctctgttttttatttcatattttatatttcgtagagacagggtctcactctgtcaccaggctggagcgtagtggtgtgatcatagctcactgcagccttgaactcctggcctcaagtgttcctcttgcctcagcctcacaagtagctgggaccacaggcatgcacaagcacgtccagctatttatttatttttaaaatttttggtagagacagggtcttgctgtgttgctcaggctggtctcaaactcctgggctcaagcagtcctcctgccttggcctctcaaagtgctgggattacagatgtgagccactgcgcctggctgaccacttttcttttaattta

SEQ ID NO: 226368 - DNA, 1100 bp, Homo sapiens
taactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccagtaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgggatggccttgtcctcaacgtgcagtgcactgttgatgcgctggaatgccgtctctttttccaggtgcaggtcttcagccgtgacccggtaccccagctctaagggaggtggcagcatcaaaggctcccctcgcctgcgtggcagcaggggaatcttgcgtctacggggcctagagtcctgggatctgggggagccacccgttggggcgattgtctgccctggtgctgtatctgcccccttttcacaccgtgtgtgacccaaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtgtggttatatctgatttctg

SEQ ID NO: 226369 - DNA, 1082 bp, Homo sapiens
aatataatcttattacctccataaagtacgtagtgttgaagtaagggttttagaatatacatcacctgaaaaatgtacattgtactcattacataatttctcatcatcccctcctcccaccctcctgaaatttccaagtctctgttgtctatcattccacattgacaatgggtaaatagaatttttcagattattaaaagctgaaggatgcccacgtaagcaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccagtaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgggatggccttgtcctcaacgtgcagtgcactgttgatgcgctggaatgccgtctctttttccaggtgcaggtcttcagccgtgacccggtaccccagctctaagggaggtggcagcatcaaaggctcccctcgcctgcgtggcagcaggggaatcttgcgtctacggggcctagagtcctgggatctgggggagccacccgttggggcgattgtctgccctggtgctgtatctgcccccttttcacaccgtgtgtgacccaaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtgtggttatatctgatttctg

SEQ ID NO: 226370 - DNA, 405 bp, Homo sapiens
tcccgggctcagttgatgcatctcagcgtcccaagtagctgggactacaggcgcatgccaccacacccaactaacttttgtagagacagggttttgccatgttgcccaggctggtgtcaaactccttggcctaatcggttcttccacctcagtcctccaaagtgctgggattacaggagtgagccaccgcaccggtctggttccacattttaaaggatttttagactgtgtttggatcgagtaatcagtttcagattaggagagtgttaagaaagatagttaagttacagtttgtattgtgcacagtttcttggaaatttagtgccagttatttccctagagagattaaaatggagagaaaagataattcagtctgaacaccagtgttgcaaagaacaaagttga

SEQ ID NO: 226371 - DNA, 189 bp, Homo sapiens
gcagtactgcgcggtactctaaggatccctaagaggtggtgtctcccctaaaccttttttcctcctggtgtaactttgtattgtgcacagtttcttggaaatttagtgccagttatttccctagagagattaaaatggagagaaaagataattcagtctgaacaccagtgttgcaaagaacaaagttga

SEQ ID NO: 226372 - DNA, 674 bp, Homo sapiens
gataccaaagaccccagtgcctcagcaccccatgcagagtcctcagcaaagttaaattgtgtttcagctgctctacttaaggggggtagaacactaggaccaccaccaacagtaaaaagtgctggttagccaggatgttcttacagtaatccatcccctgccagcatccagtacacgaggcttctctgtcccggctagaaccattgcctcactgctttatagatgctgagtcttttttttgccatggtcttactgtgtcacccaggctggagtgcagtggcccaatcccagctcactgaagcctcaacctcctgagttcaagcagttctcccgcctcagcctcctgagtagctgggactacaggcacgcaccaccacgcctgactaatgtttttattattttttgtagagacaagcactcactaagttacccaggctgattttgaactcctgagcttaatcagttctcgcctgccttggcctcccaaagtgctatgattacagacatgagccaccacgcttggccctgctgagtcaatctacaggtgtcatcctatgctgtagacagatgcccttatttttttcaaggcaaaaaccctagccatttttctcttccccttcagagtctgaaacatcctctcaacccatccctgttactactgcttggtgctcttg

SEQ ID NO: 226373 - DNA, 439 bp, Homo sapiens
cgggcagatcgcttgagctcaggagttcgagatcagcctggccaacatgttgaaatcccatgtctactaaaaatacaaaaattagccaggcatggtgtcatgcacttctcgtcccagctactcaggaggctgagataggaggatcacttgagcccaggaggtcaagactgcagtgagctatgattgcaccactgcattccagcttggatgatgggagtgagaccgtatctcaaaaaaaaaaaaaaaatctgccttttagcagtctcctcttaaaatggtttttcaataaacagcattaaataaaacttaaacataaagcttttatttagtttttgatgaagtcatagagttcaaacttaaataagtttgtacttatttaagtacatgtttcccttctaatttaaagtaatagagaactcgtttggagattcttttagtt

SEQ ID NO: 226374 - DNA, 403 bp, Homo sapiens
ttttaattgtgtaaataaatgagttcaagttttgtagatgcagttaagaaagtggttataagaaataaagtatataattttaaaacacctcctatttctaatataatattctactgcctatgaattagtactgctgtgtttatgtccactttatttccttactgcctatcaactttgctcaacagtggttgtttcttaatgattattccgtgtgtgagatatctagcttcaactccaccccctacccctgttgctgtgtgagcaggcaaatgatagtagctgtgttagcattaatttaataaaatgtaaacttacttaaacaactggtattcacattatggcgcttcagaatatgtttcaatggaaatgtagagagaagtatatttttatttctaataagtca

SEQ ID NO: 226375 - DNA, 185 bp, Homo sapiens
agccgcccccgtaactgggaagagcttgagaggcaggaaatggcacatatcagtcccatgatgaggaccccaggacttcccaaactttccagagtcttttgtcaccccaccatcatgcagagtttttcttttacagtctcacctctctctagggtagtactccaatgtcccccacagtgattctt

SEQ ID NO: 226376 - DNA, 423 bp, Homo sapiens
tgggcgacagaacgagactccgtctcaaaaaaaacaaaaagaaagaaagaaagaaaatgtacttctaggaattggtgcttaagagataattagaaattctaccaaagatgtataggcaaggatactcatcactgtgttgttcatgatgtaaaaaaaaagaaaagaaacaaactaaatatttgaggggaaaaagccataagtaaataaagtatggtatgtctatcacatggattttttaaatgactactcaatgatatggagaaagtgctcacaatataaagttaaatcaaagattctcaaccagagattattttccccatcaaggagcatttggcaaaaatgtctgggccaggcgtggtggctcatgcctgtaatcccagcactttggtaggccaagacgggtggatcacctgaggtcaggag

SEQ ID NO: 226377 - DNA, 474 bp, Homo sapiens
tcccagatcttggccttgtaattcttcactgctttgtttcctgcccaatactctcaattagacttaaatatatatatatacgtacatatatttattaaatatatatatatataactttaaaagctgttcaaaatgtcctcccccgccccacacacacacgcaaattttgagcagctttttaagttgtcctgaactgggaatttggtccaaattacccagtccacagttattagaagtagtcctaaaaaactgactttgacgttcccattatatattgggaaaaggctgccactctttgaatttagtgttcagaaactgtggcccagctaattgaacattgtcttttgaaaggagttttgtttagagagcagcacggtaatactggttacccggggatggggtggcactcggcagttggcagagagaaagaaatagccacagagaaaaataaattaccgatttctctggctttta

SEQ ID NO: 226378 - DNA, 417 bp, Homo sapiens
atggccagagaaagatgcaggtgctttagacgagggaacaccaaaaaaggtgtggagatgccaaagggcagaactcagaggttgactggacttcactaagcatatggagggctaaggctgtgtctcagtagctccagggcctaggcttttcctgtctcagagttggtcaacattaaatgctttttcttgagtgaacgaaaggaagacttggctatcatatccaggcttcccaagaacgtaggaaacagaagagagaaatgagaggaataagtgagggtccgtgtttgttggttagcagacctctgtttcattactttcaccaactgcactgctatgtatttttagtctatgtaatgtcagttttcttatcaataaaatggcagtcatatcctgttgtgaaggcatgttctaaagagt

SEQ ID NO: 226379 - DNA, 617 bp, Homo sapiens
ctgtcttatttcctgtttctctactaggggcacagcagcctgcagcctaggatatgtcttccttaaatccatgaaggaagacatgtgcttttcaccacaacctccattgttcttgatagtgcctttaggtttgagcttcttcacagactattgtaaatgaaattaattcctttgggaagagattgggagaatctgttttctgacttgcctctccctcttcttttccccttagcaaaataatcagaaccaggtctctggagctaggggtgaagactactgcaggcttctctctgggtgataccacaactctaggagctgagtgctagattggggatagagtagccagaggtcctcttggcttgcctttcccactatggaaccacttcctcatgagccagggcaagacagtcagggttccagtattctcagtgttctgtgcccaaggtagaccctccattccatgagtgggggctgggtcaatgaaggaatccccctcctcttgactgaacttgcctggaagtaacaggtgactggaggctagatgagaaatgttcctatcctcctcttcccagggagaaagcccaccaaatgagagctgtgggatgagggagccctgt

SEQ ID NO: 226380 - DNA, 320 bp, Homo sapiens
gattttaaaaaattaagagattataacagtagaagacattctaaaaatgcatatttccagagtactatattaagctaacagttgaagacaaagtgcaaatcacttataaaagtgacctttatgcgtatacataattttatattatttgactcaaagcaaagttattcataaattatattatcagaaaacagcccgggcaggggggctgacacctttaatcatagtgctttgggagaccaaggcaggcggatcacttaaggtcaggagttccagaccagcctggccaacatggtgaaacccctatctctcctcagaataca

SEQ ID NO: 226381 - DNA, 846 bp, Homo sapiens
gtttcctatgagtatgaatcagcaacatgcagtaacaagcaagtaataatagttctgcgtgtgagtgcctacagagggtaagaaaaatagcatcagattgaaaaagcaagtgcacctgcagaagggacccaggaggctgcagagcacagctcccttgagcatcatctcaaagtgtctcagagcacagtgaccctaattctggcaagtcaggttggcatgagatggatggagcacactgaaatctccagatggtcagacagcccaccctcagctgcccctggagctcggcaaaggcaagctacaaggcactgctacttggccaagagtttaaaacaacagcttctgattctacagtgtctgtggtttcacaaccacttaaccttaagtaaggaacagctagagttagctgaatgaataaatacacgttaacgttacataaagagggaaaaaaagcaatacttgagcacatagacttcaaatagtgtccagctagctgtgtccttggcatcccagtgatctgggtctttatctttgattttctccagcaggtaggcactgagtagatccagggcccagggcgggaaatgcttctgtatcagatgttacctatcaaataaaatgagcctttgaattggccaaaaaaaaaaaaaaaaaaactgcaccacaaaaaaaaactgcgcgggggcctacaatttggcgggggggggaaaaacaggggttttgaaatggggcccagtggcgccaagcgtgttttctcgtaaccccctttttcgttgtcccaagggggaaaattgccggggcccctaaggggaaggcgtaaaaattcaaaagacgggttaccctctt

SEQ ID NO: 226382 - DNA, 495 bp, Homo sapiens
ttagggggtcgccagaagagtattgattggacaaggagagagagccctcttgaagaggaatggtgctaaagtcaacctgaagccttctgaaaattcagcggccctagaactgccccaaatgctatttactgcaaagcagaattctgtatccagaggggttgtcctggactccactcaagaggtttagcttttaaagagcctaaaggattcctggcttatctgttgggtgagtgtgagagtcagatcccaaaggattatatgatatgatggatgatttagcacgctgcttcacaggaatttaacagaaatataagattgctcagctggagcagaattgtctaagagacaaacctttttaaaaccccactaatgtataacctcaagccacaactggattcaattactgcgtggaaagaaaggcattttcttataaagccactctgtttccgtgcctggctgtgagctgggtcagccatgacaaagataagcttgtgt

SEQ ID NO: 226383 - DNA, 856 bp, Homo sapiens
tttaattaactttggaagatgtcttcgattttaattgtgtcttatgctagagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacaggtaaggagatggatgctaagggtgcattagaagacaacgctcagttcttcacagactcttgagatcagccagtaagtgtttattaagcacctattgtgtgttgagtgttgtgcaaagtgctggttatacaacgatgacttaagcctggggtcctgttctcaagaagctcatgctcaggtggggagatggaaaaacagaggatcatagaaaatgtgtggtaagggccatatccagatatacacaggttattatgagaacactccagaggggcacccaagttggcctggggcaggggcaggatcggaactgcttccctagaactgatgcctgcagaaaatgctttaaaggatcaataggaagtaatgcgttaaaggaggatattccacttgaaaaagacatgagcagaggcatcaaggcaagaaacagtatggagtgtgcaggacactggaagaagtttggtattatttcttagacttaaacaaaggaaagacaagataagaaaggctaacatagagaggccgtgtttgcaaggtaagaagcttgggctgcgtgtgggtgctgggaacccccaaaaggttttaagcagtggtatttaactggaaatgcattctcacgatgaaatcttttcacagggtattgaagctcatccaaggctgcac

SEQ ID NO: 226384 - DNA, 3524 bp, Homo sapiens
atgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggttcaattagcagaatttctagaaaatttacaagaaaagtccttgaggattgaagcctttgttagtgagatagaatccttttttaataccattgaggaaaactgtagtaaaaatgagaaaaggctagaagaacagaatgaggaaatgatgaagaaggttttagcacagtatgatgagaaagcccagagctttgaggaagtgaagaagaagaagatggagttcctgcatgagcagatggtccactttctgcagagcatggacactgccaaagacaccctggagaccatcgtgagagaagcagaggagcttgatgaggccgtcttcctgacttcgtttgaggaaatcaatgaaaggttgctttctgcaatggagagcactgcttctttagagaaaatgcctgctgcgttttcccttttcgaacattatgatgacagctcggcaagaagtgaccagatgttaaaacaagtggctgttccacagcctcctagattagaacctcaggaaccaaattctgccaccagcacaacaattgcagtttactggagcatgaacaaggaagatgtcattgattcatttcaggtttactgcatggaggagccacaagatgatcaagaagtaaatgagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaaagtgctatatattagaaatttccattttgttaaataaatggttagagtctataaagccagtcgtgttatgtgaacttactccatgtaacttactggc

SEQ ID NO: 226385 - DNA, 1531 bp, Homo sapiens
aaagtctagtgggatttataggaagctactattaggggctgtttggggatgggtgagaactgggcaatgtggaaggcagagaagggagagagacatcaccatctatatttgatcccttttgggtttttaacacagaatacactttctgatgaaaaattgaaaacagaatcatgccgaagccgtggaagatcacgtgcttctcaggtcccaggaaagcaagctggcattgctccacgactgtcctgactctctttctgcagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctg

SEQ ID NO: 226386 - DNA, 3480 bp, Homo sapiens
atgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggttcaattagcagaatttctagaaaatttacaagaaaagtccttgaggattgaagcctttgttagtgagatagaatccttttttaataccattgaggaaaactgtagtaaaaatgagaaaaggctagaagaacagaatgaggaaatgatgaagaaggttttagcacagtatgatgagaaagcccagagctttgaggaagtgaagaagaagaagatggagttcctgcatgagcagatggtccactttctgcagagcatggacactgccaaagacaccctggagaccatcgtgagagaagcagaggagcttgatgaggccgtcttcctgacttcgtttgaggaaatcaatgaaaggttgctttctgcaatggagagcactgcttctttagagaaaatgcctgctgcgttttcccttttcgaacattatgatgacagctcggcaagaagtgaccagatgttaaaacaagtggctgttccacagcctcctagattagaacctcaggaaccaaattctgccaccagcacaacaattgcagtttactggagcatgaacaaggaagatgtcattgattcatttcaggtttactgcatggaggagccacaagatgatcaagaagtaaatgagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaaagtgctatatattagaaatttccattttgttaaataaatggttagagtctata

SEQ ID NO: 226387 - DNA, 1610 bp, Homo sapiens
cagctcggtacctgcattacgtccatggcggagcacaagatgatcaagaagtaatgagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaaagtgctatatattagaaatttccattttgttaaataaatggttagagtctata

SEQ ID NO: 226388 - DNA, 1667 bp, Homo sapiens
aaagtctagtgggatttataggaagctactattaggggctgtttggggatgggtgagaactgggcaatgtggaaggcagagaagggagagagacatcaccatctatatttgatcccttttgggtttttaacacagaatacactttctgatgaaaaattgaaaacagaatcatgccgaagccgtggaagatcacgtgcttctcaggtcccaggaaagcaagctggcattgctccacgactgtcctgactctctttctgcagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaaagtgctatatattagaaatttccattttgttaaataaatggttagagtctata

SEQ ID NO: 226389 - DNA, 2732 bp, Homo sapiens
atgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggttcaattagcagaatttctagaaaatttacaagaaaagtccttgaggattgaagcctttgttagtgagatagaatccttttttaataccattgaggaaaactgtagtaaaaatgagaaaaggctagaagaacagaatgaggaaatgatgaagaaggttttagcacagtatgatgagaaagcccagagctttgaggaagtgaagaagaagaagatggagttcctgcatgagcagatggtccactttctgcagagcatggacactgccaaagacaccctggagaccatcgtgagagaagcagaggagcttgatgaggccgtcttcctgacttcgtttgaggaaatcaatgaaaggttgctttctgcaatggagagcactgcttctttagagaaaatgcctgctgcgttttcccttttcgaacattatgatgacagctcggcaagaagtgaccagatgttaaaacaagtggctgttccacagcctcctagattagaacctcaggaaccaaattctgccaccagcacaacaattgcagtttactggagcatgaacaaggaagatgtcattgattcatttcaggtttactgcatggaggagccacaagatgatcaagaagtaaatgagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacaggtaaggagatggatgctaagggtgcattagaagacaacgctcagttcttcacagactcttgagatcagccagtaagtgtttattaagcacctattgtgtgttgagtgttgtgcaaagtgctggttatacaacgatgacttaagcctggggtcctgttctcaagaagctcatgctcaggtggggagatggaaaaacagaggatcatagaaaatgtgtggtaagggccatatccagatatacacaggttattatgagaacactccagaggggcacccaagttggcctggggcaggggcaggatcggaactgcttccctagaactgatgcctgcagaaaatgctttaaaggatcaataggaagtaatgcgttaaaggaggatattccacttgaaaaagacatgagcagaggcatcaaggcaagaaacagtatggagtgtgcaggacactggaagaagtttggtattatttcttagacttaaacaaaggaaagacaagataagaaaggctaacatagagaggccgtgtttgcaaggtaagaagcttgggctgcgtgtgggtgctgggaacccccaaaaggttttaagcagtggtatttaactggaaatgcattctcacgatgaaatcttttcacagggtattgaagctcatccaaggctgcac

SEQ ID NO: 226390 - DNA, 414 bp, Homo sapiens
gatggagttcctgcatgagcagatggtccactttctgcagagcatggacactgccaaagacaccctggagaccatcgtgagagaagcagaggagcttgatgaggccgtcttcctgacttcgtttgaggaaagtaaaatgggctcaaacaccttgcgcccactctggcacatctacttttaaagcttcatttttcactattccttaagattatttatatctctgtgtgggatttatataattctggcatttaaacattatttgggcatgcctgatgcctatagaaaaggcccagcaaaccctgaaagcctcaatgcccagatccagctgaaagatacagctgaaagagacagcctgcagcatcatcatccattgcgtcccactggattcattggtcactgtctaagagggaggga

SEQ ID NO: 226391 - DNA, 998 bp, Homo sapiens
tttttttatgtttctcaaatccccctttattttttattttttgagacggagtcttgctctgacgcccaggctggagtacagtggtgtgatctcggctcactgcaacttctgtctcccaggttcaagtgattctcctgcctcaggctcccaagtagctgggattacaggtgtgcaccgccacgcccagctaatttttgtatttttagtagagacggggtttcgccatgttggccaggctggtcttgaactcctgacctcaggcgatccacctgccttggcctcccaaagtgctgggattacaggagtgagccaccatgcctggcctgaaatccccctttgaaaatagaaatacatgtcttctgaaagtttttttaaattatttttttccagaattatatttttgggattttgatcttttgggattgtaattttcaggattttagactttagggcttttgatctttcaggctcagaaggaaagaaaacatctcccaggaccagatgtggagtagatgggagttggagagaagctgaagcccaggcccagcaacaggctgggggcccaggtgcttcgggggtcccagccattaacagagcttcgtgcaggtgggcagctggagccaggggggctcactctcttgtgaaacaggcagaaaaacaggccaaactctgctgggggctgcagcctttagggagcagctggtctcctgaggcaaaaggacacatactttgttgaggccaggaactggaccagcctgtcgggggcttggtaactccatccagaacatcctcagggtctccacaaggcagacacagcacagtaccacaggagatggctgggacaaagaaccaggagctggaggggtgaggcggtaggggggcagcaatcctgaaacaatgagaacatagagaagagaaagaaaagtcataccagctcggaagagcttgcaaaccgatgttccaaaacacgcccagaattctaatgttcacaaagttat

SEQ ID NO: 226392 - DNA, 554 bp, Homo sapiens
ccaacaaaaagctaacaataaaatggatccctagagcctgtaaagaagctctaagctgttcccaccggtggcctgggagagagagatctagtaagaggagtcccaaagtaacacgagatatctagaaggtggaaagtaggcaaaagcagtttctcaaactttagaacacaatctcttttaaaagaaaaccaaagacacttcacaagtgcggacattatttttattataatgttctaaaatatatccaaatccactttaggttcagtttaagctcctgaagcttttaattttctaaaacaataaaaactaccaatacagtttaaattaatattgtttttaacaagatgaatggtggtgttttgatgaaactaaattctttcttatggactgctacaatgcaaattcttttgagttaacagtctattattttgtgttgtgggttgattcagttctctccttttccatattcaagcccctagaaagttttcctatagcttgctgatgaggtccattgaccttcccttggtttaataaatacttcacttacatacaaa

SEQ ID NO: 226393 - DNA, 430 bp, Homo sapiens
cagtattcaatacatgaatataaggaaaatctggtaattttttccatttctttaagaattcattttatccttgctcttcaatttgtgctggaaatgtagatagcatcagattaaacagttgttactggctcaacttagctccataaatttatttttagtgaagtcagcaatttttttagggcaaggatgtaattatttgtttagattcggagtcatgtttctgaaggacccactgttcatggactccctagaagatatccttggatcttttggcctgggtgctaagaatctcagtttgaaaaaaaaagcattaaagaaactaaagtataatcaaacaaatttcatttaaactttgaattattactgcacagtatgttttcttattatattattattaaaattaaaagtttttaaaaatgtaatttttgta

SEQ ID NO: 226394 - DNA, 428 bp, Homo sapiens
tgggtgatgccacgttactttatatatcaataagataatgtttaaaatgttgccagttataaatgtaataaataatgaattgtaaacagtattccaatgttaggagatgttaatatataagagaatagtagcttatataagagaatagtgagaaaatgagcatctgagaatgactgaaatacaacgatacatctaatctttaatagatacctcaatgtagatatgattgtatcattttacttaattaaaatgtctttgtaaaaattagccgggcgcggtagcgggcgcctgtagtcccagctactcgggaggctgaggcaggagaatgtcgtgaacccgggaagcggagcttgcagtgagccgagattgcgccactgcagtccgcagtccggcctgggcgacagagcgagactccgtctcaaaaaaaa

SEQ ID NO: 226395 - DNA, 338 bp, Homo sapiens
accggttttgtgaggggctggcgcagacggctgtggacaaggagcttgtaaaatgggaagcggcgaacagtcccaccacctcaccctgagacactctccaccgaggaagcagccttcagtttggcttttagtgcgctgtaggatagggactgtcgtgtccctcctgtagtcctagagcgtttctgttgaaccctaatttttaggtctcaaagagtgggcttcagagataaagaggtttaggcagggacagggcgaggagcgtggggtgtactttcactttccgataagtgaggtaatccaggaaagtgagttaatttggccaaataaagcttgttttt

SEQ ID NO: 226396 - DNA, 468 bp, Homo sapiens
taatataatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaa

SEQ ID NO: 226397 - DNA, 632 bp, Homo sapiens
aaactattttaaatatggcctgactttgggaatgaaggctttacttggacatggatatgactgtaggcattttcctttatattcctttataacttactgttatgcatctactagcagctgttaaggtcactccaaaactgacattctctccccatgtttgcttccactaaaacccatctggtgatggaactgtgcataccttcatcaagtattttgaaaacaaaacaaaacaaaataagcaaaaacaaagtaaacaaaagacagatatctgaatcagacagaattagttttggatcccagtctgtcaccagttacttgtttaaaatggagcaggttacttaacaactctgagaaatatttacttaaaacactcaagtataatatgtattttgcagacattttgtgataagtaaatgaggtatgtgtgcatgtgtgggcttgtgtataaaataaactctcttgattggcctatataactgtctttttcattcaggatgaatggtgggtaacttttttactcactcaagctacatcgtattctattcagattaatctaatttcttatctgaaatagttaaaatatgtgatatactttgacaaatatcaaggtaataaacatttgaaaaaggaca

SEQ ID NO: 226398 - DNA, 341 bp, Homo sapiens
cagccaacgttggaaggggtgctgtgttactgaggcgcagcacacaaaagcaggagacactcagcagacattggaaggggcgctgtgttactgaggcacagcacacaaaagcaggagacactcagcagacattggaaagggcgctctgttacttaggtgcagcatggtaccatgggaagggcagacaccagggtgaatcctggctctgtgatttaggcagcttatttcatcaccctgagcctcggttttttcgtctgtaaatgagtatgagaatacctccctcacaggattatatgtgacatgattagaaaatgcctagccaaaaaaagaataaaaaattt

SEQ ID NO: 226399 - DNA, 793 bp, Homo sapiens
tgcagtggctcacgcctgtaatcccagtactttgggaggccaaagctggtggattacttaaggtcaggagttcgagaccaacctggccaacatgatgaaaccctgtctctactaaaaatacaaaaattagttgggcacgatggcagctgcctgtaatctcagctactcaggaggctgaagcacttgaaactgagagatggagtttgccgtaagccgagattgcaccactgcagtccagcctgggtgacagggcaagactccataattaatacatacatacatacatacatacatacatacatacatacatacatcaagggggtgatgtctctgtttgtgaatggtaccagcatgtgtacaagtctctctgccctataccctgggcctcagcctgggatgaccatgggcagaaggcacatttcttgggaagatctgaactggctccaccccacctctgtccttctcccaggatggtaaagaagaacctgggtatatggtgatccctaccctgggaccctgaatcatgtcttaataataaaaattcactggaaaagtgagagaggcggggaagaaaactgcagcagcagggagtaaaagaacctcacttagatcattgtgacaggcctgggaggttgttgcccaatatcctctctcactccttcttcccagtaaaagaatacataagttttagctaaatacatatcagaaggaagactatgttttccagcctcccttgcagctaagtggggtcatgtgactagttcaagccaaaggacatgaataaaagtattag

SEQ ID NO: 226400 - DNA, 247 bp, Homo sapiens
gacttggtcaagtttgatattgtgggctacggtggctttgggatgcccctgcccaaattggggcaagaggaagccctttaccaggcactgaagaatgcgtaccctcacctccacatctacaagaaggaggggtttccaaaacacttccatctcgctaaacatgaccgggttctgccaatcgtgatgtatgccaactttggttacagtatcaatggggtaagttcattctaaaatgaataaagtcacc

SEQ ID NO: 226401 - DNA, 436 bp, Homo sapiens
aaatcaaaatcaaccatatcttgggccataaaacaaacttcgacaagttttaatgaattggagtcatacagagtgtgtttcttgaccacaacagaatcaaattaaatattaaaacaaaatacaacaggaaaatctccaaacactaagaaataagtacagcataatttgtaataattcgtgggttagagaagaagtctcaagggaatttacaaatacattcaactaaatgaaaatgaaattatagcatatcaaaatttgtgggagtagctaaagagcacagagagggaaatttatacaagagcaaactaaactcaaaccaagctgaaataaggaactaataagaataaaagtagataatgattacagtgaaaacagaaaaaatcaagatggataatgctgatgaaataaaaatcttggctttatggagattaataaa

SEQ ID NO: 226402 - DNA, 216 bp, Homo sapiens
ttcttccttcctatttcaggccaaattcaagcctatctactttaaatctgggcacaactacagtcatcctaactggtgtggctataggttattctcccccagttgatcttatgcagcaccctaaaccaactgctatcatttaccattccctactttaaaacttccaaatcctttttatttcttttacaatcaaatccaaaactcaatgtcttctgc

SEQ ID NO: 226403 - DNA, 379 bp, Homo sapiens
ggaacatcacacaccagggcctgtcatggggtgggggtagaggggagggatagcattaggacatatacctaatgtaaatgatgagttaatgggtgcagcacaccaacatggcacatgtatacatatgtaacaaacctgcacgttgtgcacatgtaccttagaacttaaagtataatttaaaaaatcataactgcttaaaactcactgtagtacacactgtcctgctggaatattgcagctgcctcccgttgctttcgtggtgggctcaagtgtcgtgactatccaccgaaaacgttgtgtgacgctcatcaggcatctctacttgcacagttcgtctctccagtaaattgcactgaagtaaaaagtaatttccctcaaa

SEQ ID NO: 226404 - DNA, 611 bp, Homo sapiens
cattattgaataccaggggtaccacacatgagctgatgaggccaggctcctcccctgcgtaaggtgcgaatcctagtgactccgccccgttcccccagcacgcacacgaggatgcccaggtaaaccataggtagtatcggaaaaggcaacatttgattggttaaaaggcattattcggaaagaatcaattgggaaagggcagacaaacgggcagacgttctgcccctgggtcgctggtttcatctgggaccagcaatctggtctttcagacttcaggctgttctgggcttgaaggtgaggtctcaccggggacccttccctatctgcctaggcatttgtctgcctcctgcttgtatcatcattttcttaattgcctgcagtgactttatcaagccccctcctgagctgcgtaataataatactgtgttaggattttcagtgttattactcatcatcagcccggacagcccagaattccaggccttcttcctgttaaacgaacggagagcagagcctttgagctccacagttcactatctctgtgtcagccttaaccatcccattggcctgttggggctgaagataaatccccaggcattaagcatattcca

SEQ ID NO: 226405 - DNA, 513 bp, Homo sapiens
ggagaggagaggattggcattattcaagttacatttttaaaagaatcattctggctgttctgcatggagaataactacaagaagagaaaggtggaagcagggtgactggttaggggctattttagacataaaggtaaattcctggacaagggttttagtggtgaaggtaatgtttggattctgaagattttttgaagccagagctaacaaatggataatgtaaggcttattttttacagaattttaaattatgcctttttaaaaaagagtcaggcaatgatataaaatagataatttaatttggaaaatgattttataaaacgtatttgctcattccgtgtcatggtgccttattttttaatggttaatgggctctttgaaagtgaagaatttgggttgcatgaaataggggaagcatgttttgaatttgtgttattctagccaattttgatcagttaattttattattatctggtatcaattggcaatatggagtaaatgctccctaattct

SEQ ID NO: 226406 - DNA, 545 bp, Homo sapiens
tgatcaattctccatgttgctaattgttagaaatcaggagtagagggcttgtcttcattctggagtcctgtttagagttttgaggaatcactttagcataaaggatggtactgtattgtcaggaatttgtatttccagcattctctttagaaccaatgtgccagtttttgccatcttagtcacatgtacaggtagcaaggtaaacatggattatggtctatatgtttgtacggctgctttgtgggggatcagtttttgataactagaaggatgacatgacgtatgatgtactcagtccttaaaggagcatttagtttaattttctttagacctatccaccaaactataagatccatggggacaagtttgtcaatttagctcatcatcatgcgatgcctggcccagcaaaaatgccatatacacatctattgaatgaaatggaagtaagtgggagtagtgttaagatatttgaaactgaaattttccatataaaccagtagctttctgttcaaaatgtaaaaataaaaatgtctatccatacaata

SEQ ID NO: 226407 - DNA, 615 bp, Homo sapiens
ggcgtgtcggctgtagggtgccccgagagcctgcaggaccttcggaaccatctggcgtctgactctcctcagcgctggcgcggccccgaatgaaaacttggaaggcgtagccgcttggtcccgcggtgggcggggcccctgcctgacgtggacctctcgggatgggcctggccaatcctgttttcttcccaagattgttagggataattcagtcattcgtttcgcaacccatcttttggcccccgttaggtgtaagtcatacctgtgatacctttgtgactagtttaaaagttcttcgaagcatgtaagaagatctagtatatttgtgatttaagtaaaattgcagatgaggccaggcgcggtggctcacgcctgtaatcccagcactttgggaggccaaggcgggcggatcatctgaggtcaggagttcgagaccagcctgaccaacatggtgaaaacccgtctatactaaaaatacaaaaattagcccggcgcggtggtgggcgcctgtaatcccagctaccagggagactgaaacaggagactcgcttgaacccgggagacggaggttgcgctgagccgagatcagccactgcgctccagactggggatcga

SEQ ID NO: 226408 - DNA, 308 bp, Homo sapiens
ggcgtgtcggctgtagggtgccccgagagcctgcaggaccttcggaaccatctggcgtctgactctcctcagcgctggcgcggccccgaatgaaaacttggaaggcgtagccgcttggtcccgcggtgggcggggcccctgcctgacgtggacctctcgggatgggcctggccaatcctgttttcttcccaagattgttagggataattcagtcattcgtttcgcaacccatcttttggcccccgttaggtgtaagtcatacctgtgatacctttgtgactagtttaaataaaaaaatttacaattaa

SEQ ID NO: 226409 - DNA, 398 bp, Homo sapiens
aatctgtccctcccgaggctgtgtcccaggctggagaggctaagtgggtgacaaccaacttggcctcctacaagaacccacagggaggtcgggtgcaatggcttgcatctgtaatcctaccactttgggaggctgaggcgggcagctcacgtgaggccaggagttcgagaccagcctggccaacatggcaaaaccccgtctgtatttttaaaaaatacacaaactgttgtattttctatttgtattgtattgtagtggacagggcctgttatcccagctactccggaggctgaggtgggaggatcacttgaacccgggaggtggaggttgcagtgcggccgagatcacaccactgcactccagcctgggcgacagagcaagacatcatctaaagaaaa

SEQ ID NO: 226410 - DNA, 466 bp, Homo sapiens
catactaatgcccttcctgtggcagttccccagtttctcttctttgcaagcaaagtcatctcgtttttcttcaggttgtgtaccacgtgtatgggtacgtgaacaacacgtttttgttcacttgtttttaacatcatgtaattggaatcacgctgtttgtattcgtttgtgacttgccttctctctaaaaagagtatttttgaggttcatgcatgcagataacatagctgcagtaactgtggtccatttatttgcactggtatataacttactgttatgaaattattctgtaactttttcatttgttttattattgatggacgtttgggttgttttcagttttttgctttcaacaatttttcttccaagttttcttgctaagaatgtgggtatacatgtcttctggtatagctgtgcaagcatttcatttggtctcatacctaagtaaaactgcagtgtcaaatta

SEQ ID NO: 226411 - DNA, 330 bp, Homo sapiens
atcatattaatgtccgctctcactatccctttaagcatcttgaagacttcagccatatttgctcttaaccacctttttccccgtgagtacagccctagttttccttagctctaaataaatctgattgccctttattggtgtttttcattcttcggatattttattctggcctctttgtattcaaatagtttgtgtgcctaatctgttccttgactaatacttttcgtgccttttgtgctttatgatgaactttgtattttcaatgcactgtttagagaatttgtggggattctgcaactcctttatatcttaaaaaaaaaagactgtaac

SEQ ID NO: 226412 - DNA, 207 bp, Homo sapiens
acaataatttttcatggttctgtggtatgactgggctcagctaggtggctttcacttggggtcttacggttgcagtcagatgttggctgcagtcgtctcaaagcataaccgagctggatgttcttgatggctcacatgactgacagtgatgctcactattgtctgggagctcagctggggctgtcaaaataggacatcttcacatgg

SEQ ID NO: 226413 - DNA, 531 bp, Homo sapiens
tcatcattcctaatccaaaaatctgaaatcctccaaggagcattttctttgaaaagttttagattttggagcattttggatttaggattcttgggttagggatactcaacctgtaatttttggggggtaaaataacagttattaatgtacaggagcaagtgtttttattaatgaggtctttaagtgaatctgacgtctgagcagataattatgaaataaaccatgctagttcttattttatattgtaattattataaatactgacatcaaggagtatatttagagtacggtggaaggaattactgacgagtgtgaaagacatttcccagaaatggtttgaggttactctgggtgtgaggaacttctatgttatttctgattccagctgtaaatctgttttctagaaaatgttttatcaaagtgctaaataccttgaaacatgatatattttacatttcatgaatttttcttttcttaaaaaaatagcatttagcactagaaatgatcttgaagtaaacctgaattataaat

SEQ ID NO: 226414 - DNA, 445 bp, Homo sapiens
acgcctacacatttcctctctgctgaggccgcctcaggcacaacctacttcagaaaggcagcatctccccctttcttgggtgtagacccgatggaaataccgacaggtggtggcatttgccccatgccctcaacgcgtgaagtcactgctaatttcacaggagtcgctggtgacattgggctctgattgccatgggctcagtgacgggaaggcgctgccttctatcctccccagggctgccttcgagggtgactttcaccacgattggaaggaaacagccagagactgcagggcctgagctgactcagtcactcagtcaaatgtttgcgaactgtgagctgttgaggggagcccggagagtgttgcccccagtaacttccccaggagctcgtgatccagctgaggagcccagaggataaaataattctttaattcactctgcaga

SEQ ID NO: 226415 - DNA, 488 bp, Homo sapiens
acgcctacacatttcctctctgctgaggccgcctcaggcacaacctacttcagaaaggcagcatctccccctttcttgggtgtagacccgatggaaataccgacaggtggtggcatttgccccatgccctcaacgcgtgaagtcactgctaatttcacaggagtcgctggtgacattgggctctgattgccatgggctcagtgacgggaaggcgctgccttctatcctccccagggctgccttcgagggtgactttcaccacgattggaaggaaacagccagagactgcagggcctgagctgactcagtcactcagtcaaatgtttgcgaactgtgagctgttgaggggagcccggagagtgttgcccccagtaacttccccaggagctcgtgatccagctgaggatttgctgaagaattggatgagggaaagactcagagaatggaatactgagaattctacaataaatatttgaatcctagaatgt

SEQ ID NO: 226416 - DNA, 492 bp, Homo sapiens
actgcaaaagttatggccacagtgcatggtaagtgcttagttacggtagaaaagacattacatttgttggtggaagtcatgaatcaggccgcacagcaggaggtgagtggccagtaatggagaattactgcttgatctcagcctcctgtcaggtcagtggcggtgttagattctcatgggagcacggaccctattgtgaactgcacatgtgagggatctagattgctcactccttatgagactctaactaatgcctgacgatctgaggtggaacagtttcatcctgaaaccaaccctaaccctgctgtggaaaaattgtcttccacaaaactgatccttggtgccaaaaaggttgaggaccgctgctttatggtatttacccaccagtactgatggcatttcacatcagtattcacagttatgtggtctccttatcacagagtttttgggagcaccaaaggaaagatgctaattgatctttaaaaaaaaaat

SEQ ID NO: 226417 - DNA, 431 bp, Homo sapiens
gtcattttcttcctctaatgcagtcttgtttccacctatctcctttgtgatattaatgacaaatatattacatttctatatgttgtaagcccgaaactacaattggatatatattgttttatgcatttaaaaaaacaggagaaaaagtgagaagaaatgtgcaattattatgtctcttatgattacttaaattaattatctttatcagtgatctttatttttttatgaagtatcaaattactgcctactgtaacttgcttttagcctgacctacctcttttagtatttctcaaaaagcaggtctgtctgtatttgaacttcattttttaaatttttttttctggatatgggattcttggttgacaatttttattttctttcagtactttgaatatgtcatccaactaccttctggcctccatggcttctga

SEQ ID NO: 226418 - DNA, 273 bp, Homo sapiens
cttatcccctctactactgaatatgctattcccagtttcttcactcttctaaacactgaatttatattcttattttttaaaagtatttgcttacatctgattattttagattgctagatacagcgttcttgacacatagcccaactgcatgcatattgccttactgtatgtctaatattctattttggatgctatctgcctatatccctcaaaaataacccttagcctgggcactgctttagagccttgctcaatactgactatacaatttgc

SEQ ID NO: 226419 - DNA, 456 bp, Homo sapiens
tatatttttttgaactatttgttgggggttacatatagatgaaaaatgttaaactttcattaatataaaaatgtatgacaaagcaacagcaatcaagacaatatgatactggcataaggatagacatatggatcaatgaaatagaattgagagttcaggtactaactctcctgtttatagtcaattgatttttgacaaggtagtctagatcattcagtggaggaaagaatagtattttcaaggaataatgctaggatgactggatattcccatgcaaaagaatgaaggaaaatgcctaaatcatatcatatgtaactcaaaatggatcaaagacctaaatataaagagctaaaactataaaaatccttgaagaaactataggtgaaaatgttcatgatgtttgattaagcagtgtttttttagatatgacaccaaatcacaaaaactaaaaagaaa

SEQ ID NO: 226420 - DNA, 469 bp, Homo sapiens
tatggccgtcaaacttcggcatatagcagggttgcctaggaagttgctcaaacaaacaaacaaacatatgtcctgaccctggaaattctcattcagcagtgtcaaacttgggcatctagctttactttgaacacactctctagtaattctgatacactctgaatttgagaaccattagtgtattggaaagaactcaggccctttggagccatgaaagactggatttgaattctgattctgccatttatttgctatgtgcctggggcaaattacttacctctctgcaccatcatgtctaaaatgccaatcatttgactaacttatcaagtgatcgcagagaagtaggattaagcacatattatgctgttcttatagacaattttgcatttaacaaaattttagttcattttgcatagtaatctataataaatgctaaatgcaacacaatgtttgattcaccatcttgtca

SEQ ID NO: 226421 - DNA, 166 bp, Homo sapiens
ggttttagaatgtgtccttggataagtagggactatttattgtatgtggcaaaatagttcatccagttaatttcattcttttaaagctctaaaatcccaccatgtttgtattttcattgtatgcataatacctggaaggaactacttactggtgaatcactcaaac

SEQ ID NO: 226422 - DNA, 202 bp, Homo sapiens
acagtgactgtgtatagtttgctcaccagtctgacaaagagtggttaatggattatgtaactacatatttggatgatctcttaaatgtctattctttttacaaatacctaagctaattcagtgtttataaaccatagcttcgtgacaccccaggacagtggttttcaaagtgtgaactctgaaccagtagcatcagcatcac

SEQ ID NO: 226423 - DNA, 344 bp, Homo sapiens
cagctgggattgcaggcacgtgccaccacccccagctaatttttgtatttttagtagagacagggtttcaccatgttggccagtctggtctcgaactcccgaccttaggtgatccacctgcctcggcctcccaaagtgctgggatcataagcgtgagcccctgtgccagccgtatttctctattttactaaattaacacacggattatgatttttgttcaatcagttatacttcatttattgtccttatttatagatttcttcattttattttatttattttttaagacggagtctcactttgttgcccaggctggagtggcacgatctcagctcactgcaacc

SEQ ID NO: 226424 - DNA, 982 bp, Homo sapiens
gtggtaacctcttatggagaggcaagtaaattctgctgtttttgttattcacagaaaaacactggctcgtgtgggttgggaaggtgaaataccagaagtatttcatctggttatttctacccatgcaactcctataatattgaaatgcataggttagcatttttggccaatttactcagcattctgggttaaaggcttttatttattttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggtgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcttttactaattattgtttacatttgaagtgttttatgaatgaatatttaattgcatagatgaagattactagttataggcattttactaaccaatactcattaagcatagcgtggattcatatgacatcaaggagctattttatttggtaaaatgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatggg

SEQ ID NO: 226425 - DNA, 257 bp, Homo sapiens
ttcacctcccatgaccacaggcagtatcctagtattcctgatggcaggaagtgtcatcagcctggatctgggagaggctgacacaagagcagcacgccaggcaaccaggaatgcacatgtgataaaaatgtatacacttgttgtgtgttttttatgttttaaaaattagttcaatgaagtacagtagggaaattgtcaataatttattgtaaatttcaaaataaaagatttgtattgttcctagcacaaagataaat

SEQ ID NO: 226426 - DNA, 430 bp, Homo sapiens
aagaaatctgcttcagctcggaatgcttttcattttctttaaaaggtagaggaaaaatagtataatgaaaaatatattgctttggagttgattactttttaataggaaaagaacactgtattctaggtgagaattagctgcatgcctttgtaaagagcagtatcaatccaggcatatatatttgtatgaaacatgtttagaaatgctatgagctagctgtggtatttttgttgttgtcattgtcattattgttatgccctggcttctgaggatggaggcaagggcatgtgagttagagttttgtctccataagaataaatgtttgtcccttagagatttcccattttcaacagcagagcaggctgaagctggaaatattaaaatacacatgacttctcgaagacagttggatgcctttagcaaaaaaaaa

SEQ ID NO: 226427 - DNA, 649 bp, Homo sapiens
gtaagaaaaattggaaggccttaatagctgcttaactttctaaccttctcttgtttctcttcccacaaccccagtgcagagggaggctgtttctgaaattttcttatctgactaaggaaacttatttccaaaagaaatgcaattgtcttaagaccccctcctcaggaatctcatcaaataaccaggaaaggttaaccactggagaagaaactaaaagtcatcaccatgcccaaacaggatttttatctattcttctgagggcacctccaaaagtctacctgggagcctttatctgcatgataagataatctttgctgacagtgaagacctgccccccaccttcctgtcacctccctcagagctcagatgaactttgccttaggccattgtcctttgggctcatccattttcctctgaaaatcattcaccatccctcacaatctcctatgttccccccatttctttctaccctatcaagagggtattgaagcctcaagcatctgggccttctttgaatctcacattttcaggactgtcatgtttacatatacgtaaataaatttttaagcctttttctcctattaatctgtctactgtcagtcatttcagcaaaacatcagagaagacagaaagaagctttccttctgtc

SEQ ID NO: 226428 - DNA, 458 bp, Homo sapiens
tgagagaagccctgaagacatgagagagcagccatacagctatctggggaaagagcaaatgaagtgtctctgaggtgggatcttgcctaatgtgttcaaggaacagcaggggggcccatggtggatagggcggagcaagtggggagtggtaacaggagcatcagggctgggcacggtgctcacgcctataatcctagcactttggaaggccaaggtgggtggatcacttgaggtcaggagttcaagaccagcctggccaacatggtgaaaccctgtctctactaataatacaaaaattagctggacatggtggcacacgcctgtgatcccagctagtcggaaggctgaggcaggagaattgcttgaacctgggaggcggaggttatagtgagccaagatcgtgccactgcactccagcccgggagagacagagtgagactctgtcttaaaaaaaaaaa

SEQ ID NO: 226429 - DNA, 601 bp, Homo sapiens
ttcgagaccagcctgggcaacatggtgaaactctgtctctaccaaaaaaacaaaataaaaatcaaccgggcatggagcacatgcctatagtcccagtggggctgagataggaggatggtttgagcccaggagcaagaggttgcagggagctgagatcatgccattgcattccagcctgggagacagacctggaccctgtctcaaaaaaaaaaaaaaaaaaaaaaaagaccatacatatacattattaaaaaatcaaaataatccataaaaggtatatagagaagagtgttgctttaacttgtaggaccatttgcccctttcttccccttgccagcctctatattcacaataggaaacaacttttagtagtgttttcttacagtctttccatttttctttatgtaaaaacaagcaaatataaatattcttatatgccctctggagctctttccatatcactgaagaaggtgcctcctcattttggtaaacatctctgtggttttccgttgtttgtttcacaaacgggagatttaacaaatctcccattttgaagtgctcttgggtcacttccagtcttctattacaaaaagcagaactacag

SEQ ID NO: 226430 - DNA, 321 bp, Homo sapiens
cagcccgagaagtttgtttcagtcgatgtcttctccagggagagtagatttgctcctggaaactaaatctgtttctaaaccttttccccagggtttagacacttaggtaataatacaatttatagtgagtcaacctccaaaataaaaggaattctttaagggaaataaagacttttccaaaaacttagttaacagtaggaaaaggggctgggtgcggtggctcacgcctgtaatcccagcactttaggaggacaaggctggcggatcacgaggtcaggagatcgagaccatcctggctatcacggtgaaactgtctctact

SEQ ID NO: 226431 - DNA, 505 bp, Homo sapiens
atgattgtgttatattatcccaggtaagatgtgaaggggacaaggaaggaaggggaaacattggtcctagggtgggaatcacagaggccctggagcaagacaggcctgggctcatgtcttggctctgccacccaccagctgagcgaccttggatccatttttctgcttctctgagactgtgttccctcatcagcaaagtgggaagcagctcctcaaaagcccttaggtcacagcttgcagcggaatcagctctcgttaaacggaagctgccatcgccatagctgttatcatcactggaaggacagagaggaggaagcaggtggcagacgggcttgcacccacagggataaagcatacctggcctcctgctgagaatccctgtccctgctgaggtggagagagaatgcgaagaggagcaagcttttcacagcaaggatgcaacttctcaagagtctgagctgctgcttcaattaaaggaaaaatctgcaatttagaaaaccaaaag

SEQ ID NO: 226432 - DNA, 472 bp, Homo sapiens
cattcaaggtgcgatttgggtgaggacacagagccaaaccatatcacttgctaatgaggaaactgagtcagagaggtctagtgatgtacccaagtcacccaccagctgagcgaccttggatccatttttctgcttctctgagactgtgttccctcatcagcaaagtgggaagcagctcctcaaaagcccttaggtcacagcttgcagcggaatcagctctcgttaaacggaagctgccatcgccatagctgttatcatcactggaaggacagagaggaggaagcaggtggcagacgggcttgcacccacagggataaagcatacctggcctcctgctgagaatccctgtccctgctgaggtggagagagaatgcgaagaggagcaagcttttcacagcaaggatgcaacttctcaagagtctgagctgctgcttcaattaaaggaaaaatctgcaatttagaaaaccaaaag

SEQ ID NO: 226433 - DNA, 142 bp, Homo sapiens
tacaatattattttgtacaaataacgacaatttgctctcacacttctttttgtcatctcaatgcattcaatgagaatgtcagtaaatactgcctagccacctgcacccttgttttctgaatttaataaaagttatttcaaca

SEQ ID NO: 226434 - DNA, 226 bp, Homo sapiens
ttctattggagttggtatttttcttattgatttctacactaaagacattactctcttgtctgccacattttgcagatattttccttaacacatcattttcttcttcagttttttcgcagcctattttatttcataaacctgtttttcctctgtggcttcctccactgctcttatacttaggaagtgttttttccttatgctaaatttgataaaaatttatcttttt

SEQ ID NO: 226435 - DNA, 524 bp, Homo sapiens
tattttattatttttaagtttggggctttgaaatatcttcatttagattgagatgctatttaagtaccaactgtgaaaggaatagtaactaggtaggctgctgtgcccaagacagtgagcaggcctagttacaagaattgtggggtatgcagatcactcggtgtaaatggttatgacttgatattgtggctgaaacaagccatcattgaggaaatggagatgttcggctttagatttaggtggagcgagggtggaataaaagttttgagtcttctgtgttcatttaatatcctcagtaggcctgtgtggtatatattgttttcttactacgggtaaaaaaacttaagtctcagagagtttaaacagtttaccagtatcccacacaaataagcagtagataagattctgaccaaagtctctgtgactttaaagcccaagctcatccctcattctcccactcttcagtctagaagaggtaaaattcttaagagcagctcttaggaaaaactttttaaaacataaat

SEQ ID NO: 226436 - DNA, 266 bp, Homo sapiens
ttgcttattttttttcaagttctaatctctcaccctaaatttctcttcgctgaaaaatctacattttttgtctattttccctctcagttacgtatctacatagaaaatataatctttattttattttacgggaccttcaagaagaatgaattactcatattctttgaagaatatatttgttaaatctgaaacgtcgttcattaatcacaaaactgtaattatgaggtgacaaggacactggaactttggttatggcagtcaagcag

SEQ ID NO: 226437 - DNA, 371 bp, Homo sapiens
ggacatcgagcgaggcaggtgttccaccccactttcttgtttgaggggagaaggaaaccaaagccagtagaaatggaatttatggcctccgtgctctcagagggagaaaaaaattctcactcatcagcctaaagagaaaccctgtcttatcccagattaccaccatgggatttaaaattcagtgagaagactgcttgggaaatactgtctccgaactgccggtacagacactgcccattggtacaatatttttaggtcatctgtcaattgccatgtttgcatttctttcatgcaatacaagttgaaatcataatgaatttcttgagtttcaggaatatctcaaaataaacttcttcatcctcaacaaatga

SEQ ID NO: 226438 - DNA, 408 bp, Homo sapiens
aagtaacatttattgtgggatttttttaattgtaaaagcaaatatgttaattgtgctgcatttggaaagcacagaaaagtataaaagaatataattacccataatttcaccaaccagcaataacaactattggcaccttactgttaactgcctgcaagttgatgccagttttcaccttctcaagcctattttgacagctctattgaaaactggaaccatatcgactgctcttcatactccctttctgctttattttttcctccataatatttatttcctccttagaaccttaatgtgaaaaaaaaaatttcctcctaatgtatgattcatttggttagctgatttactgcctggctctcagtgggtggggcttctgtatactttattcactgtaataaaagtgcctag

SEQ ID NO: 226439 - DNA, 431 bp, Homo sapiens
tatcctgtgtagttaatgacaatttttgtaagttagctaagagtattgcctgtagaattgttaaaaatatgaacaaaaccataattaacctttaaagataacttgcagaatctgggggatgagtaggaagggaggttgctaaaatgtcatttttacagataaataatttggggagtattgaaatattctctttagcttttggttttgtaattcttagctttaaggaaatgtgatatgtaaagaaaagaaaaatattccttttctttgatactttgagcaatggtgacatgttactctcttccatctgattatactcccatttagaaaagaatgaggtgatgccagttataaataattataactttagtgctttccaaataggattaacagtcgagttaattaatgctctttaagaaaccaaatttccactt

SEQ ID NO: 226440 - DNA, 3940 bp, Homo sapiens
  misc_feature (453)..(453): n is a, c, g, or t
  misc_feature (678)..(678): n is a, c, g, or t
  misc_feature (1732)..(1732): n is a, c, g, or t
  misc_feature (1818)..(1818): n is a, c, g, or t
  misc_feature (1825)..(1825): n is a, c, g, or t
  misc_feature (1858)..(1858): n is a, c, g, or t
  misc_feature (1864)..(1864): n is a, c, g, or t
  misc_feature (1867)..(1867): n is a, c, g, or t
  misc_feature (1884)..(1884): n is a, c, g, or t
  misc_feature (1945)..(1945): n is a, c, g, or t
  misc_feature (3123)..(3123): n is a, c, g, or t
  misc_feature (3575)..(3575): n is a, c, g, or t
  misc_feature (3636)..(3636): n is a, c, g, or t
aagaaatgtagagttggaagatgagggaaaatgaaggatggtgttacagaaaattagagaagaaagtatttcagtagaaggctgtaaataactgataaatgttaagaatgacagaataagataagatcaggctacacaccatggatatggcaagaagaggtcattagtgacctcctaagaatgctttcaagagtagagaggtgaaagatgttctgaaagacagctgaaaaggaggctattggagatgtaaggcacaaagtcaagagagattttaatgtgagataaactacattaaaacattggtagatgggagtaatactaatggagagagaatgaggatgttggagagagaatgagcatgttggagagaataaggataaactcaagagtgaagtcaatgaatgagtcaaaaggaatagaaactatttcaaatggacagggaggctttagttntaagcctggacagttagcctactttagtttgagaatgcaaattatttgtggaaagaagtcagtaggaatatttgataaaaggaaaacaaaactgattcttattttaattatttttctttgaattattagaaaagatcactagctgaatatatgacttggggggaaatagtaaaactttcagagaatttttagggtagcatagtaaatagtaagcagtagactgcntcaggaatttatggattaaatgagtgttcatttggaatttatgatcacaagcataaattgaatttagtcagtagggatttgtgattttctgtagcaatgtctcactgactgggtaaaattagttttggaattttgatgaaagagctcaaggtaggggacatggagggatttacgcatgttgacaaggagtgcacactaattacagagagtctacatcaatctagaaaataagtggggtcatgaaacaggtaatgaataaggaaaaatggataaaaaccagtggattactggcaaaggggttttggagagaagccataaaagtaagtattctggaatggtggagagtgatatcgggagagtgggctgttccaaatgaagattttattggaagagcaacttccaataaaaacaggatacatctatgcatgtagaaggctaatgtgaagtgataaaaaaggaatttggcgtatagaggttctgggaactaagaggcagggtgttggacagatgaaggatgaggacagaatgcacagccaagtagtaaataaatgagagagagtgaccagtagcatagaggtaatggtgagagaggtgcaggaggagggagagaaaagaagaggtttgagaataggaaaaaagggtatgaaaataaaatggagagtgagaggtatatgtacccctctttaggctggaagtgtgtggtatgttggaggcaagcctattttaaagaagactgtaaggaaaaccatgtcatttggagccacttggatttcaggtggatcaactaggttatcttggcaaaaaggggtcaaatattggaaaaaattactgataactgatcttgagtactgttctctcatattttgattttgaaatagatattgagatactcttacaaattagtataaaaaccaatatttgaaaaatattttgaaaataatacgatagtctctatggtctctatgttcaggcttgcatgaaatttaaacactttcatttaaaaatgggacatttatttatttagagacagagtcttgctctgtcatccaggctngagtgcagtggtgctatctcagctcactgcaacctctgcctcccagggtcaagagattctcctgtctcagcctcctgagtagctgngattacnggtgtgtgccaccacatctggctaatttttgtntttttngtngagattgggtttcaccntgttggccaggctggtctcaaatgcctgacattcagtgatctgcctgcctcagcctcccanagtgctgagattacaggcgagagccaccgctcctggccaaaaaataaaaataaaaaataaataaataaaagggggggcagcttttagattacaaagaaagaagaaaactcatattcatcaacacatattgattgggcatcatttatgtgttgaatatttacctacatgctgatgatacattattgagtaaagttaataaatgaactagctcatctatactttttcaagttaaatgactagcaagatatagaaccaaaaaacaaatttaaaaacccttttatttctgtgacatttactggattatgtccatagtactctgaacagtagcggtcattgcttgtcagtatccaccaagaatatacacggcagccagtggggatttacgctaaacctgagtctgttgagttcatttgtaaatttgtttctatgttatggtcgttttgtgttggtgcaattcaattaaatatgaaataaactttgagaggtgcttattctatgaaaactaacttgaatgctataagaaatgcggtaaagaaaagtcactaacaaccattgttatgtagaattaggtgtggccgtcacagctttaaatgattgggtaaaagtactaaaaaagcagattcttgtctcagattccctggatagagtgcagaagttcttgttcctcttttaggaattaaaatacgggtgttcattaaagaataagtgaaactacctttacaggttttacgttaaaaagttttttaaaatattatttacattaattcatgaatttctgctttaatagacattatagaataattgaccaattacaagttccagtctcctattataatcaaacaaatatataattctaaactataaaaggggctttaaaagaaagtgtctggcgttatgagaggagatagtaaggtgacaggtggaatccattgtgtaaggtattcaaagaaacttcgaattgacatctgagaggtaagcagatgctaactaggtaaaccagaaaagaaattgctctagaaaatagaaatattacaaaaatttggccagtataacagaaaatgggggttagaaaacaaaacaaaggaaaataaaaagttaaatactattatgaaagtataaattaaaggctatcaaaataaatgtgaatgaattaaacaatttatagcaaggtaatttancaatgtcctttttatgaaagacataccaaaagaaataccacagaaatatcataagcaaaacaataaagaaatattgactagctaaaaaatggaaaatataacattactttagatagaaatattatatcaagaaaagcagaattcaaggctaaaatttgtcaaatagcattgatcattatgttataaggatcaactgtgtaatctttccttaagacataccacaaatgaatttttctatccaatgacttggaatcaacattgcaaataaaataaaaattcaagaagagtctgggcactgtagctcacgcctgtagtcccagcactttgggaggctgaggcgggaggatcacaaggtcaggagatcaagaccatccttgctaacacggtgaaccccgtctctgctaaaaatacaaaaaattagccaggcgtggtggtgggcgcctgtggtcccngctgcttgagaggctgaggcaggagaatggcgtgaacccaggaggcggagcttgcagtgancagagatcgctccactgcactccagcctgggcaacacagcgagactctatctcaaaaaaaaaaaaaaaaaaaaaaatcaagaagaaacagataaaatcaaaattacagtggaatatattaatttacctatctgtttttgtcatatcaaaaatcacaaaaacatggatattagaatttaaataatatcagtaataactttagtatttatatgttaaactttctaccctttatcaaaaaattaatttcaagtatgcatggagtatttttatataagtttatatataaggtcacatagaaattatca

SEQ ID NO: 226441 - DNA, 1759 bp, Homo sapiens
  misc_feature (453)..(453): n is a, c, g, or t
  misc_feature (678)..(678): n is a, c, g, or t
aagaaatgtagagttggaagatgagggaaaatgaaggatggtgttacagaaaattagagaagaaagtatttcagtagaaggctgtaaataactgataaatgttaagaatgacagaataagataagatcaggctacacaccatggatatggcaagaagaggtcattagtgacctcctaagaatgctttcaagagtagagaggtgaaagatgttctgaaagacagctgaaaaggaggctattggagatgtaaggcacaaagtcaagagagattttaatgtgagataaactacattaaaacattggtagatgggagtaatactaatggagagagaatgaggatgttggagagagaatgagcatgttggagagaataaggataaactcaagagtgaagtcaatgaatgagtcaaaaggaatagaaactatttcaaatggacagggaggctttagttntaagcctggacagttagcctactttagtttgagaatgcaaattatttgtggaaagaagtcagtaggaatatttgataaaaggaaaacaaaactgattcttattttaattatttttctttgaattattagaaaagatcactagctgaatatatgacttggggggaaatagtaaaactttcagagaatttttagggtagcatagtaaatagtaagcagtagactgcntcaggaatttatggattaaatgagtgttcatttggaatttatgatcacaagcataaattgaatttagtcagtagggatttgtgattttctgtagcaatgtctcactgactgggtaaaattagttttggaattttgatgaaagagctcaaggtaggggacatggagggatttacgcatgttgacaaggagtgcacactaattacagagagtctacatcaatctagaaaataagtggggtcatgaaacaggtaatgaataaggaaaaatggataaaaaccagtggattactggcaaaggggttttggagagaagccataaaagtaagtattctggaatggtggagagtgatatcgggagagtgggctgttccaaatgaagattttattggaagagcaacttccaataaaaacaggatacatctatgcatgtagaaggctaatgtgaagtgataaaaaaggaatttggcgtatagaggttctgggaactaagaggcagggtgttggacagatgaaggatgaggacagaatgcacagccaagtagtaaataaatgagagagagtgaccagtagcatagaggtaatggtgagagaggtgcaggaggagggagagaaaagaagaggtttgagaataggaaaaaagggtatgaaaataaaatggagagtgagaggtatatgtacccctctttaggctggaagtgtgtggtatgttggaggcaagcctattttaaagaagactgtaaggaaaaccatgtcatttggagccacttggatttcaggtggatcaactaggttatcttggcaaaaaggggcaacacagcgagactctatctcaaaaaaaaaaaaaaaaaaaaaaatcaagaagaaacagataaaatcaaaattacagtggaatatattaatttacctatctgtttttgtcatatcaaaaatcacaaaaacatggatattagaatttaaataatatcagtaataactttagtatttatatgttaaactttctaccctttatcaaaaaattaatttcaagtatgcatggagtatttttatataagtttatatataaggtcacatagaaattatca

SEQ ID NO: 226442 - DNA, 528 bp, Homo sapiens
acatggacttagaagctccaagttgatgaagaatttctacatttcactgttagaaggatgcttggttttcctaccaagccactacattggctgaatctaagggctcaaagtttaatgcaagaaagaaggaaatgccagttttcaacagaatggttggatttaagaatcctaagtgaaacaatggaggtggagagaatccaaactggtaaaccaaactcaagtgaggacaacatgaggtatcaaattacagagccaagaaattcaggtgtaagaacaacttcaagttacaaggtccaagacatagactaaaatatgttaaatgacaagatcaaacagatggttcatataggtgtattaggttgaacaatggccctgcaaaatgtccgtgtcctaatacccagaatctgtcaatatgttaccttacatggccaatgggtcttcaaagatgtgactaaatcaagtttcaagagatggggagattatcctggtttatctgggtgagttcaatgtaaccactagggtccgtat

SEQ ID NO: 226443 - DNA, 369 bp, Homo sapiens
tgcctggcctgaagactctagtccttcagaataacctaatccccaaagtgtgtccagagttatgcaacttgacccaggtgacaatactaaatctgggaaacaaccttttagaagaagttccggaagagatgaaatatcttacatctctgaagaatctccatttatctggaaataggatctgtagatttgcacctggagcctgtggtaatttaatcaacaaggaacaacattatagcatcaaatttaatctctcatatttaataatatgagactgaaatgaaaaagaattttgcatgtttaatctttttttgttggagatattaacacccccctcttgaaatataggaggagacaacaattttaaaaaaa

SEQ ID NO: 226444 - DNA, 470 bp, Homo sapiens
gtgtcccagcccagagaatctcaagtaaccattgaacttgttcaaagtgactctaaactgctagtgtcaaaaacaatcattctgggaagaagataatagcatcctaggcctcaaatgcatctagcaaacaagcaaaaataatcaagccccagagaggcgagattgccataagaaaagcagaaacaggccaggtgcagtggctcatgcttgccataccagcactttgggaggctgaggctggggaattacttgagctcaagagttcaagaccagcctgcacaacatggtgaaactccgtttctacaaaaaatgcaaaagtcagttgggtgtggtggtgcacacctgtagtcccagctactagggtggctgaagtggatggacggcttgcgcttgggaagcagaggttgcaaagagctgagatcatgccactgtactccagcctgggccgtagagccagaccttgtctcaaa

SEQ ID NO: 226445 - DNA, 431 bp, Homo sapiens
atgcaggctggggaagaatccacgtgggcaaagaacatcctgattaaaaatccaaacgttttcatggtgagacttctatgtgtcaggaccatctgctggtggaattaagaagcctgaggtgctaatttgttaaagaaaaagtagatatctggaagtgagaacagagaactgaaaacaatctctgatggcacaagtaaaggtgaaaaacctaattagaataggacttggtgctagcctaaggactgtagctattcctgcttctacatccttcaaattgagtaccagggtgcaaattttttcaaaaccattccttcctttggaattttgtattgtactataagacaatcatgcttatctcctgttttgtaggtaatagatgtgaatataaatatgtttcagaatgagaaatattaaacataaatgacagtgaa

SEQ ID NO: 226446 - DNA, 344 bp, Homo sapiens
gttctatttaatgtagattataaggcctttagtatgtctttctaaatataatgccagaaaaaatgaacagcactcaaataacttacttttttttttaactgcgttaaaaaatactgagttatcagcatagcatttggtagtggttgagtgagtagggataggtgatggggatgaggtcagcccacactactcacatgaagttgtgaagaccaggactaattcctatgtagggtatctttacgctgattaagcagtactactttgagtttctattaattaaaatattacatgtattatcttggttttaaaatcctattttttattttttcttttttacaggtttg

SEQ ID NO: 226447 - DNA, 330 bp, Homo sapiens
gcctaattttaattaatagaaggataagcaatgtttattatcaagctagcatcttcatagttttcttctgaaactttcttaaaaaaaagtactgatgctcatttcattccgatttcttttcgcctgagagttcctttcctcctgcaccattttgcatgtctaagttcagaagataatgatttatttcacctttcttatttctgtctgctcaattgtcctatgaaagaatttgaatattaagtagaaaatcttgaacctaggttaaagccttatgaggatgattgtgaactttttccctaaatcattaaacctcctcatgtaaacttacaa

SEQ ID NO: 226448 - DNA, 563 bp, Homo sapiens
cgagggttgtaaacgtagtttggaaattctgaccagccaaggagtgattcctttagatggttcagtgtcgaagcgataaagcaaacatgccattctgagacacatagtaattcctaggactgaaacccaagggagatatttccccccaatgagtttgtagagggtaaggaattttagtgtattataagtgatatacaataactcagatatgcttgaatatgcaagactgtctctgagctcattcttcaggaccccatatacaaaaagaaagatagcagaatgggaatcaaattactacttgattaatagattctcaaccacttaatatctccccagtccaaagctgcctggctttgaaagttaaataaccaaacatgtatttccaatgaaaatttaatgtctgaattgagatatgctgtaagtgtaaaataaacacctgagtttgaagactccgttaaaaaaagaatgcaaaaatatcttgttaaatttcctattgattgcatgttgaaattgcaatattttggatatgatgggttaaaatatattattaatttcatctgtgt

SEQ ID NO: 226449 - DNA, 452 bp, Homo sapiens
gcagcagtcaaacctggtctatttatgccgaagcccaagtgcaggtgctcagaggagctcaagggcagaagaattagtcagggcacagatcttccggatcgctactgtatggggaccataacatcactgtaaggcccctgtgctgagccacaaaccccacttggaacaaagaaaactcccagagagcagagctgtgaggagggatagatattatgctgtggtgcagccagacaagccccaccttgttgtgcctccagaagaagcacattcttggcctgggtggtaacaataacatctggatggaaatatcaagtggtatcaggcttccagaccaccattcatgaaagagctaaccttacatatgcttgatcaaatgacgaaaagcttcagccagaaacagttttgcctgggttctgaatcttccctgagctcttaaattctacccagtgagc

SEQ ID NO: 226450 - DNA, 599 bp, Homo sapiens
gggagtccgtgaacaaagtcagagttattagctgggtgaaggggaggaggggcctttctctggagagggtggagcctgaacaggaagcaggaagcttcctgtggcggggtaggaaccagtgcaggtccctgctgcaaggattgagtgggtgacagtggagaggaacatgggttctcagatgttattggggggctcggagggtagggcagagggacacagggcaatggagttagattctgggggctggatttgagaaatgtgtgtgaaataaaatttagaaagcttgcagaggatgtaggagatgaggagaggggacagttaagcctgaccctcagcctggagtgcagggtgttgttgccaattgggggtcaagtgggagagaaagatgaaggattcaggtttggatatgcagatttgaccgtctgtggagatgctccagaagcagtggggggtccagacgaggctcagtgtgatctccaacatggacagtggtgggcctactgatttgctctgtgaaagttggggagagcagctgggatttctgggaatagattaggcaggaaggagaggttcttcctattcaggcaaattgaatctga

SEQ ID NO: 226451 - DNA, 194 bp, Homo sapiens
gttatagaaactgtcagattttattagtcagtacacaactgagtggtataatatattctttaaattttttaaaatttatttttatttagagatggggtcttgccctgatactcaggctgaagtgcagtggtgcagtcttggcttacttcagtcttgatcttccgggctcaagcagtcttctcaccccagcctct

SEQ ID NO: 226452 - DNA, 280 bp, Homo sapiens
gctctgaggtggcgatggtgacggaggaggacacactcccccatggccgctctctcggaccacagagccaggccaggttcctgcccacccctccgccctgcgcctgctgccatcggcactggcctaggatgcctcaggcaactcacttcagctctccacaggttctcctgtacccccacccacggataactgagagaggagaccgtgtgtctatggtgatggggcagtaaccatgggcaaactcagggagggagggtgactgtgtgcaggctccgggaag

SEQ ID NO: 226453 - DNA, 655 bp, Homo sapiens
aaaacgacaaactagaacggcaaaattacactcaggcacattggagtactcttctctcaaatcactccacagagaacttcatcatttgctccgccctctaataactcatgcaagaaaagttcagcaccatcagagagaaacaagacagagagaattcatagaatggctttagggcctttcctccaggcggtaagaggatctgcgtgtgtccttcgcaggggtccaaagggagagaacctaggcctagggtttcggggataccgacacccagaaacagattttctctcaaagaagtttctgccgccatccctatcttatcagcaggaggccccggcgccatcgtctccgtctttatgattttattatggggaggtgggaaacgccaccctggattcttccaggcctcccctattcagcttgggggttccccctcattcttccctcaaagcctcagtccctgaggtcctcctcagcaccccccgcttctggcggcctgtcccccgtgaagtgtaaaggcacggccgaacccaccggccttgccgtgaaggcgggagggcccgaacccgccagggccacggcgatggctccgaggggcccagaaaggggaagggcaggccggggaccggggcagaatgacctggccggggaagaaagg

SEQ ID NO: 226454 - DNA, 758 bp, Homo sapiens
tgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatct

SEQ ID NO: 226455 - DNA, 337 bp, Homo sapiens
gcaagagggatgacttttagaagcttttagattctcaaactgtatccctaacatgctgaaatttcacattgtactttgtgttctttttatatccattgttctgagcacttggtgggcctttgaagtctcggctacttggctacttcaactctgggaactatttttggcattttttacttgataatttcttcctctccttccccccaccccacccccatgtttctggaactcctagttaaatctggactcctgggttaatcctttgattttgggggtaggatgtgactagcattatcccatcgctcattttctgagatttgtttggcttgctcttcca

SEQ ID NO: 226456 - DNA, 101 bp, Homo sapiens
taatgcatgaattaagatcagaaaagagaactagagaaagaggctagatggctgcgagaagccagaatattaagaagttggtccaggtgaggtggctcacg

SEQ ID NO: 226457 - DNA, 579 bp, Homo sapiens
tgaaaagtactgtactaatctcaataagtacatggagtgttacaatttattgactcacattcctctactccccaccccaagaaaatgattagggaggatgattcagttacaaacttacactgcaaaaggaaaatgcatactgatcttggattagggttttttttccccaaatatttacaaaaggatgattataccagtgttttaggggatttttattccaggacttcacctttcaacataaatggtaaaatgtgcacgtgtcattttatatattttatttgccaaaaagaggtattaattaatcacattattttctgccctgaaatcccaaaatactatcttaaatgatgggtaaagatcttctctgaaagatggtggctattttttcaaggatgaaagaaataaagtaagacaatattcttcgaagactgagcagaatcattgtcataccccggagagatgaaatgccatattgatacagctgctaggagaacacagagttgcaaactgtcactacactatttgtacacaactccacagtgatgtcttccatgatgcatctctaagcagtatatgagg

SEQ ID NO: 226458 - DNA, 351 bp, Homo sapiens
agccagtctattttcatggctgttaggtacaatttgtatgcttgggagctgtggagttgctgtattctgtcataagggcagatcagcagagaaagctaaagcaagaggagaatagtaacatggacacaaggcagaaatgcagagatcaaagatggaaagagaatatatcccagattcctaatggctttccaaaactgatccccttctttcttgttccccaaatactgccctcttcatatggcccttaaattcttgtaataaattctcccttctttgtttaggccatttcaaattggtttctgtttcttgcaaccagacaccttaaaaaaaataaactcaaattttctttca

SEQ ID NO: 226459 - DNA, 574 bp, Homo sapiens
tatcgagccttcctgtgccacagcaacagagctccagttgtgtcttgtaagaattggtcattgtttcatggggacgactggctcctttgggtgggatctgatggcatctcatggagttgaggttgtctgccaacgctaactggccagctctgacaggaggtgcgtggcccaggaggagccatcaggccagttctctgggatactgctgtgtctccagctctgcagtttgctctgcgtcactcagcggcagacggagaggcagacacgagccccttgtgagccctcctccttaccgtcatctcacaatgctctgaaataaggaggcaaatggctgaggtcccctcagttgtagatgtgattgagttctatctaccagaagcatatgcctcctggaagcctggttctaacacctcccacaaaatccttcaagcacttttttctgttccaaggtttgcttatgggggacccagtgaagtgcttcagagccctagagatttgctgagtcatatgaggggtcagcaaacttttcctgtaaagggtcagataataaacattttaagctttgtagactgta

SEQ ID NO: 226460 - DNA, 541 bp, Homo sapiens
ttaagagtcatccccactccctaatctcaagtacccagggacacaaaaactgcggaaggccgcagggacctctgcctaggaaagccaggttgtctgccaacgctaactggccagctctgacaggaggtgcgtggcccaggaggagccatcaggccagttctctgggatactgctgtgtctccagctctgcagtttgctctgcgtcactcagcggcagacggagaggcagacacgagccccttgtgagccctcctccttaccgtcatctcacaatgctctgaaataaggaggcaaatggctgaggtcccctcagttgtagatgtgattgagttctatctaccagaagcatatgcctcctggaagcctggttctaacacctcccacaaaatccttcaagcacttttttctgttccaaggtttgcttatgggggacccagtgaagtgcttcagagccctagagatttgctgagtcatatgaggggtcagcaaacttttcctgtaaagggtcagataataaacattttaagctttgtagactgta

SEQ ID NO: 226461 - DNA, 712 bp, Homo sapiens
aattgctgagcatcattccatggtatggatgtaccacagtttaactatttacatgttgaaggacatctaggttgtttcccgattttaactattacaaagctgctatgaactttcatgtacaggtttttctgtgagcataagatttcatttctctgggagaaatacccaagactgcaattcctgggtcatagggtttaacatgtttactttttaaagaaactgccaaactgttttccaaagttgctgcaccattttacattcctgccagcaatgtatgaatgatcaaatctctccacatccttgccggcatttggtgttaccagaatgtagaggaaggggagaaaacattatttaaaacatagattaaagaacctaagaagtaatacagtcaggactgtttggtataggagaaaacagtcccacctattcagtaacttttgaacttatgatacagcaatcactgttcacgagttcagcttgattcgtactaatagaataaaataatgccaagtagattttttttaaatcatggcttacagtcttcactgtgatcataaaatggaatcatgtagaaagcaaatgaacctggaagtggtaccaggaatgtgtgtcacataattccaaagatccagaatctctttcttttcctttcctcttctttttgcctctggatcctgccactttcaaatcaaaatgttcaattttttttcct

SEQ ID NO: 226462 - DNA, 437 bp, Homo sapiens
caaggctagaaaaagttcagttctcattcaaagagagaaacatttattcatatagtttcttaccttttattcatatagcctaaaggctaccaatggggaaatggattagtaaactaggatatatctatactgtagaacatcagaagacattaggcatatctatatgttttgacatggaataatctttaagttacattgttaagggaaaaagcaagtcagtacagtgtgtacagtatgactctatttttgttaaaagaggtatgtattttgatatatacatgagaaaaagttgagtgctatatatggaacttttaatacttgtctctggatgttgggattaaacagaactttttatttttctgtgatgtttgactgtttttcttagttgtgttttaatttttgtaatcaggattaataaagataatttttaaaatggg

SEQ ID NO: 226463 - DNA, 434 bp, Homo sapiens
taccaggggctgggaggacaggtaaagccagatgcaaagttaacaggaaacactgttttccaagatcatgcagcagccgtaaaatgtcgcaatggtcccctctttgagcaattgctgcctttttacgagtgcgcatacccgctttgccacacccatccatgtactactggggataccgaagatcactctctccttgtgacaacgcccaatccctagctaatccccactactcctaaccccacctcagaaacaccaagcaatccagaactgatcctgcttctcttagagattcctcagaatcctcgaatgggaacccaaaccttacaaaagacagttctctccagcctcttgttgaactgcatttctccgttactctggaatatcctgtcacttcatctatgtattaaatctgattttgctttgttactggtggt

SEQ ID NO: 226464 - DNA, 295 bp, Homo sapiens
aaaatagaagatctatgagaagagagactttgcctacatatccttagagtctacaccataataagtattccaaaacgtattcattaaaagaatgataagtgttctctcttaaatccggtgctttaccattcaggatgcaatgtctctgtcaacttacaaagagtggcatttctggtctagcaattgtaccttgaagatttgctgccaccaatgagaagaaatgctatctaatctccttagacagagacactgtcccagagttttcctttaagtatcctaaatggcaatgaactgt

SEQ ID NO: 226465 - DNA, 1582 bp, Homo sapiens
cattttgaaaaaaattataacatttatatatcatcttttcctcgatgcataacactttttacaaagtttagtggtagataagtgaggggtaactcaaatcagagaaacaggggtgcagacgtttgattaacttgtctcatatcataacttttcaagatttcattatcattccacaacactgccctcaaaaaagaattttgtaattaccattgagtgacaaaataccaagtagtgacagaggtgtatagacgaactcaaaagttattgtaggaggacactgataaaatgttggggaaaatcacaaaagacacgagaagataatttagagctctatgcccaaatcacatgactccagtctctggctctcttagccagaacagcgaatcttttacaatttacctcttgttgccaataattttctattatcttcaaataataataggctggagtatgaacctagtttatcaatacttttttaaaaaaccgacattcctctcttaaggagtccatgcattctccccattttttagaaaattgttccatgaagaggaattaagtttattcctttgaattctagtctgcatcccagcttttagaacacgggatgcagaaccagttgatttgccacaggccaagtcctgagtctccagcgaatcaagcaattaaccagtcacttggcctttttgcagaaatccacaaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgcgttcacacccggggctcagcccggtgcgccttcacgcgcagcctttttgtttatgcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccggatacgcaggcttctggagaccctgggtggacgccggaggcaagaaagaagaggagacgccgaaccacgccgcggaggcgatgcccgatggccctggaatgaccgcagcctcaggaaagctttaccaattcaggcacccagtcagactattttggccaaaatcaaaatgttatgattacttatatcaagaagcagaagctcttctgaaaaattttccaattcaagccacaatttcattttatgaagattctgatagcgaagatgaaattgaggatctgacctgtgaaaattaatctgattagctacttttgattatatccaaagcttgtggggtttaaatttagtgtacaaatgtatcataattattttaaactaatttatttgtatataaattattaataaaatgaaatattttgtaaaattctggta

SEQ ID NO: 226466 - DNA, 1738 bp, Homo sapiens
cattttgaaaaaaattataacatttatatatcatcttttcctcgatgcataacactttttacaaagtttagtggtagataagtgaggggtaactcaaatcagagaaacaggggtgcagacgtttgattaacttgtctcatatcataacttttcaagatttcattatcattccacaacactgccctcaaaaaagaattttgtaattaccattgagtgacaaaataccaagtagtgacagaggtgtatagacgaactcaaaagttattgtaggaggacactgataaaatgttggggaaaatcacaaaagacacgagaagataatttagagctctatgcccaaatcacatgactccagtctctggctctcttagccagaacagcgaatcttttacaatttacctcttgttgccaataattttctattatcttcaaataataataggctggagtatgaacctagtttatcaatacttttttaaaaaaccgacattcctctcttaaggagtccatgcattctccccattttttagaaaattgttccatgaagaggaattaagtttattcctttgaattctagtctgcatcccagcttttagaacacgggatgcagaaccagttgatttgccacaggccaagtcctgagtctccagcgaatcaagcaattaaccagtcacttggcctttttgcagaaatccacaaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgcgttcacacccggggctcagcccggtgcgccttcacgcgcagcctttttgtttatgcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccgggtaggcttccccgcgctgctctgcgcctcccagcttcccccgtctctccctcctgcgcctccccagctcctcccctccaactctccatcccccactgcccggtgccagcgctcggcttcggtggattctcccgggtctgggctcacgtctcctctgcgcgccttgtgctcccctatcccgcagatacgcaggcttctggagaccctgggtggacgccggaggcaagaaagaagaggagacgccgaaccacgccgcggaggcggtgagtgagccacgcgtctcaggccgcgcctcccacgggtgcagaagatcgaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctcca

SEQ ID NO: 226467 - DNA, 1765 bp, Homo sapiens
cattttgaaaaaaattataacatttatatatcatcttttcctcgatgcataacactttttacaaagtttagtggtagataagtgaggggtaactcaaatcagagaaacaggggtgcagacgtttgattaacttgtctcatatcataacttttcaagatttcattatcattccacaacactgccctcaaaaaagaattttgtaattaccattgagtgacaaaataccaagtagtgacagaggtgtatagacgaactcaaaagttattgtaggaggacactgataaaatgttggggaaaatcacaaaagacacgagaagataatttagagctctatgcccaaatcacatgactccagtctctggctctcttagccagaacagcgaatcttttacaatttacctcttgttgccaataattttctattatcttcaaataataataggctggagtatgaacctagtttatcaatacttttttaaaaaaccgacattcctctcttaaggagtccatgcattctccccattttttagaaaattgttccatgaagaggaattaagtttattcctttgaattctagtctgcatcccagcttttagaacacgggatgcagaaccagttgatttgccacaggccaagtcctgagtctccagcgaatcaagcaattaaccagtcacttggcctttttgcagaaatccacaaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgcgttcacacccggggctcagcccggtgcgccttcacgcgcagcctttttgtttatgcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccgggtaggcttccccgcgctgctctgcgcctcccagcttcccccgtctctccctcctgcgcctccccagctcctcccctccaactctccatcccccactgcccggtgccagcgctcggcttcggtggattctcccgggtctgggctcacgtctcctctgcgcgccttgtgctcccctatcccgcagatacgcaggcttctggagaccctgggtggacgccggaggcaagaaagaagaggagacgccgaaccacgccgcggaggcgatgcccgatggccctggaatgaccgcagcctcaggaaagctttaccaattcaggcacccagtcagactattttggccaaaatcaaaatgttatgattacttatatcaagaagcagaagctcttctgaaaaattttccaattcaagccacaatttcattttatgaagattctgatagcgaagatgaaattgaggatctgacctgtgaaaattaatctgattagctacttttgattatatccaaagcttgtggggtttaaatttagtgtacaaatgtatcataattattttaaactaatttatttgtatataaattattaataaaatgaaatattttgtaaaattctggta

SEQ ID NO: 226468 - DNA, 650 bp, Homo sapiens
gagaccctgggtggacgccggaggcaagaaagaagaggagacgccgaaccacgccgcggaggcggtgagtgagccacgcgtctcaggccgcgcctcccacgggtgcagaagatcgaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctccagatgcccgatggccctggaatgaccgcagcctcaggaaagctttaccaattcaggcacccagtcaggtgagtgacaggcctcgccgaaggtctcccgctcctccagccccagggaggagccaggggcatcgcgcagcccagctccgcagctggtcctgcagtctctctctctctctctgaaaatctggcttcaaggttacttatcttctcactcatcaaattgaaaaaggtaggggctcacggtcccacgtaaagggactgttg

SEQ ID NO: 226469 - DNA, 522 bp, Homo sapiens
ataatgagaatgatatattctcgtcaatactttgtaatctttagcaagttatttagcttttctggtcttcaaatccttataggagtaggggttggggacagcttggcattgatctctactgtcttttgcaataattttgtctctagctgcatgtggaatcacttctattttaatttatgtttctttctttcttttttcctatcttccacagacatgaaagccatttgcagcaaagactgaaccaaccaacatttaaataaaatctgagaacaaggccatttctaaaataagatacaaaaccaggtgaaaggccagtattgctctgagaagagaccaggagaaaaagaaaacactcggcactaagaatcattcttgtgccaaactatgaagagaggaaagctatataaggaaaatccatgagcttggagttaatgtttagtataacaaaagtacattcaatacacatcaacctagatagctacaaaaatggctctttggaaaataaaaagcaaaattgaaaaa

SEQ ID NO: 226470 - DNA, 462 bp, Homo sapiens
cttccaaaaatgtgatgctgaccctacctagcatttgctgaatgtgcagtattagctgtcccgtaaacaccagctgggttattcattacatactcagctgtatacagtagctgaataaaacaggttttttaaaaaaaaaaccacacaggaaattttctgcatgtttttctcttccttgaagattaaaatgagttgttaggattgccattgtagcaaaagggaagttgtacttccttttttgggggctttatgggtttatttttgaatatcttttcaagttcttttacctttgtcctaaggaacctattttcacagcttaaaggactaatgtttctcttctcttagtttccttgaaatcagattgtgtgtttgttgtaagaacatttagatcaagcttgtccaacccatggcctgttggccccatgcgccccaggatggttttgaatgtggcccaacacaaat

SEQ ID NO: 226471 - DNA, 500 bp, Homo sapiens
aacccactgcacttcctccatgaagccttccctgaccacacctccctgccttcttggggactttgctcttcagctctctcgtctgccagactctccccagaagcatcgtgggtgcagcagaaatgacgtctcaggagcagtgagcgcgcctggggctcaggtcgtcctttctaagcaccatgctccacaaactaaccagggctcccggaggcggtggaaaggctgcagagggcccctaggcggctagaaaggggctcagaacggtggagcccccgagaaggcccggggtgctgggggtggctgcctagtgggccccggttttccttcaggggtggtggagatattcgaagctggataaaattcggggggcggggggcagacagcactgtccaaggtgctcggggcctctgaattggacgcttgataatgtaactttatcttctgtaaacttcacctcagtaagttaagaagaaattaagaggaagtcagctggagaccca

SEQ ID NO: 226472 - DNA, 303 bp, Homo sapiens
tgcagtgaggtaactactagctacatgaaactattgaacatttgaaatgttactactgttactgaggaactaaatttttaattttacttcgtttaaatgtatatagccacagtgtaggtctagtgcatgatatggatgaacttctctacagagaccatttgtatctatctttaggtcttcatagttaagacatttgcctcagttaaaatagccccctagcagagcctaaggaggttgaggctgcagtgagctgtgatcgtaccactgtactccagccagggcaacagaatgagaccctgtctc

SEQ ID NO: 226473 - DNA, 640 bp, Homo sapiens
taaaattgtacagaaggaaaaagaaattcatgctaattttgctgtcatacctcaaactataaaagttatggccacagtacatgataagtgcttagttaagatggaaaagatattcaatttgtagatagaagatgtgaacagaaatatgttccgattgatgacaatcaggtttggtactatctgtggtttcaggtatccactaaaggtcatggaatatataccccttggataagggggaactactgtatagatagagatggagatggagatagagatggagatggagatggagatagaaatagagagagagagagatagaagtataggtatacctctctttgtgctttgcaaatgtgttttttacaaattgatggtttgtagcaactgtgtgtcgagcaagtctatgagtgacagttttccaacagcatgtgttcactttgtatctttgtgtcacattttggtaattctcacaatatttcaaactttttcatgattattgtatctgttatgatgatctctaatcagcgaccttgttgtgactattgtaattctcttggtgcaccatgaactgcactcatgtcaaatggcaaacttaatcaataaatgtatctgttctgactgctccaccaaccagccattc

SEQ ID NO: 226474 - DNA, 355 bp, Homo sapiens
gcgttggcaggcccggggtcagatcctgattcagccagttaattgctcgtggatggcagagctgtgtgttgtccgtggtcagacacacaggaagtctgaattgttatcctgttctgccactgaaatgtgtaaaatatagggggagtgtcccaagtcattttcctaaaagcatcatccaactatgagctgaacactgccccgagaatgcaacagaacttcagctctgtcccaaggtcgtcagccacagctccaagtttcttagcatcagctttttctgaacaaaatagtgcatcctgctggaatcactactgtaaactgagtataaaggaaaataaaccctctttttcttatccac

SEQ ID NO: 226475 - DNA, 303 bp, Homo sapiens
ccaattgccattttgagaatggtatttaaatgatgataaagttgtgtaagcattttgatcaaatccacagccaaatattcttttttaattcaactgaatcatctagtcacttcataatctcgttgctccattggggaattcaaccaaagggttgaaaatacttgagtacctacattatcttagctactgcagataaaataaacaacgataaaggaatacaagaagtgacagagtagagtgtgtacacaaagtcagtgttatgaataagatccctgatcatgatattgaaagcgaaagaaaaaa

SEQ ID NO: 226476 - DNA, 286 bp, Homo sapiens
tgggggccagcgtgaggattgaaggatatactgtgtgtaggtatatcctacaatataggatcatttgaggtcaggagttcaagaccagcctggccaacatggtgaaatcccatctctactaaaaacacaaaaactagccaggtggtagtgacacacgcctataatcccagctactcagaaggctaaggcaggagaatcgcttgagcctgggaggcagaggttgcggtgagccaagatcatgccactgtactccaggctgggtgacagagcgagaccctgtctcaaa

SEQ ID NO: 226477 - DNA, 188 bp, Homo sapiens
cacaaggaagggaagttagaaggaagggccagttgttttttcaattttgaatagggtggttgggtcaggctgggaaggcgacatttgagaaaaggcctgagagaggtcagggtgtgaactgtgcaaatatgcaggggaagaacattctaggtggagaattcattcagtgcaagggccctgaggcattg

SEQ ID NO: 226478 - DNA, 328 bp, Homo sapiens
tgtatgttagttttggatcattaagccactttgttactgcactggcttcctgaaaagccaaaaaagtgacattcacaagtcatgcttcgttgtactagcaaaggaaggacatgctgtaacctcacgtctggcgtcccggcactttgggaatgtcaacatttatcagccttgttcacatctagtcctcctccaacaaagtaagcaattgtcccctgaactcgggaatctcatgccagtttgatgatttggcattggaagctctgggtgccatagccactagttgtgtaacaccgactcaccataaatagcaccatttatttaggatcta

SEQ ID NO: 226479 - DNA, 262 bp, Homo sapiens
cgcacccggcccctcattttatttttattgtctcatttgagccctcacataacagatgacatagataggttagggtttcttattgtgttttctttatagatgcataagtggaggctcatggagcttatgttatttgcctaattgcatgcagttggtaagttgcaaagtcaaacttaaaactagaactatgaactccaaagtcagcagtcatgctctttctaactgcattataccatctacaagaaaagatacaggctgaaaa

SEQ ID NO: 226480 - DNA, 650 bp, Homo sapiens
gaaaacggccgccagtgtggtggaattccataagcccaggagttcaagaccagcctgggcaacagaatgagacaccatctcttttaattaaaacattttttaaattaaaaaataaaatagagctggaatagaaacaatgccagaaaggtaaacaaaagacaatacctgaaacaaaattcgtcctactactgaattttatttttgggggttggggaggttggatttgtgtattttcatggcagatggctaaactgtgagtgattagtcatcaatctggaaaaaaggctcttgggaaagtatggcaataactaaagaaatctgtaatcccacaaaagttgatcaaaacagaaaactttagtaaatattccaaggtaataaagaccctgtgtggcatacgtatttgcaatatacaaacattcaaataaaatcaagttaccaaaccccatacttatactggactttcttagcagttcttctacattaactttaggaaacgtatacagccttactcagcatcttacttcatacgtgatgaaacagaaacagagatcttattaatacaccttagaatgtaaaatacatgggaaaaaactgacttagtacaagaacctgaagtagaaaatgctaatgaagggaagtaagctgccttg

SEQ ID NO: 226481 - DNA, 583 bp, Homo sapiens
tgtctcacaaccaagaaaattaaagagccatgaacacaagggtgaggttggagtgaaacttcaataagtgaaaggagaaagctctccacaaagaagaaggggcccaaaagagggttgtttttctacaattgaatacatgggcttttataaacaggctagtagggcgagatatttcatttacataaggagcaaaaaactggttaggactaggtgttcatttgcatagagtgcaaattccatgtccttttagcatgcatgcgaactcttagcctaagttactttatattgtttaatttccctttctgcgcatgtgtgagggggtggaattttcattgcaaacgtgctaggttctgtgttactcctcttaggcatgtttaagcaagtctcccacctcccttccctgtgcaaactcccttacctgtgtatgtccccaaaaaaagggaaggaatgtgcttactgaatcctaccatgtatacatgacccttgttagttacacagaaggcatctttatggtggaccttgcctccttatccatccttgcctcctgatctttcaggctgttcctttgttagaaaaaaaaaaa

SEQ ID NO: 226482 - DNA, 306 bp, Homo sapiens
actaagttatcacatccttagaagtgtgcctagcactgcataaagccttctagatacttccttccatggttttgttcaggtttcctctctcagctggaggggtgccagctttactcactcactgctgcttcaagctgctctgagcaaggatcaaaccttggcttctccaggaagaaaagatgtgttatcagatttgcctttgaaaagatctcatggggaatctaaggtgtagaagactcccaaacgatccttcctgggaaggctaccacttattgaacccaactcaataaatgccaatttgtacac

SEQ ID NO: 226483 - DNA, 499 bp, Homo sapiens
ccactatttaacctcttaactaagtattaccatttttatgattgtcgggaatttcagatgaacagtatagtctcatgatgaagtcctatttttcccatatttaggcaggatttattaaaataagcttgtctatgctagacaacattggaaatgttagtgaagatataaaacatatttacagttttaaaatacttggtatttataaagcatttttcttttgtaaagattttaaaaatatattgcagacctctaaaaaaataaggcaactgatatatcttctgtagttctgtgtaagaaaacccttgagtggtctaaagattgaaaacaaattgaaaaaaaaaatttgtctttcggataacttattaaaaatagggtttcccaggaaattacagctgcaattgaatatttccatataaggcagttgaaaaatatatttaaactgtctcctcccctcaaaagcctagatttatggtgaaaaaagaaaaatgtaaacaaaacc

SEQ ID NO: 226484 - DNA, 157 bp, Homo sapiens
tctaattagatgagaactaaaacatcctttggatttggtaacagagttacaactgcatttttattgaaaatgaaaatgcttaattgagagtgtatataaacttctaggtaaagatggcaaattgaactcatgcatctaattttgcttgttcctgatg

SEQ ID NO: 226485 - DNA, 361 bp, Homo sapiens
gcagccatctagattcttctggttctcattaatctgattctccttcaaaacagatttatagatccttataggaacattctagaagagaataatatacattatgccaaacacatctacttatattttgaaatgttcccactgtatttttttatttgctgcctgtggcctgtgtgtccctgtgttctctatgggatgccctttccctcttccacatcagctgcttttcctctgatgttttcttatttgccgtttatcctatatgtagaatgcaagaattattcacttccttctttatgccccacaggtctttgctcatactagaatagcatttattatcccatgttgtagttatttaaacaca

SEQ ID NO: 226486 - DNA, 517 bp, Homo sapiens
atcatttggtctcaggtctacaatgctaagccaaaaagcaagacttaagcatttggcattaggcgctgggaaattcagagaattaaaagtatcttctacctatgactccttcatattaggaaagaagactgatattctttagtatgcatagatctaatgaaacttaatggctcagataaataaaataaaaacaagatcataagccaatttccttccagaagacctaaaaaactccaccaaaattaaagaatggccatgctgttaaaattccgttgtctacaaacactcattgtttcaaaaacattgatcagaattgtacttggccaatgttactggaaacattttttcaagacaaatcagggtttaagaggcttctaataagttagttgtagtatatgaattgtttaagcccttattaattataaggtaacattaggttggtttattttcagagtcatcaagaatgcttatggaaagttgagatttgcataagcattcttgatgactctgaaaaaaa

SEQ ID NO: 226487 - DNA, 415 bp, Homo sapiens
cagctggggtgaggacccctcacgtggggagggaaagtgggggaatattagtttctgatacaacgagagacaagagaataattctacgaggccgtgtagaacaagcagagagagaaaagctctttgagtgcaacaaggaatggggttttaaaatttcatttgcacagcggcaggtcttgccaattggatcctttccagaaagcaatctgctaagtctgacagtcggaagaaatgccgggctgctgagcgaggagaggctgggtttttttaagggtttatttttcatccaggtcctttgtgagcaatggctttttttttttattccattttaaaagaaaaagacacgcagcgatcctctttgtgaggcgggaaagggcttccctgaccatctgggcctcagagggactcggggaga

SEQ ID NO: 226488 - DNA, 518 bp, Homo sapiens
gttgtcatttctcttgttgcttatgcattttcctctagtagtcttctcttccctgtcaggtttatgagcactgtttttagtggtctaggaaaatcacataatctagcttagtatttatagcattatttttaaattcagccagtagtcaactttgagtaggatttctgagatgttttctggagagcaaaagaggtgtgtatcttagtacgaagatcatacctttaattatgtttcctcagagtctttttgagtagtcgttgtttttagatttctttctggctatttggagttgtcaaataagtgactttgagtaaataaaacgttaatatatttattacaaaaatattagccatttctgttattcaagttaagtgctcatttcgtaagactggtgctcatttagatatataaacatatctttagctgtgcaaagtaagatatttacctcagtgctttatctgtcagaccacaacatatcactactggttaaatttgaaatgctttttaacctttttaag

SEQ ID NO: 226489 - DNA, 186 bp, Homo sapiens
agttacttgtatgcagtgacaaaagggaaaataccttacactgtctttcttttaccactgagtccatgacatacctccctctcctctgatgcctcagcctcccactgagactcaccagtggccttggtatgttcaatcaccaaggctctgggataccacctcctgccacaccatctctggccatgc

SEQ ID NO: 226490 - DNA, 619 bp, Homo sapiens
gtgcctccatagtatcttttaggcttaaattatatcattctaaaagtatattaattttaataattattaaaatttaattttaattaagtaatttaataattttaataactgctggaatctaacattgaaatttcctgaataaaatttgacccctagaatataaacagattttttaaaaaatgaattttgaagagtatttttttttttaaattaagattagagtatagcatacaggcttgttctagctctaaaagtccaaggctttgacccctggaatataaacacattttttaaaaaatgaattttgaagggaatttttttttttttaattaagattagagtgtagcctacaggcttgttctagctctaaaattcccaggctctaggactgttttttgtaaaaaaaaaaatatacttgaagcttgtcttttttgaattagtagttgtaactatagagttaatggaaaagatcttaattattagtttcatgttgtcattagttatatgtttcaaagtataattttaaataatattagagcataatgtagaaaatagtatacccctacctttaaatggcattatattgaagatacacagtaaaaatttagaaataaatgga

SEQ ID NO: 226491 - DNA, 909 bp, Homo sapiens
cattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctcctgtgctccactgtcccatgtaattccatatatgaagctaccactgtacatctctcttttccggtgcctgttgagttgcatagaagcacagttgtgttctattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctatacctaacacataatatgtccaaatggatgaagaggaggcaaggacaaggatgtgatgacaaaacattctgttatgcacttgtagcatttatgtttcttcctgggggattttataatactaaaagaatcataatataaagagatgatt

SEQ ID NO: 226492 - DNA, 252 bp, Homo sapiens
agcccacgttctaaaccattaggctcattctgcctctcttggagaagacacaagaagtcccagtcttggctagcctggctagttccagagacctccatagctaaacaaggtgtagaaatagaatgtcccgtcacttagctatacttctatccttcccaccttctacacaactaccattaccattgccaccagcaactggtaaatattgatggagcttcttttctttgccaggcaccatagatacaaaaacta

SEQ ID NO: 226493 - DNA, 481 bp, Homo sapiens
tcactgttccacaagggctgacacacaggctttagccaatgtttgttgacgaaagaaatgagaaggggacaagaaagagggtgatggcggagtggtggaccaggtgctgtccagagggtgatgacagagtggcaggccaggtgctgtccagagggtgatggcagagtggcaggccaggtgctgtccagagggtgatggcagagtggcgggccaggtgctgtccagagggtgatggcagagtggcgggccaggtgctgtccagagggtgatggcagagtggcgggccaggtgctgtccagagggagagccggggtggcaggaggggtgcccatctccacatcctcctctgagctctgtgacccttgggggctcagccgctccttcacaggcacttctagaatgttgttccaaatcattcttgtaattcttctttctagtatatgtttaaaaattgtcataataaaaagtgtgataaatcaat

SEQ ID NO: 226494 - DNA, 450 bp, Homo sapiens
cagaagagttttcccagtgtcccgggagccattcaacacagcatcatacagaatgactgtggatctgctgtgcttagtttctttacttgtgaaaacagagtaatagtagcacctacctcacagggttgttctgaagattagaggggttctttcatgggaagctctagagcagtgcttgagacatggatgaaatgccctgagttgggtttagcaacttgaagaccattggaaagattgtccctacaacaaaaccttcaatctacaagatttctccctccccaatggcatgttgtgtatccctggctgccgtggactatttctggacttgtttcatgaaactaacccctagtagaactaagaaacattttaggagagaagtttacaacagattaaatgataaacctaaaaaatgaataaaacatattataaaaataaagaggatagacaaaa

SEQ ID NO: 226495 - DNA, 409 bp, Homo sapiens
agcatgatattcagagtgcgccggcgtccagcgcgagcgcatcctacgacaaccccgtctcccgctggggtccgcagcccgcggactccggggtccccccgcccaaatgcggcggcgcgaccgcttcgtcccgcggccagggcgctccgcgtctgctccggccaccccagcccacccgcgcagcgcggacgccaacgcatcccactcccgctgggcgccaggggcgcggggttcagtggggccgcggcccccgcacccggctgggatccgagggcggggtggtcgcggctgacgtgggctttgcggctccgggccagagagcagcctgggggacggtgggtctctttccggcttgggagggaacgggggcgcccgcgcgggaggacggcaggcgagggacggcggccgc

SEQ ID NO: 226496 - DNA, 519 bp, Homo sapiens
gatttgagggtaccagcgattgaatggagacacccgtatttattgaccatgataaaatggttgtgtgagtgaaagaactcaaacatctggtacctccctcacagagctcacagaaaaataatgatgagaaccgtatcttgtgcttggtgttaatgtggcaacaagttgtacaggcgttcagtagaggaagatcaggtgatcacagtatggtgctggccaaaggcagcttccttgaggtggtgagattctaaggctaaaataaataaaaagttatatgctcagtatagaaatcttggataatttttaaaaagcctaaaagaaaaaatggagtattatcccaccaaagataactgctactagtattttggtacatgctcttccagttactttttactgtattatataatcaaaatgaaatcttattatatatttgttgttttgaaacttttgtttttagcaatatgatattttcctgtcaataaatcttcaaaagcataaatttttttacaatgaaaattg

SEQ ID NO: 226497 - DNA, 682 bp, Homo sapiens
gttggtttacaaccacaggtacatgacctcaaaaaaatccaatatgtaaatatttaatacaggaaatctttaaccaactctatgagctccctaaacaccctaacactgcatgcaaaattttacttatgtatgatttctttctcagaagaatgccatactttttatcagttctttataaatgtgtgtgactggaaaagatgaggcaccgttaatttatagaggtacttactcacataaaaggacagtctttccttactaacattctatacattttctctaagtaacctttaaagaaaagcacattaagatattccttgactctaaaaagttgaaatagaacagtacacaggtatacagatactttgttctctcaaattcccactccctacctgaaacaaattcctgctctagaagaccttattattcttaatgttaggctggatcagtacacacaagggcctcacctgcacagcagatgaagaatggcttacctccacactcctacctcttttttgtcatgaattgtcttgaattatgtgcatgcttatatacaccactgtttcacaaaatgtaggtattgtgattcttgaaaaatttaagtaaaattattttcaagcttacgtttttttacggtcatgtgttgcttaatgatgggcaccgttttgagaaatgcatcctttgg

SEQ ID NO: 226498 - DNA, 130 bp, Homo sapiens
aattggaccttataatctatctgttaagttcctgttatacctagattatatcttggttcttctgcttgaatctcaacatcacatatttgtccatttaaagtcctttcaaactgagctcttttgcaaacag

SEQ ID NO: 226499 - DNA, 517 bp, Homo sapiens
ccagctttgaatgtgacccaacacaaatttgtaaactttcttaaaagattatgagatttatgcatggaccttttttttttgagcccatcagctatcgttagtgtattttatgtgtagcccaagacaattctaatgtagcccaaagaagccaaaagattggacacccctgctaggccacctttttcagaatgggtgcctgataaaaatacagaggacttcctgggccccgtgctgctgaaacctccgggcctgctcctcccggggaatctgtatttttcaccaccaccctggtgattccaaggtctactcgagttggagacccatttattcaagggctgtcaagtgagctgtctatacaggactatcaggcccgagaacacccccggaagttagcagggccaaggcgaagggattaggcctgggcttcgcgttggcctccccggtccacggacgaggttcggggcgtgggggctaagcggggcggagggaacccccaaatccccgggggcgcggccgc

SEQ ID NO: 226500 - DNA, 460 bp, Homo sapiens
ccactccactgcacccagtgtggccgtacacctgtgctgaacggccagagacttcctggtcaatactcccacagataaaagactgcaggatctgcttatacacaaatccatctttcgctgggaacccacaactcataacaactctcctaatgccaagtcatcaaggcctcttgaaagagaatcataaaaaacaaagaatttcaaacttggaaggaaacctaaagtttactggtgaggagcttgaactgagtagaagcaaagaatcatactccagatgagaaacgccccatgcactgagctgagactggaactctcctcttcttactctcagtccagtaagtttgactacagagcactcattatcattgtgattattatgttcccgcatattttgtcgttcttagttaggcatactcctttaacactattgtaataaaagcaaaatctggaagatctttaa

SEQ ID NO: 226501 - DNA, 640 bp, Homo sapiens
ggacccacaagtaaggaaagtattgctaccattcaattttcacattagtcaaccgtatacttaggaaagaaaaactttccttttgttctatttactaggaactaaaatgattttactggagaagacattaataaattagtaagtgctcacatattccatatatatgagatttcatactttcctaccatattttggttgagttatatttattctccaaatttatggcaacctgtgcagaaaaccacaggtaatattatgtattagagccaagattttttggcccagaaatggtaaaatcctcctcattcacacacacacacacacacacacacacacacacacacacacacgcacgcacatagacacacatatgtatttgggattattaaatatcttagctatatagaattgaatgaacatactatgatactatgaacttagggtcttaatgaatcaaaggatgttgtttctagacatgttatataaaacataattatttaaaaacaatgaaaaataccgtaaaccacttataaaataccaaagaagtgtgcgaaaccatctgtgacgtgaatgagtgtgaggtggaacattcttaaatattgtttttccttgagaagttatcaacaatattgatttccta

SEQ ID NO: 226502 - DNA, 270 bp, Homo sapiens
agccacatgttgaaaatcatgagcctacattagacttagttgcctgcacagaggacagttccctcatccccaactccttagccaattgggcaaaataggaatacaaaatcaacttctgttatcatatggcattaggactcaagggtttatttattactagcattgctggtaataaatatacaaatacaaaaaaatacaaatacaaaataatgatacaaataatacaaatatatttgtaataataataaatacaaaataattaaaatacaa

SEQ ID NO: 226503 - DNA, 354 bp, Homo sapiens
ggacattaactgtagcctggaagtactctacatgtacctgtggtggtagtggccgtagagtgaggttcctctgcctttgaaatggggaggaaagagtaagaaagactgtatctagtggtttgagtcccagctcatctgcagtacaacagaatacgaggtaggcttctaagattattgaatctagtcactgactctgaggcagcacctctggactgctcagggactgggggatctcaccaccctgaagggaaaacaggcctggcttgcattgccacctattgattgtagagcctcatggctttgattgaatatactcattggacagggagtgattacagcagaccataaataaaa

SEQ ID NO: 226504 - DNA, 524 bp, Homo sapiens
agctttttttcttctctcctattttttcaccccaccctcatttcattatgaaaaattcagacataaaagtaaagagcataccataatatacctaccaccgaagtttagcagataatattatacattattggctgggtacggtggctcatgcctgtaatcgtagctcttttggaggccacggcaggtgtatcccttgaggccaggagttccagaccagcctgaccaacatggccaaaccccgtctctactaaaaatacaaaaattagccaggcatggtggcatgcacctgtaatcccagctactcaggtggccaagactcgagagttgcttgaacttgggaggcagaggttgcagtgagccgagatcaacagagcgagactgtctctaaatataaatgtatataaatataaatatatatatatataaatataaacatacacattgcattatttgcttcatttgtttaattttttttctggagaatctgaaagtaaattacaaataaccactgcagcttacatctc

SEQ ID NO: 226505 - DNA, 328 bp, Homo sapiens
gagatggagtttcggtcttgttgcccagtctggagtgcaatggcgtgatcttggctcaccgcaacctccgcttcctgggttcaagcgattctcctgcctcagctactcaggtggccaagactcgagagttgcttgaacttgggaggcagaggttgcagtgagccgagatcaacagagcgagactgtctctaaatataaatgtatataaatataaatatatatatatataaatataaacatacacattgcattatttgcttcatttgtttaattttttttctggagaatctgaaagtaaattacaaataaccactgcagcttacatctc

SEQ ID NO: 226506 - DNA, 362 bp, Homo sapiens
aactataaaacaaaaatcacatttttgatgccttagagctggatttttcagtatttcttagaaatggaacgcttcgtcacacggaactgtatggaatgccactagcaaagagggagaagacaagtcccctggtgaggagccggagcccttgtattcgcttctgcctgctgctgtgtggcccctctgttgcctccaaatgtgaggctccccggggtgcggtttaaaaactagtgcccgttttcaaaattcataccagcagaaccaaatgcaatttatagccaatgccaaagcaaagtggtattttattaaaataaatatatgaaaccaaagtgaaaatttaataaagtaaaatttagtttaca

SEQ ID NO: 226507 - DNA, 212 bp, Homo sapiens
tctcttagatgagtgatgtgcaggtgtgtttgggagtggaaatgggaggctgttacaaaacttaagagcaagaatagaaggcatagagtacgcattattaaataaaaggcagtaggcatcagaaggatatatgtgtttcagtgtatctgatacttgagtatttgagtaaatttgtttttgattactgatatacaaatatactataaattctg

SEQ ID NO: 226508 - DNA, 198 bp, Homo sapiens
ctttcatgcaacaaatcaaaaggatttacaccattattatactacaaacattcatcatgctctttaacacgcccaataactgagaaggcacacaattgcgacgatgcttcagttgaacttatacttcacatctcttccgtggaagtgtcctacattgatcaccttggatacctctttgcgtcgactacctagtacata

SEQ ID NO: 226509 - DNA, 183 bp, Homo sapiens
acctgcagttctttgattttgatttttgcattttctttactgtttcatgtggactatgggctgtaagctgcttacattgaatctttcagttttgcttctgtctgaatttgtctagatgaaaaatactagactggctcatatgaaatgataaaattgtagaccagggtagcaaactatggcctg

SEQ ID NO: 226510 - DNA, 104 bp, Homo sapiens
gagggaacattggctttatacggcagcaagtaatcaaaaaagccttcacttgtgagaaaaaatgcttggtatggtacaccttacttaaataccagatgccactc

SEQ ID NO: 226511 - DNA, 828 bp, Homo sapiens
tgctgtaccttgatagaaatagaaaggtcatgtttatggtaattgggacagggtaagagatagaattaattctatattgaacatttcaaattatgatgaataattttgttatactaaatggacaattggctatacttcttcctctgaggctttatttttctttgttttttctcctctttcaggctgaagtcatcgatgtgagttatggaatggcagatgatttaaaaaggattaggaaaataaaaaacgtaacaaatcagatcgcactcctgaaattaggaaaattgccactgctttataaggttggtccagtgaatgttattcagtggtttggtcaatattttgccttgttttgttggaattatatgcttttgtgagtgtggagtgtgtgtgtgcatataggtgtgtgagagagagaaggggagaggaagaaagagaggcagagagtgtcacagaaagatggcttttccacattagaacattttaatttaagatatttaagaacaatatatttatgcccttatttctttagagagaaaataccttaagtcaggtaacactgagtttgtgggaccttaataaaattggcatactcttcataatggtacctatctggaatagtaaaaaatgagaaccaccctgtgttcatcttatgacatatgtgaaacttctaatctattatcaaatggactaattatcatgttctctatgttagacaagtatctagatgatttacaccctttagtgattattttgtcaactatacaactacagttactaactgtgatcaggattttaattaaaatataattgctaagagtagcagaa

SEQ ID NO: 226512 - DNA, 721 bp, Homo sapiens
tgctgtaccttgatagaaatagaaaggtcatgtttatggtaattgggacagggtaagagatagaattaattctatattgaacatttcaaattatgatgaataattttgttatactaaatggacaattggctatacttcttcctctgaggctttatttttctttgttttttctcctctttcaggctgaagtcatcgatgtgagttatggaatggcagatgatttaaaaaggattaggaaaataaaaaacgtaacaaatcagatcgcactcctgaaattaggaaaattgccactgctttataagctttcctcattggaaaaggctggatttggaggtgttcttctgtatatcgatccttgtgatttgcctaagactgtgaatcctagccatgataccttcatggtgtcactgaatccaggaggagacccttctacgcctggttacccaagtgtcgatgaaagttttagacaaagccgatcaaacctcacctctctattagtgcagcccatctctgcacccctcgttgcaaaactgatctcttcgccaaaagctagaaccaaaaatgaagcgtgtagctctctagagcttccaaataatgaaataagagtcgtcagcatgcaagttcagacagtcacaaaattgaaaacagttactaatgttgttggatttgtaatgggcttgacatctccagaccggtatatcatagttggcagccatcatca

SEQ ID NO: 226513 - DNA, 984 bp, Homo sapiens
atcattttttatggctgcatagtattccatggtgtatatgtgccacattttcttaatccagtcgatcatgttggacatttgggaaaagtatttttaatgtttttatcctaaacccaaaataagaagggaaagctgtaaacatttttgctttaacaaaaaggaaatccctttcttagcttttctttcacttctagttgcagttcaggaattttctgtaagtggtgcttgtacctttatcaaaagttctgttaacagttggtgaggcaagaaatatttgtatcaaaaatgcaaagatatgacagcttaataccagatctcagtgttcagaagtttagtccatataggattgtgtatgttatctattttttaaatgattaaatgtatgttttaaacctcaagtaagacacatgttgaaaatatggctgaattgaggctagcatttacagttttgattgatgaaatctgtattttttgatacatttaatagtgccttactgtggtatattcatgtggtaatagcgccacttctggttatatcattgctaaatttaaaatttggaaatttggagtctgtttattgcctccatcgtagaaaattagataagatatgtgattgcctaggatagttttgaaattaatataaaattcaaactaacatttacaaattataaattttttatttagagatgattgtaggttcacatatagttgtaagaaataaaactttccaaactttcaaaatggggaatatttagtatttggtcctatttggaaagagctttaattatttccaagaacttacctgggtttagaaaatgaagttttggttttttaattatgtcctacctgtcaatttctgtttctgtaagaaataatgtagacccacacgcctgtagtcccagctattcaggaagctgaggcaattggaacacttgagcttaggggtttgagatcagcctgggcagaataatgagacaccatctc

SEQ ID NO: 226514 - DNA, 366 bp, Homo sapiens
gagatggacttttgctctgtcgccaggctggagtgcagtggcgtaatctcggctcactgcaacctccgcctcccaggttcaagtgattctcatgcctcagcctcgcgagtagctgggattacaggcacctgccacaacgcccagctaactttttatattttagtggagatggggtttcaccatgttggccaggatgctcttgatctcctgactctgtgatctgcccgcctcggcctcccaaagtgctgggattacaggcgtgagtcaccacgcccggccaatttaacatttttcaacatgtgatgttttcaccttctcccgcatgaatgtaaacaccttgaggtgaactccctgtctgaagttctc

SEQ ID NO: 226515 - DNA, 611 bp, Homo sapiens
acttcccccttgctattcttctgatagagcgctcacaagatctgatgattgtttggaaatgtgcagcgcttccccctttgcgtgcgttctctctctcttcctcctgctccaacatgtgaagaaggtgcttgcttccccttcgccttccgccatgattgcacgtttcctgaggcctgcccagaggcggaagccttgtacagcctgcagaaccatggggcaattaaacctcttttctttaggaattacccattctcaggcagttctttatagcagtgtaggaacggactaatatgccaaccctgtctgagtatgctcagcaaagcatattcggctcagcaaagttgcagtatccaagatcaatctgcaacagtcggttgtatttctacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaatattgttaagatgcccataat

SEQ ID NO: 226516 - DNA, 527 bp, Homo sapiens
agctttattgattcaatttataatatatactatatgaactgagatgacagattcaaaatctaatgtcagtagaacttataaatactaagaatagtaattttgagccatcatgctcaaagcattgtacacattaaagataaccaataataatagctaccgaatgtctctctgtatagggcttttattagttcaggtcttacaaaataattcaaaacaaagcccctgaactataacctcatttgaaaagtccatctttgttttcaaaaggaatgggagtctccagaacagtcagcaaaatgactgttagcacatatttgaacatcattcatattgtcctgattgtcctatgctgatcagccttggctatggacaaagaagatattaaagcaagctggaagacaaggcatggttgacagttaaggaagatgaagtcaacaagagttcagggaaaactgagaccacttgagtcagggaagacttcacataggaaggggggagagacagaataggctctatagaataaatta

SEQ ID NO: 226517 - DNA, 402 bp, Homo sapiens
ccataatctgccttctcttcactctgtgattcaaggccacccctcccacttacactagattccatccccaatgactttttcaagaatttaactccagaagttaaacattatttcctgcattatgaatctctacaccacccccaagcaggataattcattttaggtagaaatatgtggtaatagttctcatttaaaattctgtacatttccagctactgcctcatttactcctctctttatagaagaaagcatcgtttgtctttattcagcatctccactttttctcttgcattcttttgctgttgttttgtttttctgggaaagttctttaatgtttttaatttgttataaaatatttcagactttaaaaataaaaagtaaatatattgtgtcataaaaaat

SEQ ID NO: 226518 - DNA, 171 bp, Homo sapiens
acgtgatgctgtacagaaagatagatggattcttagggtgtgctgagctgtggggactcatgaccccaaatccaccatgtctcaggttacacaggtttagatctgctccctaaagggcagactaactgccctgctgggtcaagttgtcatcagttacatccattagtgctt

SEQ ID NO: 226519 - DNA, 174 bp, Homo sapiens
tcccattcccactagtgcactgcctatattgttctgcctcacctaagagcttcaggactgagctattaggaaggaaaaggaatgaggacaggaggagtctcaatatcatcttaaactcttttgtgttttataggcaagattaagtttcaaaaaaggaaccccaactaatacaca

SEQ ID NO: 226520 - DNA, 361 bp, Homo sapiens
agtggggtggcaggagaggaggctgaggactcatcttacagggctttggtaacaaaggtctgctaaagaactgcagacctaacccataggtacaagcaggttttcaaacagaaaagctacatgatctggtccttgtgcgtgccacgtaggaaagataactagacagcaaggtggacgggagacagtgaggagggagggaaattactgaaaagaccatgacaacagtctggagaggaaaaggaatcaaatgtgattccaagattactttgtaaaaccttggttgattagacgccagctgatgccatcataaaagcaagaggcggagaagaaacaggctcagagggacccttgtcctgctgcc

SEQ ID NO: 226521 - DNA, 451 bp, Homo sapiens
cagttttctaagacagccacaaagtgaacccaagagattaatacgggagggcggtccagagggcttagtctctgagtgaattctgtggtcatgaattgaaagtgtaacaaatcaccaagtcctgtaattctatctctgagtatcttttgaacctgcacccttctctcctccccaaatcccctaccttagttcaagcctcacgtcctccctccagcccagcctcacggcttccagtcttggctcctcgtcattcactttctactcgatggccagagggagcattctaacatgaaatcttttcatgccactctctggcttcaaacatatccacagcttccatgtccttctgatgacatccgaagtcctctccatgctgtggtcctgcttgcccctcagatctaatctcatgcctctcttcttttgccaccctctgcctgatgagagccagaca

SEQ ID NO: 226522 - DNA, 475 bp, Homo sapiens
  misc_feature (17)..(17): n is a, c, g, or t
actgaaggttttttctnttgggaaggccctcttggttttggagagaaagacaagttatgagtagctgctacccctggaacggtgggcagagagcctactaggaaatgtgcagaataaactattttttgaaggaaaaaaaaaaaaaaaaaaccccaccacccctcaacaggcaccggtgtgtgatgtccgccttcctgtatccaagtgttctcattgttcagttcccacctatgagtgagaacacgcggtgtttggttttttgtccttgcaatagtttgctgagaagacagggtctctcactctgcgtctcaggctggagtgtagcggcaccatcttggctcagtgcaacctccgccttccatgctcaaatgatccttccacctcagcctctggagtagatggaactatatagtagatggaactataggtgcttgcctccatgcccagctaattttttttttttttttttttttgg

SEQ ID NO: 226523 - DNA, 479 bp, Homo sapiens
ataacataagggatgagagggagaattggggaatattctgctataaggtgcttgcatggtatagcgctagtagaaagaggacttaggtaagttgtaagtgtatagtgcaaacttcagggcaatcactaaaaacgttttttaatttagaagtataattgatatgataagagagaagagaaaattgaatcgtataaagtgctcaattaaaatcagagaagggagaaaaagagaggaagactagaaaagaaagaacaagtgcaacaaattcaaaatgaaacaaactcaggatggatcatggatctaaatgtaaaatgcaaaacaataaaatttctagaagataacaaaggagaaaatctaggtggccttcagtttggtgattattagaataaacaccgaaagcacaaaccatgaaaaagaaactagataagttggactttattaaaactaaacatttctgttatatgaaagaatcattaagc

SEQ ID NO: 226524 - DNA, 936 bp, Homo sapiens
cagtctatgtgtaaaccaaagggttccaagggttttggccttccaactatttttgtgtgtgtgtgaatatgacagcactgtgcacctcacctgcatgctgggaacagtgatgtgcccctgttctgccccaagtactaagttgggtccctctggccaacttagtacttaattctcctgccctggctgctccctagaaaccctggctctgattgctgggcccacactgccacctagcggtgccccctctcatgccctcactagccaaatttccatagattcttctcttctaggataatccctctcctgcaccccaggattgaacttactgcaagattcccctgccactccctacccagaacaatcacaagatgaatcacaagaatacacagcagtgccttcccaaaagtctcgctcatttggcctccatcctctcaccatgtacagcctcccctctccagtaaggacagagtgtgtgtgtgtgtgtgtgtgtgtgtgtgtgtgtgtgtgtgtaggatttagcccccctcactttaagctattccaaagtctctgtccccttggacacacagctacatgaagggctgtgtggcagagtctgccatcatgaacccactcctgaccagacctagccatcctgcatgccaaatcctcccatcattgtggaggggatgctgcaggtggttgctggaacatgagcactaagggaaaccacatattctgactttcctgggctaagtgagtagtttcaaggcatctctccgatggacccatgtggggaatgcgtgtgcctgtggaagcatggacactggttatagggactgggaggggagaagcagcacctttgccttacttttcatacttctgtataatttgaattaattacaatgaggaagttttacttatgcaacttaaaattttaataaaagagaccagctt

SEQ ID NO: 226525 - DNA, 352 bp, Homo sapiens
ctgggcgggccaacagagccaatgtgatgggagagaaatgctacgcacctggggcttaacctcgagcagctgtgtgggctttatcaggccaacacgacgctgaagaacaacagaagacgtttttgacattcggctttggacttggcaaacagggctggactgaacacgtctcagggacacactctggccacatccttgctacatccaagcaaaggctgcctggagctgctgtcagggtctttgctgggtctctagctattcttgtgccactcacaccatgtttttaaaaaacattttttctttaaactttcttacttaaataaaatatattttaaaatgaaacctaaattac

SEQ ID NO: 226526 - DNA, 434 bp, Homo sapiens
caggaatacaaataagatgaagttcactaagttctcagacccaggagtgactagggacatggaaaagagagcagtgataatcaaactctccatccctccacatctggtaaacctccctttccacaatgccatgattttgtgcaattagagaagcagaaacctgcaaattcactgtctgcagataaatggggccatttcaccttccctggtacctcacagatcaggtagcaagtgatggagcatttctacgtgtatccaaacctttgcaaaatgggttgccatcatttccttgtaatggatagacaaagtccaggcacttctttggcacccttatagctttgaaaagctgatgctgatgacttcagtgaagatagcattgttgcataatgtccacaaatcattgataataaaaatataaccaagaacatgacata

SEQ ID NO: 226527 - DNA, 683 bp, Homo sapiens
ggagcgtcctgtgagggaggggctgcactgccactttactgatgaggaaattaaggttcagagagatgaggtcatttgttagaggccagacagcctcctcagcccatttctaaggttgtttctgtggtatttgccataaagccataggttcattgatttgttcttaagtagttctgagcccttcctgcatatcaggcagggacaaacaggaaagtccctgcctttggcaagtgcgggggaaatgaaatgattctgctcagcctcatccattggtctgaacaatcacgtctcatgaccgcagggacacggcttcccctgaacgcggatcctagaggccaggcagaagcagcatgggtttccactcacacgatttatctactgctcgtgaaatctctggatttaactctgatgaaagactggaggctgaaggagaacttcaatatcatatattttaaaggttgattcacagtttggagcaagaattaaagaaccacgaacttcaaggtgatgtaaaattctcaaacaatgagatagataaaaagtacgcagccaaaaagttcaagaagaagtgttatggagatggagcaggcccttcgtaaaaacacgatgttggttttctggattttgtatgtttgcttttttttttcctcatcctaaagaaatattcactgtcatacctaatt

SEQ ID NO: 226528 - DNA, 585 bp, Homo sapiens
tgcaatttcgtctggagtccgcagacccctcctcatccttcccagggttgctctgaggccattcctcgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaaggtaaaacgggcaacggcgttggggcaagcctctctgcatctgcgtgtccagcctctcctgcatgccagaagtccccaggcaggagtgtggtgggacatccggctgggtctggataaagtgcttcatgcctgtaatccaagcactttgagaggctgaggcgggtggatggcttgagcccaggagtttgagaccagcatggaaaacatagagaaaccccatctcaatataagaagaagaagaaaaagaaaaaaaaaatcaaaaacgaaaacaacacaaattttagagtaagt

SEQ ID NO: 226529 - DNA, 381 bp, Homo sapiens
cggggtcgggggaagcagcacgggatcccagcctcaggcctgcccggacggtgttggttgggagacgaggtctcactatattgcccaggctggtcttgaactcctggccttaagcgatcctcctgccttggcctcccaaagtgctggagttacagatgtgagcctctgtgctcagcccatccttggctgttcaagtgtagaggtgatgtaaaattctcaaacaatgagatagataaaaagtacgcagccaaaaagttcaagaagaagtgttatggagatggagcaggcccttcgtaaaaacacgatgttggttttctggattttgtatgtttgcttttttttttcctcatcctaaagaaatattcactgtcatacctaatt

SEQ ID NO: 226530 - DNA, 908 bp, Homo sapiens
ggttaggtctgcctgccacacatcacagccagcgtttctccaggcacttgccaccttctcttcctgtcccctggagaaggtgcagggggttgggggagattcgtctccctccattggtttctgggccagtgccctctgagggatgatctgtgactccactttaggaccccgcccgataggtgtttcataacagctttctctgagatgtgattcatataccctcaaatcaccctttaaaatgtgtcattcattggtctttagcatgttcacagaattgcgcagccaacaccatgatctaaagttggtgcattttcatcccccagaaagaaaaaccgtctttttagcagacaccccaccgtccccggtccctgctgtctgtgtctgtggatctgcctcttctgggtatttcataaaagcggaatcaaaacacgtggcctctgtgacgggctcttctttccgcgtggtgctgtcaggacgtgtcctgctgttgcgagtatcagcacttcactcccgtggccagatgaggtgctggtgtgtggatgtatgacgtgctggtgtgtggatggatgacgtgctggtgtgtggatggatgacgtgctggtgtgtggatggatgacgtgctggtgtgtggatggatgaggtgctggtgtgtggatggatgagatgctggtgtgtggatgaggtgctggtgtgtggatggatgacgtgctggtgtgtggatggatgagatgctgttgtgtggatgaggtgctggtgtgtggatggatgagatgctggtgtgtggatgaggtgctggtgtgtggatggatgacgtgctggtgtgtggatggatgagatgctgttgtgtggatggatgagatgctgttgtgtggatggatgaggtgctggtgtgtggatggatgaggtgc

SEQ ID NO: 226531 - DNA, 825 bp, Homo sapiens
tctaagccgggaatggtaaccagtcaaatgaagagtctgctgtgggtggggagggtgcaaacagattccctgccctgggcccaaccgctggaggaggacatgaccatagccttacagtgggacccggaagatgctggtgactgaaagtctgtctgcggttattggcaagagtgactggaaactgtgaaacactaaaaacaccagcatctggtgtttgcagagcattttcctttgacgaagaaagaaaaaccgtctttttagcagacaccccaccgtccccggtccctgctgtctgtgtctgtggatctgcctcttctgggtatttcataaaagcggaatcaaaacacgtggcctctgtgacgggctcttctttccgcgtggtgctgtcaggacgtgtcctgctgttgcgagtatcagcacttcactcccgtggccagatgaggtgctggtgtgtggatgtatgacgtgctggtgtgtggatggatgacgtgctggtgtgtggatggatgacgtgctggtgtgtggatggatgacgtgctggtgtgtggatggatgaggtgctggtgtgtggatggatgagatgctggtgtgtggatgaggtgctggtgtgtggatggatgacgtgctggtgtgtggatggatgagatgctgttgtgtggatgaggtgctggtgtgtggatggatgagatgctggtgtgtggatgaggtgctggtgtgtggatggatgacgtgctggtgtgtggatggatgagatgctgttgtgtggatggatgagatgctgttgtgtggatggatgaggtgctggtgtgtggatggatgaggtgc

SEQ ID NO: 226532 - DNA, 691 bp, Homo sapiens
aatttctgtggtgtacatacatccttcatggcctactttaaacttccagcagtttaacaactgacttgcaagatgcctcataagctggcacaaggcaactctagcacaccaatgaccagttgccacagttatcatatgtagttctgagatttaattccttttgtggcagaattaccacaggataatgatgttgtaaaaacatcacagctttaagtcaatctatgaagcactgccaccattgcctgatactaccatacatccaaacatttaacgcacttcttcagtccctattatgtcccataaacaggtcagaaggaacagcctataaactttttagaaaatattttcacagaaaatcttttccctcggtctttatatccattttggcactcagcttccacaaccactttggctttgaggcgtcacagtaagtagtgccattaagttttatttaaaatgcaataaagtgctactcttaagtagctgaatctatggcatactgaccaaagtataattattattaggattttgctagagagtcattacatggcaatatccagtaactaatagcagtagatgtgattcagtggagaactgggctgtataccaagagcagtagtgaagtgttagggttttaaataggtatactgtaatcaagtttccatttttgtatcacccaactgcttggtgg

SEQ ID NO: 226533 - DNA, 465 bp, Homo sapiens
aacaagacccagccttgaacctgcctctcacctctctacccagctgctcttctcccagagtggagatgactgccccaggcctgataagtaaatggtgggacaaagcaggaaccccagcctccagcttacatacctcctgggagggaagatcactaccttcccagaggcaactctttccaccttcacagaataaatgtctggaaggtctggcagaagattgggatgcgtccaacttgcttcttctctccccagggacccagctgtgccctgcgcaggctctgcccagctatgaggctgtggtgggacccctctgtgctgtttctttcgggctgagtccctgcattgtcctagcaacttattctgctaagtggcagagctcacttgtgggaccgccaccccgctccagggattgtctgtatttttttgtttgttttttaaagggttggggggtatctcaccatgttg

SEQ ID NO: 226534 - DNA, 306 bp, Homo sapiens
aaaataaggcttttaaaggtgttacctatgggctctcaaagagaattaaagtaaaacgtaccttagtaaggattttttaaaatattttttaaaatgttcaaataaaaacaaaagtagagtaaatagtataatgatctctcatgtacatgtacccaccactgaacttcaacacttactaacatggtcaatctgtttcattgttcccccacccattttggaattatgctgaacaaagcccagatagcccattatttcatctgaaaatacttcagtgtgtacctctaaagtataaagaatcttaaaaca

SEQ ID NO: 226535 - DNA, 511 bp, Homo sapiens
aaagggctccacgttcgcgcccgtccacgagcgattcctcgccaagcccgcgcgcctctggctgccttccgctttgccccagccgcggggactccggggaggagccaccgccccagcgctggccgggtttctcccgctcctccctgccaggctgtcctcgacaacctctgggccgagtccaagagatcccgcaagtcgctcctgcccgcatggggcttacagaacctgaaaggcgcattttgaaaaagagttgcagaaacagttcatggggagaaaacaaagaaacaaaccaacaaaaaactgggactagggccggtgcggggatcaagcccgcgaccatggcggtatcagcaccacgcgctcaccaactgagataaccgaccgcccgaccatctagtgctgcccgagcgtctgaaagggctccgtgttcgcgccggcccgcgactgatttccttgcagagcccgcgccactggctgcctccccgcttggccccagctgcgacttctgacc

SEQ ID NO: 226536 - DNA, 640 bp, Homo sapiens
ttggcttctcccttcttctgcctgctttattttagcctcgctagcagttgattagatggtgcccacccacatggagggtagatctgcccctcccagtccactgactcaaatgttaatttcctttggcaacaccctcacagacacacccaggaacaatacttcacatccttcaatccaatcaagttgacactcagtattaaccatcacactgggatttctctgcatttctggagacttgaacagaatcttatttttgggcaagaattttcatttatggtgttgtgtacttcctccagtgtcacaacaggaggatgtaatgtctggttgtgtcattttgtgatgttaggattgatctgtgagtttcgatattgccagtctaatctatgcattgtgagattcctcatcagttttttacctaatgacttcagcagtcattgatgcttgatttctaaatttattatttaattaggagttgcaaaattgtaatattctaattctattgttccttctgcatttattagatttttctacaaagtactttcccttttcatgtatttgggtactctggggtatagtttttataggaaaggcagaataaagagaaaagagtcaagcactgattaaaaatttttcagactaa

SEQ ID NO: 226537 - DNA, 469 bp, Homo sapiens
cctgtaatcccagctacttgggaggctgaggcatgagaatcgcttgagcctgggagccgagattgcaccactacactccagcctgggcaatacagtgagactctgtctcaaaaaaaacacaaaaaaacaaaaaccactgtcccccgacaaaacgtgctgtctgtctgcttctcgccacttcttggtgaataagacaccccagcttggagagccagtatactttttgcctcttttcctctaaattgtttcctgcatctctttcctgcttatagaaccagatcctattttccatggttttttctgatccttttccttccataactgcaaactttgacctttgtacactgggaagggacctagctgaaacacttgaattgctaaaccttaaagtctcagcccaggaattgacactggtgcttggggcttttctccacagtcatccaaactcaaacccccgctctcactaaat

SEQ ID NO: 226538 - DNA, 590 bp, Homo sapiens
tgagacaaagtctccctcggtcacccaggctagagtgcaatggcaagatatcagctcactgcaacttctgcctcccgggttcaagtgattctcctgcctcagcctcttgagtagctgaaattacaggcatgcaccaccacacctggctaatttttgtatttttagtagagacagggtttcaccatgttggtcaggctggtcttgaactcctgacctcgtgatccacccgccttggcctctcaaagtgctgggattacaggcgtgagccattgtgcccagcctcactgtctttttttaaaaatcatttttcttaagatgtcagtcagtcaaattgctgctctttaaaagtattgtgtcttcccactgctcaccatggctattttaaatatttttttcctagtttaaaaactttgtcatagtttccatagtcttatattgacacccaaaggtgtgtttcatatgtattcattctgcttagggtttcctaagctttcaactctgttagctgctgtctttcatcattttgtaaaattcttagtattatcttttcaaatattgcttttgccctattctctcccttctctttctga

SEQ ID NO: 226539 - DNA, 448 bp, Homo sapiens
cgcgggagtctgaggcatgagaatcgtttaaacccgggaggcagaggttgcagtgagctgagatcaagacactgcactccagcctgggtgacagagcgggactgtctttaaaaaaaaaaaaaaaatcatttctttatgtattttgagtctatattattagatacatatagattttaaattgttttctcatcttgctgaattaaatctttaatgtttccagccatgggttggttgactgcaataatttagcaaaaaaaaaaaattttgctaaattttaatgtcactttttgatatgacgctttggatcagtccaactttgtgttccctgcttttccactcaggttatcagttgattgggagccactcaagggtgaagctttgcaggttttttttgtttgtttttattcagtatgtctattacatgcaacttttaaatagctattattat

SEQ ID NO: 226540 - DNA, 339 bp, Homo sapiens
gcaagctttctcatgtccccagtgatctgtagactgcttgtacaaggctatacacaaactcaggagaaaccaaagtgggctttagcactttattcttccctagttgaaggtgaagccttgcatgtgcagaaagtaaaagccagggtaggcttgtaacctgcccaaactttaaatgcattccccaaaccatgtacagatccatcaggaaaagggtgtgaatgttactggctaaacacaaccagtaaactgctgagagcacaacctctcagcagtcattggctgaccagtaagttaggctcaccccaagaaggccaagcttaaaaataaaaacagataata

SEQ ID NO: 226541 - DNA, 539 bp, Homo sapiens
ccatgctctggccactccccctccctgcctgagggtaacagggaaatgggagggcctttgggctggggacaaccctgctgcttgcactctgcatagagaaagcatgaggagaacagaggaagagagagcaggaaagaaacagaagatgcaggctgatggttcagaagatcgggcaggaagcagcctcaatgagggtctatcacagcctacagacagcacagaaaccgtcccaacacagctgccctgcaagctgggtactgccacccccattttgtgggcaggaacacagaggctcagagatgttaagtgactttctctggatcacacagctggctatggacaaagctggactctgtccacttgactccaggctcttctgggtgttggggcacgacagtgagaaaagataagatgacggaggaagaagggtggtctgaggcctgcgggctctccttccctgagggcctggtcaggctcagtctgacatctctgggtgtctcaaggcttgtctgctatttccagccctctcctcatcctcc

SEQ ID NO: 226542 - DNA, 421 bp, Homo sapiens
cagagatggggtttcactatgttggctaggctggtctcaaactcctgaccttaaatgatccccctgcctcagccttccaaagtgctgtgattacaggcgtgaactaccacacccagcgactcacctcattgttatggttgtataacatggatgtatcatagtgaattcatttattcaaatacttatttatggctgtttagattggttctattccttttctattaaagcaatcaccattccattcattttaaattcgtgttcttatttttatccatataccatcattcaacatacaaaatcatacccattccattctacattttagcatctcaaaagatagcacttcatcaaatcaggatatatacccatattccttttcagtgaatcctgaaaagcccctaccaagtactttcaggtgaat

SEQ ID NO: 226543 - DNA, 329 bp, Homo sapiens
gcctacccagtggccctggccccgcagggcgacagcggctgctccctcccatttgcgtcccagaccgcgcggcctcgcttagctcccgggagccgacaggcgcttgccctggtgccagcgcagggcttcccgggggcttggggtaggggtaggggtgcgggggggaaggggagaacgtaatttccttctgcaggagtcgtggagacgtgagctgcaaccagccaccgcgctctctccaggcttgtttaccagttttaggtcatcattgtgcacgaaacattctttcatccaaataaaagcaaatgcagaagaacacctgatcccaaaca

SEQ ID NO: 226544 - DNA, 304 bp, Homo sapiens
cattctattcgttttcaagtatgtaaagtctgcaatactttcaggaggcaggttcctgggactggagctttaaacagctggaacaaaccgcttaactgtattccaagcgtgtctatttaagcttggaggatagaagccttcagcttttgtacgtaaatcttggtagagctgaaggaatttgtatgaaaagatttgtggtagagtgaatcaaaatcgctttggttttatgctcttctgcctgcagtcgaagctgttagaatgtggtttagaactgagtgaacacaaaacttgattttattctagt

SEQ ID NO: 226545 - DNA, 442 bp, Homo sapiens
agaataatgacaagaatatgagtttgtgcatgcttggtacatacacaatcatccttttttttccttcaatatctttgatctatggttgattgaatccatggatgtgtaaccaactcttacaaaggattgactatacagtcataactaaaagacatttgcaggttctatttcaaactaccacaatgaagcaaaaattgcaataaagaaaggaacacaattgttttgatttcccagtgcatataaaagttatgtttatgcactgtggtagtctaataagtgtgcaaagcattatgtctaaatagcaatccacatactttaattaaaaataatgaattgctaaaaatgctaacgaacatttgagcctttggcaagttggtaattgtttagctggtggatgatcttaccttgttaccaatagctgctgactgatcaggatggtggt

SEQ ID NO: 226546 - DNA, 540 bp, Homo sapiens
attctgagactgctgtacatgtatgcagagactgaacaaataagtaaatggctggtacatgctcactctcagggagggaggccacagataaacaagaggaagaggctctaatgtcatgtgtggttgtggattagaaccagaaacataaatatgaactcatgtttagattaatatagatattaatggattgatatagaaataatgatgatatgggtatatatacaggttagtatacagtcatatatttcttatccctatccactgagagggcctagaaacaacaatactccagtagcaacacacacatctcgtgcccatatcttgatttcttttgccatttcctaacaaaaggagccaggacttcttggagaaatggctgattctaagactgggtcagagagtataccagatgacgctggcacatcttctactgctagaaagtaaggaaatgctcaaaaaataaaaccacggagatatttcaaaggaacacagaagccaagtggaacagctcccagtggccaaagctggaaaaattggggc

SEQ ID NO: 226547 - DNA, 239 bp, Homo sapiens
gtgggagattcgcttgaacccaggaggtggaggctgcagtaagcggagatcgtaccattgcactccagcttgggtgacagagcaagactctgtctcaaaaaaaaaaaaaatagctaggcgtggtggcacattcctgtagtatgagctacttgggaggctgaggtgggaggatcatttgaacctgggaagtcgaggctcaaagctacagtgagccaagattgcacccctgcactctagcc

SEQ ID NO: 226548 - DNA, 515 bp, Homo sapiens
taatctaacaaactttattctccgtaatatagaagtataagtattttgatgattccatctttaatcacatacatcaatctttccaataccaaagaaagttttctaagtcaaaaatgagcaagaagagggtgaaataataatggaaagtatgcaaggcatgctgagcattttgaagaaaatatgttcacattttatttttggaattatttctggactctttcagctttttcaagtttctcccagataatttcagtatccttcataaatttttgatttctcttgggccataattagtctttaaaaaatgtttcagggtaattattggggtctgtgttgtttcaatgtctcattctttgacctagtaagactggtatatatctgagcatgtcactttttcatacacaacttcttcaggctgtctgaccctaagaaccagagcaatttttcttagtagacattgggaatagtctggttttgagaataggtgtttgacgcagagttttcctttaaaaatg

SEQ ID NO: 226549 - DNA, 419 bp, Homo sapiens
ccattcaaagttattttaaaaatcttggaaaccctccccagtcggctgtgggtgtgcctgaaaacagagacctggagagcatggtgcaagtgcgggtggacaatcggaagcttctgcagtttttggagggacagcaaatacatcctacgacggccctgtgcaatatttgggacaatactcttcttcagcttgttttggttcaagaagatgtctctcttcagtatttcattcctgccttgtaaaaattcagccagcttagattttttttttaaggttttgatcttttcaaaactaaaacagaccctgagttaattgggttgaaaatttggaccttcactgacttatgcagggcgtatattttgttgagcccttcctcctttgcaaaatttatattaaagcattggtaaaacagttgggta

SEQ ID NO: 226550 - DNA, 912 bp, Homo sapiens
  misc_feature (440)..(440): n is a, c, g, or t
ggcacgaggaaggaactacgtctgataactacattctttgtaacttcatggaagcagtgcctaacacttaggaatctttttgagccccaaatttgctatttttttcacacacttggatatgtgttcttcgcattaataatggaaatgatagtgccattcctgccgaccttacagttgacagttgacactaaatgtgagactaaatgtgacaatgtgtatgaaaatgtttctcaaacttacatttgtatctaaaagcaagatattagtagtagtagtgtcatccaatgtggtgtaaaccacatttgggagcccatccatgggcattgcagagagtggtggggtggaacaaaagccacagatgaaaattttgccatcctaagaactggataagtatctgggaaagcaggatacctggggtagagtatgctttctttgctttncagttaagtcttcatttcagtgaccacttgtttatggtagtttagaggtgcctgccagtaaagccaggatattaattaaaatgcaaaaattaaatttttttaatggggcctggaggaaaattaaaggatttataggagaaagatgggatccagagggtttttttttgtcactagtttgaaaattggtggtggtggtgtagacaagttgaaggatgaagccaaaatttcaggcaaaatatcagattcaaactcaaggcaatgactattctatatttgccattttggtgcagctaaagatctctggggagtaaagtgatgacaaatcttcaaaacaggtgattgaggctgggcgcagtggctcacacctgtaatctcagcactttgggaggccaagattggcggatcacttgaggtcaggagctcaagaccaggctggccaacatggtaaaaccccatctccactaaaagtaca

SEQ ID NO: 226551 - DNA, 399 bp, Homo sapiens
catagtgttgtacaactgtcaacactaattccataatattttcagctcctcaaaaggaaacctgttacccattattctgaatattagatataaatagaatcaaactgtgtgactgacttctttcactttcaaagtttcatgttgtagcatgtatcagtacttcattttaaaaaattgctaaataatgctacattgtattgatacaccacatttttttcactttgattatttatttatttatttttttattattatactttaagttttagggtacatgtgcacattgtgcaggttagttacatacgtatacatgtgccatgctggtgtgctgcacccactaactcgtcatctagcagtaggtgtatctcccagtgctatccctcccccctccccccaccc

SEQ ID NO: 226552 - DNA, 435 bp, Homo sapiens
gaggagaactgaggggtatagaaggtttgggataatgtgaggaggccagttccagacggtccctggcacacacccttcatgcaatctctgaaataaaagtgtgtgctgtttgtctgcaaaagcattaaattaatttctaggggaactgaggagacctctgaggcacctctgaagcttctttattttaggtctaaatttcttgctatttttttgttttcttagtgtgtatatttttacatacttgaaatgactgtgaaactaactttttgaattaaagtttgaacacagttactatttcattataatgctaataattccatagttacatattattcttttatatttaatagttgtgacacaaattacctcactttcccctttgatgacctttattatgacattgaccaaaagttgaaaatgtatgtttctggttaa

SEQ ID NO: 226553 - DNA, 598 bp, Homo sapiens
  misc_feature (78)..(78): n is a, c, g, or t
  misc_feature (82)..(82): n is a, c, g, or t
  misc_feature (99)..(100): n is a, c, g, or t
  misc_feature (109)..(109): n is a, c, g, or t
  misc_feature (123)..(123): n is a, c, g, or t
  misc_feature (132)..(132): n is a, c, g, or t
  misc_feature (182)..(182): n is a, c, g, or t
ttcgaattggctcggttcccaagcgcacgcggttcaaaatgcgccgccgcgcaccgcgccgttatgcttctccgggtncccnggttcgtccccaacttnnccgtagtcngctccttcttggancgctacggnccgctgctagacctgcctgagttgcccttccctgacctggaacgggttcntcaagggccccaccggacgtcggcaacggagaagtcggtcaggaaaccgtgcagcagctctggctttgaaggttaccggaaaaacacgcgtggagctggaggtggcagttcaccgaaattgaatcactctaacgagccgcaacataaaatccctggaaaaggtgtgtgctgacttcatcagaggagcagaggcaaagaatctccaagtgaaaggaccagttcgaatacctaccaagactttgagaatcactacagaaaaagtccttgtggtgaaggttctaagacgtgggatcctttccagatgagaatccacaagcgactcattgacttgcacagtccttctgagattgttaagcagattgcttccatcagtttgacgcgcggtgcggcgtggggatactctagatcgacccgag

SEQ ID NO: 226554 - DNA, 766 bp, Homo sapiens
  misc_feature (78)..(78): n is a, c, g, or t
  misc_feature (82)..(82): n is a, c, g, or t
  misc_feature (99)..(100): n is a, c, g, or t
  misc_feature (109)..(109): n is a, c, g, or t
  misc_feature (123)..(123): n is a, c, g, or t
  misc_feature (132)..(132): n is a, c, g, or t
  misc_feature (182)..(182): n is a, c, g, or t
ttcgaattggctcggttcccaagcgcacgcggttcaaaatgcgccgccgcgcaccgcgccgttatgcttctccgggtncccnggttcgtccccaacttnnccgtagtcngctccttcttggancgctacggnccgctgctagacctgcctgagttgcccttccctgacctggaacgggttcntcaagggccccaccggacgtcggcaacggagaagtcggtcaggaaaccgtgcagcagctctggctttgaaggttaccggaaaaacacgcgtggagctggaggtggcagttcaccgaaattgaatcactctaacgagccgcaacataaaatccctggaaaaggtgtgtgctgacttcatcagaggagcagaggcaaagaatctccaagtgaaaggaccagttcgaatacctaccaagactttgagaatcactacagaaaaagtccttgtggtgaaggttctaagacgtgggatcctttccagatgagaatccacaagcgactcattgacttgcacagtccttctgagattgttaagcagattgcttccatcagtttgagccgggagttgaggtgaaagtcaccattgcagatgcttaagtcaactattttaataaattgattaccagttgttaaaaaaaaattataaatggcagacttgatcccattcatcattagactactttcatgttttgctcagaattaagtaagttttaatattcatttaaaaatacttatcaaataaatttggtttctctcaaagtaag

SEQ ID NO: 226555 - DNA, 493 bp, Homo sapiens
gtatgtgagtgtgggcagagcaacaggtaactagtgcacaaggccggcagctccagtcctctcagccaggtcgccgaaccctgtgcctggagcactttgccaggctgacgttttacactaagaaaagcttactgggcaggtgctgtggccctcacctgtaatctcagcacttcgggtggccaaggcgggcagatcgcttgagctgaggagtttgagatcagcctgggcaacatcgtgaaaccccatctctacaaaaaatacaaaaattagccaggtgtgtggtgggtgcctatagtcccagctacccaagaggctgaggtgggaggatggcttgagcccgggaggtggaggttgcagtaagctgagattgcgccattgcactaagcctggatgacagagccagaccctgtctcaaagaaaaaaaaagaaaagagaaaagcttaatggcttgtgtttattcacttttgtgtgtgtttcttcttttttttttttt

SEQ ID NO: 226556 - DNA, 508 bp, Homo sapiens
ttaagcaaaggttcttaacctttttcttaatctttggtagtctggtgaagcctacgtatttaaacgcataaaataaggtatgctgtgttacataggaagaaattgattatactgaaatatttaaaaattgtaatatagtaatatatgtgttccttgatgcatgaaatattaagatctagcagtgatctaaggactcccagaatttcaaagtagtgatgaatagaaacaatgtcttgagatagctacaacatatcatgtggtatgaaaatatctgtgatttctgttggtgacaaagtcacaagttctgctgattctactgtggtttcttgcctatatccatattttaagaaaatgctaaatttgagttaaaggttaataaaaataaagatttaattttttctccaagttcatgggcctacaggccaagattgctcagttcaggaattcaatatttgtcagtttccctattgtaaaataaaattaaaatatattattcatcccaactgca

SEQ ID NO: 226557 - DNA, 90 bp, Homo sapiens
gtcttccttttctccttccctctttttcttccttttcctctttgtctctttctcaccctgtttttttctctccctctctccctcacccct

SEQ ID NO: 226558 - DNA, 626 bp, Homo sapiens
gcggtggctcacgcctgtaatcccagcactttaggaggccgaggcgggcgaggagattgagaccatccaggctaacatggtgaaaccccgtctctactaaaaatacaaaaaattagccgggcatggtggcgggtgcctgtagtcccagatattcgggaggctgaggcaggagaatggcttgaacccgggaggcagagcttgcagtgagccgagatcacgccactgcactcagcctgggtgacagagcgagactccatctcaaaaaaaaaaaaagacagaaaagttactttttagagagtggcttacaagaggagtattatagaaatatatttagttaatgacatcttctttacaagctgataattctactggaaagaatcatgtttcagagttctgacatcttccaccagttcactgttacctagatttttactggatttttgccagtggcatgaatataccttatcctcctttcacaatctctttttctccaaacatttcctaccaccttacaccttaaagattttgttaatgtctttcttagtagaatgcaatttccatgaaagtagagatttttgttttgttcactgctatatccccagcccctagaacagtgactggcaggc

SEQ ID NO: 226559 - DNA, 570 bp, Homo sapiens
agatgttatctgcttcataggttatgagaattaaatgagatgatgtacttcaatttacttaatgtatttaaaatacctagcttaccatttgactcatggtaggatgggaccaatctatatattttaatataatatgtatatacacacacatgcatgtacgtgtgtatgtatatatgtatgtatgtatataaatgtgtgtgtgtatatatatatataaatgttttttgacttcttttagtatagaaaatgctaactttattcccaagtaagtgcaagacattttaagatgcctgtggaagttcagacatcataattccctgcctgggactgtgtgaaggtagatagaagactttagttcacagaaacaaatggttacctgtggtaatgtagatgttaacaggatctgttattaatgaatctgttgactggttttccttgctgtggcttgttctaacctttgaaatatgtgttatgagaaaaggggtgctatttttttaatgatgctaacttcattaaagctacctgtaatgttcttattttgtgattataataaacattttttgggataaa

SEQ ID NO: 226560 - DNA, 481 bp, Homo sapiens
aagcagagcaagggtctgtctatggtcaagtcatcatttctcaaagggtgtctcatgggtcaagtccgtctggagaaagctaagtgaaggtggaaaatgttccattactacagggctgcttggaggcatgccagcatgcaccatgaatgcctcaggcagcatttgccaaaagtgttggactaacaaactctgttttcatggggtatctttgtagagcttgaaaatacacaaaatgttgggccccaccccatagattctgatccagtaggtctggggtggggctgagaatttgcattaaacaagcttccagatgacactaaagctgccaacagcaggcccaccccagagaggcactgtttacggctttcctcagaaggcctgcttctaggccatgcctcagaaggaaactaacatgataaaacaggcaatgataagcacaaacttttgtaaaaacaatgttaattaaaatagcgtttctaga

SEQ ID NO: 226561 - DNA, 391 bp, Homo sapiens
aggttcaagcgattctcctgcctcggcctcctgagtagctgggattacaggcacacaccaccacacccagctagtttttgtatttttagcagagatggagtttcaccatattggtcaggctggtcttgaactcctgatctcctgattcgcccgcctcggcctcccaaaatgctgggattacaggcgtgagccaccacgcccggccaggattggctgcttcttggccaacctaggacttggggaaaaaggatagataagagaggttgaggggttttgtgggagcaaactttcgatccagtctactcacaggacctcccaaaaactccatgccattttcatctctgaaattgctttgaacatgcctctggtctgtgaatcccacctgtcttta

SEQ ID NO: 226562 - DNA, 575 bp, Homo sapiens
cttgagctcagggttctgggagagtgtggggctgatggtggtgaggtcattttgcacggtccccagggtttgcctgcatacctccgcctgctcccctcagagctcagccacccgccccagctccagcagcctctcctgctcccagttcaggcatttcaagtcctcattgtcttgcatgtgggcccactggagctgtcctgctagactttccagctcctcccacaggtgctcagcctctgcctgtagctgctgctgcagctgcagaccccagaacttggtgtctgcctcccacggcactgggaaggatggaggcagattagaaaaatcatcccctctcatccacagccatcaaagcagggctctggctcacaggtcccctcagaagtgccgcttcacatgagggctgcgccccctgctgggggctccaggggtgggattcagctgagaaaggaagcagacaataacggcctctggattctcaaaaacaccctcctcttggtacacagctcctctcgggctccccagacttggcctccctgctaatgattctcaaaaaaaccctctgcattctcaaa

SEQ ID NO: 226563 - DNA, 580 bp, Homo sapiens
gctcatgcctataatcccagcactttgggaggccaaggcgggcggatcacgaggtcaggagatcgagaccatcctggccaacacggtgaaaccctgtctccactaaaaatacacaaattagctgggtgtggtggcacacacctgtaatcgcagctactcgggaggctgaggcaggagaatcgctggaacccaggagttggaggttgcagtgagccaagattgccactgcactccagcctggcaacagtgcgaggctctgtctcaataataataataataataataataataataataatttttaaaaatgtctaactagtttcttctgttgtatattttgcctttaaaattaacttgctatctattgagatggatgttcagttttagtaaatgctctgtgaggattttttaaatgttcatttcttatttaggggaagttcaaagttacatgttatatcatgttattaatagtgctattccaaatggtctagtacatcaacttatttttctactttatctgttttcttagaatgctatcttcacatacaacattaaaaatgaatttttcaaaattgtcttg

SEQ ID NO: 226564 - DNA, 428 bp, Homo sapiens
tgcagaatgttcaaatactaaacaacaatgaaaaattacagatatgtgaattacataaatgaatctcataaacatatgttgaacaaaagaagccgacacaaaatatttatatatacttatagttcaaaaacaaggcaaaatccatctgtggtgttagaatagtggttacatttggggagataaaagaatagtaattgggagaggtgtggagggacacatggtgttttatttcttaatttgggtttgtaatgatatagtggtatgttgactttttacaaactttgcatttgtagagttgtgtactaattatttgtgtatttttctatgtgtgttttatatataaacagaaaagtttaaaaaatcttaaattgtaatacagaaatgatttcttcccataacacattaaaaatagttcatgaagaaaaaaa

SEQ ID NO: 226565 - DNA, 1290 bp, Homo sapiens
tctcgaaacttggaaggctgctgcttctggccttacccctatgcccaatcagttgtcagtatagtcagttctcccgtgaatagctgtacactctatatactgcctgtcactgtgcactgccaccaactaagaccaagccactgctgccatctctttcctaggttacttaaagggcagttgcaccccctacactttctccagtctaacatcctatgctgctattggcctcataaaatgtccatctgattgcatcatcctttgcttaaaatgcctcattagagttttgataaaatctaaactttttaacagggcttataagatccttaataacctgttcccaagctggctgcatttcttggagtttctcggaaatatctgcctccctcaagcacattcccaccccaccctgcatacatacacatctctggccacttgtttgtcatttaccctagagtctaacatagggcacagtaaggcctcaataaatatttgttaaataaaggtaggaaggcagtggtcctggattttaattgtatgtcctcacattttaatttaatttaccttaaaaatgtaaatgattccagagtcaaaagttgctgtttgttttatagtgctctgtatgtttccctccactctgtagtttccagagggttattaaaaatggactaaaagaagcatgtgggcttctgttagcaaatcagttgtaatctgtgttctttggctgagtgctgagcttaggaggctgccagatggggacacaggaaccaaatcatctttgcttcccagtggggaacaggggcataaattggctgaatgggcttctgcagtaaaactccttcaatttgagcttgtgtaagccaggatcaaaatacctgagacttgttgagacttgtctagaatgtttgttaaactttcaaacctgtttgggaagaaggcttggaacaacagtgggtttgggtcttgtgaagtaaatcttatttaaaggaaatagacaaaagcttaatcatgtttaatttgtaacattataggtaagactgttggttgctgttgtaatgactctaaaaaagaatagagaatatttttttccttagaagttccaggttcaatgatgaaaccccatctctaccaaaaattcaaaaattagccaggtgtgttggccagtgtctataatcccagctactcgagaggctgaggcaggaaaatcacctgaacccaggaggtggaggctgcagtgagccgagatcgcgccactgcactccagcctgagccacaaagcaagacgccatctca

SEQ ID NO: 226566 - DNA, 455 bp, Homo sapiens
agtgagtgtggactcagggtatgacgatgaaactactttttaacatgtcagaagatttaagggagtatgtcattgatcattctagtaaaaataaaagcatcacagggatttaaaagagtgtgacttataaattatgttttaaaagtagggctttgaaaaatcttaagggcattgtcccaaagcagtctcacaggggacccacaatagttaaaggagttttgaagatttttatgcatgtttctttgtctaatagagtgaattcgtgaattccaataagattcctggaaaatccactaagttttaaagagaactgtattgaaagagtatactgacagcttggactaaaagggttagatacagtataaaagagggctttgaactcctgaaattctacggggagggctaaaaacactgtgtgacaattactcagctataaacagaggctatttcttgtg

SEQ ID NO: 226567 - DNA, 399 bp, Homo sapiens
ctggattactccatggagccggggcctgtgcagaccctcaagagaggtcttttgcacccaacctgttgggcagctgccctggtgccctcaaggtgcccccctttctgtgcccacctcatctttggggcctcacagtgaggatgtggccagtgacaggggctggggaagatacaccagggtagagaggtggacactccgggcttctggttatgatgatgatgatagccagactggtgattcccaaactggagggtccttgggatcttctggcaaggcaaaaagtccagcatgccatatccaccgactcctgagtcagatacccggaaagaacctgaggttatctatgtcaggctctctgatgacgattttgtgttgaataaagtttaaagcacagatcca

SEQ ID NO: 226568 - DNA, 269 bp, Homo sapiens
catgacccaggacacgacagattacagatttttttttaaagcaccaatttaaacaagcttagtccctagatttgctgtgtaaaggcatgtcccttagaaacacttagcaaatgacacaaagctatataaaggcatcacaatgctgtgaaaagtttggtagtatggtaaaatgtagttaactggctaaggcaagcaacatcatgagactgctcaagattacagcaccactaatgtttcctgctttgttgtacggtgtctagcttcacatg

SEQ ID NO: 226569 - DNA, 388 bp, Homo sapiens
tcatagtagtaagtcagaagtcagcttccttcccctttgtgttaggataccaccatgcgtaatcatcctgaaacaaaggtgcgggggaggatttggaaaacttgttcctaaataagctgttttctaagttgagctccccttctctagaaagtttccttaggaacattatgcatattggagacaaagataaaaccctttttattaaagtaaaaaaaatgttgatagttgttggtgatgtccaaataatattttcaagtcatattataatgatggggtttcccccagtactttggattgaaataaacgggttagaatggagaacagatgacaggagtcttctctgaaatttctgagaggccacacaatcttaggttgaataaagaaggaa

SEQ ID NO: 226570 - DNA, 496 bp, Homo sapiens
atctccttgagatcctgatagcctgttacaggaatgaagtaaaggtcagttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttat

SEQ ID NO: 226571 - DNA, 543 bp, Homo sapiens
atcatctcagtgcccctgttgaaggccaaattatgctgaactattagtgtgtgtacagaacactgtgggctttctcataagaaaagatgggcacggggccaggtgcagcatcttaggcctgtatcccagcacttgggaggctgaggtgggtggatcacttgaggtcaagagcctggccaaaatggagaaacctcatctccactaaaaatacaaaaactagccaggcatggtggcacgcacctgtagtcccagctactggggaggttgaggtactagaatgcttgaacccaggtggtggaggctgcagtgagcagaggttgcatcagtgcactcccgcttgggtgacagagtgagactgtctcagaaaaaaaaaaaaaagaatggtgggattacaggcagaagccatcatgcccagcccccttatttcttactcagtctaatctcagtctttccatctgtaaaatagtatcagactctgcaatgtcctctgaaaacatgaggcaaagatgggagtaagtgaataaaatatgccatatgcttgct

SEQ ID NO: 226572 - DNA, 463 bp, Homo sapiens
ctatgctaaaataatacagagtattaaataaagttggccttgtagtggtcagaggaggagaccacaaatatgttctggatttttagagccccagaaagacccttaaaatctgccttaaaatgtgttttccatttactagtgaaggctgaacattcttttaaagatgtctttgtccttgtacaatacaatatacccagaagggaaaacactttatagcccttatggactaacttggtctgctttgaaatttggctcaggtaggccttaccatggagttacctggtagctattaaagaagtttaagtacagaagttttcataattacttccttaatttcttcctcatagtttgattttaaattagaagagaattactggaatacatgtatcctcctcaatcactacccctagcaagcttcattagtctttgaaatgtttctccctgtaaagaacagtggcaaaaa

SEQ ID NO: 226573 - DNA, 407 bp, Homo sapiens
attttggcttgctctcagcggtgtggcattcattgcacagggcttcacacagataatccatggtttttttttcttaaactctatttcagcagaactcatgatttagcttcaatgctaagctgttatctttctcactttctttagcctaatgggtccatttttccagaacactttaagaagagtttaaatttagaagagaatggaaaatgagaataattgagggagaattttctttttaaaatgaaatttataatcaagtgaatcagtgaagtaaagaagggtggcacttcagaaaaattgactttggacagggcaaatttgattttaattcagcaagttcatatcatctaaattgatgcaagtgaagttgctagcccagagcacaccattgtgtctgcttttccttt

SEQ ID NO: 226574 - DNA, 996 bp, Homo sapiens
aaagcagagaaacttttcaggaataatgagggctgctaaataattatgattgtcaattttccaggggaatattgtcccaagtgtatatgagaacatagagcttcaaagctcataaacaaaattggatacgcaaggtaaaaacagaaaaatccaattagagttgccgacactaacactcctctctcggtaattggtagacttagtagaaaacaaatcagcaaacatattggagaattaaaccataccatccagtaatggacctattaacttcataatgcaaaataaaaatttaggtagaaggcaaagacaaaagttaaaagaaaagatcatgttataaccaggaaattaagagtagtccagcatatagaagagtgctattattggaagagttatttagttattttgagacattttttgaaagagttatttagctggaaatgacagaaagactgaaaatggtgaatctggaggtggatcttcccttgtccatatttattttgtctttttttgaggtctagggtgtctatacttcctctgaattacctacagtgtctggcacagagcatctccccagtgaatatgtattaaatgagtagaaagtaatttatagattcaaaagaattgggcaagaataatgttcattatttgacaaatccttaaatgtagtgtttgaaggaagacaataagtcaaagttgacttgaaaggtaagcccaagtccagactcttttctgtaatcccagcactttgagaggccgagatgggcagatcccgtgacaccaggagtttgagaccagcctggacaacacagtgaaaccctgtctctacaaaaagtacaaaaattagccaggtgtggtggtatgcatctgtagttccagctactcaggaggctgaggtgggaggatcgcttgaatccgggaggcggaggttgcagtgaacagagattgcaccggtgcctggacaacaaagtgagaccctgtcataaaataaaataaaat

SEQ ID NO: 226575 - DNA, 324 bp, Homo sapiens
ctagttcactgcagtagaggagaaaaacagaaataatcagaagagaaattccacagattccaccactaaatctaactgccaaccgattaatcgctcctcgaattctggcttcctcctgtgtgtcagcaggtgaatactgtgctcctttccaaggtgaacccctccatggtgcactgggtgcctttccatttcactactctaaagctttgctccttttccccacaacatggattttaccttttgttttttttttctcattagcaaacaaatattctaaaatagctcccaccttagaaacaaaaacaaaaagaaaaccccgccttt

SEQ ID NO: 226576 - DNA, 404 bp, Homo sapiens
atgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggtaggttgggcttctaaatgcaataataaattacgctgactgtggtaacttagccaaagtaagatactgattaagccgtatttttctgaagtgcttccattccaggttttgctttctgaggcattacattgtttttgagtatagattacattttattaacta

SEQ ID NO: 226577 - DNA, 784 bp, Homo sapiens
cactttgaattccttgtctccagggaccagcaggagaaaagagtcaccatcgtgacagggggaatccatcctcatcagcccgaggaagtggatggcgctagggaggaagatgtgtggaacccagatctccttgggcgtttcctggtactcccttgactcactggaattagggttggatgtgtatagtgctcctggcctgagaagggtatgactgcaaagggctcagatccacaaggaatgaagatttgggtcacgtcaccacataacatttctcaaaaaaacatcaggacttgctgaggtgatagctaagggtgagggaaatgggccatgcaaaagggacaggatgtgaaccaggttgggcctgagaactggccatagtttgtcctattaacctatcacttctaagcttcccttcaggaagagcagtccatggatttgtggagaggctgctccctgagcatgcatgcagaggtggatctgtgcagtccagtgtgtgaaatgtggccaccatgaaagtgcactgctcagatctcctgctgtgggagcatgactgactgacagccccagctgttgcctctgtgcacacaccaccatgtttgcacagagctgggctttccataccaatgacagagcatggcaggtatatgaaagctggtcagttcttttggggtgcagtggtgcatgcctatagtcctagctacagaggaggctaaggctgatcacctgaggccaggagttcaaggctgtagtatactatgatcactcctgtgaatagccactccac

SEQ ID NO: 226578 - DNA, 717 bp, Homo sapiens
gggatttgaggagatgtgatgaatcagaatttattatgtgtttggaaggaagacattctgaatgctgcttaaaagctaagtattaaattaataacatatgtcagccattgtggctgctggatagcctcagttatgaccaaattttacttagctgtgggcaaactgtctaaacagttttttcagctttaatcctcccacttgcctaggagtttacagggcagttgatttagattgatctttcacattatccccttggactcttagaggattcatgatgacagttgtttaccagaggattttcagtgacatatgagaaataagatctgtcttctgtgtggagatggtttctctgtgatgttccctgaacctcatgttggcccttgccagagatctctatttttacagctacttgcgtcattgtcatttccagctgatagatgattgaatgcaacttcacatccttcctgtcttaggacttgtggggctttggctcaggcagctggatagacagcagagaaggtcactgagaataggaggttggactattagttctttccttgtccccacatggcattctaaactgtgataaaattatttgatacaaccattgaacccattcctcctgttgccttttctcagtcttcagatccccatagtgtttctgtagcatttgaaatctactcttcacccagattttcaaaactgtgtacttctttg

SEQ ID NO: 226579 - DNA, 444 bp, Homo sapiens
tgtgtgagtgtgtctttaattcctctagtgccaatgggttagggtctccacaaccgagctggtcttggcagaaaccaccccttgttttctctatccattgcaaccgagtatctgttaaatgtctctcacaggcctctcattacactttatattttgcaactctggaaaatgtttttctttaatatttcccaaaactcaagaagcaaatttattataggctgtgtagcttataatcataccttttaatgtatatccttgaatctcgtgatcatttttagtcatctttttaaaaaatgtggcaacatacatgcaaaaaattttgcatatatatgtatacattgtattctttatatatttattgcccagtgtccctacacactagaaatgatggttcatgaaagaattaaatgtgtatctatatatttttcattacaattcccagtt

SEQ ID NO: 226580 - DNA, 427 bp, Homo sapiens
gataaaaagccagattcagtaagaagtgacttgcccaaataacctatttatgctaaaccagaactggaactcaggtccctgcagggtggccaaaagagtctttgctctacagccttcactgatacctggtttctacttcacatgtagaagacaatccagtgttttaatctacataaatatccatccttgtggataaatgtgaattaacaatatagcattatcccagatcataatactttaccttgtccaaaatatcacttctcatattttaaaacgtaaaaaacttaaaaacttatagaaagttggccagacgtggtggctcataactgtaattccagcattttggggggctatggtgggaagatcgcttgagaccagcctgggcaatatggcaaaaccccatctctacaaaaataaataaatacat

SEQ ID NO: 226581 - DNA, 254 bp, Homo sapiens
atcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttcttta

SEQ ID NO: 226582 - DNA, 433 bp, Homo sapiens
atacacaatcatattcccacaattcaaagaatagcatgatgttaaaaatggtaaagggaataacctacagtctagaagaaaaggcattttacttgacactggactttaagatacgttcaattcacatttcatcttgaatgtcaaagagcatgtatttgattaccaaatgataagaaatcattgtacgtgggtgaaaaagagtgaaataattatacacatccataaacctttcaacaacagccttcactcactccccacttcaacctttatgaagttgcttttagtttttagtaacagtcaccttaacagacccaattttgaaacccattaatacaaaattgattaaacacttaaaaaaaagacagggaaaatactcacatcacaggtaaataaataaaggaactttacatttcacattatatatatctctgtt

SEQ ID NO: 226583 - DNA, 364 bp, Homo sapiens
actatagtgtcttctattagcagcactagaaagcaagcaatctgagaagccacatgagagatgagaggaagggaatttcacttggagtcagaactctctgctgagatacctatagatctttcccgagtttgctgactttatcaccctatttagtactagtggcatgctttaaattaatgatttgcagctaatatacagaatgatagaatctggattcaaagattgagggagtgaatctaatgagacaaaatttaacccagaaaaaattagaagcttctatacttgagttaaaactaaaaagatttacagaagtggattaacagcttgaagtatgaaataagggaggggtctagttgactgcaac

SEQ ID NO: 226584 - DNA, 451 bp, Homo sapiens
actggttcttgggaatttcaagaagaaacttgttttcttatcctcacctataaagacccttcccagctgtaagaatttacagctacaatccaagaaatgagattgcattttacaagaaaagaaaactgatgattcttgcccaaaacatgagaagtagaaggaatgtgagagaaaataatgtagattccgtccaggaagtgctaggtgctttcctggtgggtacatttacaaattagggacattttaattaatctactggatttgtgattctgtctgctactatcttctttttcttgaccttatgaaagatttatagatggcttcaactgaaactacaggaaatgactcatggttatccctgaagatattagagccagatttccattccttagggctgatgcatagcagctctttgataaatatttgctaaataaatgacaaattttagaat

SEQ ID NO: 226585 - DNA, 335 bp, Homo sapiens
aaggtggggtctcgctctctcacccagacgagtgcagtggcgtgacctcggttcactgcaacctctgcctcccagcttcaagggattctcctgcctcagcctcccaagtacctgagattacaggtgcatgccaccacacttggctaatttttgtatttttagaaaagacagggtttcaccatgttggtcagactggtctcgaactcctgacctcaaatgatccacccgccttggcctcccaaagtgctgggattacaggtgtgaaccactgcacctggccccttttttctctttcaaaagcatacgtactttctgtaaccagacagtggtaataa

SEQ ID NO: 226586 - DNA, 448 bp, Homo sapiens
agatggagttttgcttgttgcctaggctggagtgcaatggtatgcaatcttgaatcactgcaacctcctcctcctgggttcaagtgattctcctggctcagcctccctagtagctgggattacaggagactgaggcagaactgcttgaacccaggcggcggaggatgcggtgagctgaaattgcgccactgcactccagcctgggtgacagactgagactctgtctcaaaaaagaaaaaaaaaaaggagatattagatacagcaataagtaaaacgaaacaaagacccatgaagaccagaactttaaattgtcaaaatatcacaccttcagtacaataaagtgctaattatttacttgaaagtatggtttggtggccaggtgcggtggctcacacctgtaatcccagcccaaattatattttttaataactaatacaaaggtgaagtg

SEQ ID NO: 226587 - DNA, 643 bp, Homo sapiens
ggagtggcggcagggattttctcccattgtgccaggtaaagggttgttcccattcagcttcttggcacactcaatactcttgctagtgtggggcctgaaataaagccctgaccgaagggagctcctcagcagcctcccctacctcttggtggctttaaaatctagaacctgcatctcttatagaagaccctttattagaggcaaggcttaatcccacagttcttggtgccaagctgaaagaagggaacattttgacctttgaggtggtgcttaaatggtcatatttaatggtcatatgtgtccttcaaatgggctctgggattcccttcagttatttacatctctcagcagtcctttactcctccgttcccaggaatctctggatctaggaaatactggcttatccactccctatggctcaacaatagtctaaaataattagcctctccctaccattctggagcgttggccagtaaagaaactatgtgcttagccctagcaatcagaagagtttaaaagcttccttccaaacacagcagagcaaagggcatccagatcactacaatccgtatctcccagcctcataggaattgacccctttacctgacctattcctgcttttccacagccagttctaccatca

SEQ ID NO: 226588 - DNA, 462 bp, Homo sapiens
agatgaacgtagtcttcactgtgctacctgctctgaatatatccatgcagtttcattcaatttttctggaggagaccgatcagcaattttcataagatgggggcgagtagtagcgtgaatgaaccctgtctaaagcatgtggaagacgaggaggaacgcaaagcccttaacatcgaagctataggacaaactggctgtatactttgcttgaagaattatgaatcatgataaaagtaacctgtaatgcccctagaaatagggctcttgtttaatctctgcttaaacattgactaaagacacaatggccacatctagcaatgtgattctggagacagtgctgcggtctgcaacgggacatgaatggccaagccaagcttgcaaacatgggatgctgtgcgtggggacagacctatggagtcttgcactccagcctgggcaacaagagcaagactccgtctccgt

SEQ ID NO: 226589 - DNA, 255 bp, Homo sapiens
caaattaagggctgaatttattgataaggtgtacacacctgggaactgggaattaatgtgttggttcaagtgcctgggggaggcaataatatttgtttctaaaattcttttcctctttttcactgtgaactttaaaatctcattttactttagtgattttttaaatggtatattacaaatactgttatgatattgggcctctttatttgtgtagtatactttatcattaaagaattagtcatggttgttccattt

SEQ ID NO: 226590 - DNA, 327 bp, Homo sapiens
agaaatccagggaggacaagggattgacctgggtagtattgagctggaaggtaaaagcaatgaacaaaaagaggttcagattccttattttggagcgacagtgtcaacaagaaacatctgccaaaccacaaggaccatgtagaagctggtgtcccaggaggtaagattttctacctttcctccattgcacaacaagctataaccatgcctggtggagaaaatggatgaataaggaaggttagctgtgagtgaatttcaattctgctaatgttttttgaaccattaccagataaccaggccctgtgtgggacctaggtgggagccaaa

SEQ ID NO: 226591 - DNA, 520 bp, Homo sapiens
aggacaatgaccttatcagggtacaggtgaaatgagctcagtgagagagataaagagttgtgtaaggttcatgagttgctaggtgcatacacgtggtcctttctctcacagcatgtaaaaaatcagctcaacatggattgaagactcaacatagacttgaaaagacctgaaaccatacaactacgagaagcacatacaaagataaagctttggacattgacgtgagtaatgatttcttggctatgacaccaaaggcacaggcaataaacaaatgggaaaatagacaagcggggctgcattgaacgctaaagcatcttcatagcaaaggaaacaatcaactgagggaaacggcaacccagaaaatgagagaaaatgtttgcaaagcctacgtggtagaaggggtaaatatctgaatacataaggaagtcaaacaactcaatagcaaaaaacaaacaacctgattgaaaaacagacctaggacctgcagaggcttctctcacaataaaataatgttttaaga

SEQ ID NO: 226592 - DNA, 1133 bp, Homo sapiens
acacacacacgcatcactcccatacatgcccacctgtttaccagccaatcacatttcttggggcaactcgtctgagttgcttctctttccagagagtttttgcataaagaagcacaggtatttctgcgttaccatgaccctatttcccagtggttcctagccagttgactctcctgcactggataccatcctggacagcattccttagggaaatgagccccctgttttttcccaccatggcacagttggtcctttgcatggatgcaccattattgcccctgtctcttcttggtggaccttaaggttttctccatccttttgctgtaacacacactgctccaagtgtgtgagcatatcagtaggaaacgcttccaggagtagaactgctaggtcagagggcgtgtggatctgtaacctgacagacctagaccggcttcagtttggttttatccagtttccatattgattattcatataaaaggaaacagacaaacataacgctgtgcatgtattctctcttagaccagaacaggcatagggtgcacttttaatttgtccatttcgtagagtagaaattgtttttgctgaaatgaacaccttaggatgctgaagaatatgacccgtcccatggaaaacattcaaaaatgtgtgtagcgctttcttcccaagggtgtgtgtgcgcatattttaacactaattcactttctacttccgttgctatcctttctgtgagtctttctcagaatctcagaaaagaaactaaattgttcactctagttatcaatgctgtactctatacctggaatttgctaaaagggcagattttaagtattctcaccacagaaaagagaaaagaaaatggtaattatgtgacgtggtggacatgttaactagctttattacggtgagcatttcacagcggatatccagtcatcacgctgtacacattaaacatgtacaattgggttttgttgagacaaggtctccttctgtcacccagtctggagtgcagtggctcagtcatggctcattgcagcctcgacctcctgggctcaatccatccttccccctcagcctcctgaaaagctggggccacaggcatgtaccatcatgccaggctaatgcatatatat

SEQ ID NO: 226593 - DNA, 1174 bp, Homo sapiens
tgctcctcccctcttttgctgagcacatgcagtccaattggcctacattaactgcaggtgtgacgcagctccttagtaccttcatcagggactgcacactctactgccatcatttataagtcattcctccaaccccgaccccatgagctttgtttcccacatatggctcgagaaacatcagtaagtgttggctggaattattttcctctataccctaagactcctgagtcccccttgtctccagcatgctgcatagatgctgaatctgtgagagcatcagcctagagggcctggacttttctgtcctgcttcacgcatggcctctgtgacctgatggacacctacccatgaccttggctccagcctcattagtcactaaccaagctccaaaagtctggctgcctcttggacagctctggatgtcccatggacccctgaacacagcacatctgccagctcttgtccctttcatccatgtgacaaacctgctccctcctccttttcctgcctcagtgattagtacaaccacccaccgtctaagccagagatctgggaagctaagttctactccagctccatctatcccattcagtcactgactcttacagtctatctccttagtatttgtccattctacacctttctttctattctcactacaaatctttcaacccttctcacctagcaagactgtaaaactcttttgcccccaatcacgtcccttaaatgcattttccacaattgcaggggcttttctaaaatgtacatctgattgtgtcacaccctgttcaacagtactgcttgaatacttgctcccacgatcacccatgaactgaagtccacattccttagtagggcactcaggcccctccctcggcagccctgcctgtacccctgcaacgccctttcctcttcacatgcaacacaccaggaactggactcctgcatctctcccgaatgactaatgccctctcatttctgggcctctgtatttgttactcctattgatcaatatcctctcttgtcctcagtacaaccaactctgaagccaagggaccacctttgcacatgagagacagtcatcaggaagcccaactgatcaatatgaaatcagtcatccacggccgggcgcagtggctcatgcctgtaatcccagcactttgggaggctgagg

SEQ ID NO: 226594 - DNA, 1012 bp, Homo sapiens
tgctcctcccctcttttgctgagcacatgcagtccaattggcctacattaactgcaggtgtgacgcagctccttagtaccttcatcagggactgcacactctactgccatcatttataagtcattcctccaaccccgaccccatgagctttgtttcccacatatggctcgagaaacatcagtaagtgttggctggaattattttcctctataccctaagactcctgagtcccccttgtctccagcatgctgcatagatgctgaatctgtgagagcatcagcctagagggcctggacttttctgtcctgcttcacgcatggcctctgtgacctgatggacacctacccatgaccttggctccagcctcattagtcactaaccaagctccaaaagtctggctgcctcttggacagctctggatgtcccatggacccctgaacacagcacatctgccagctcttgtccctttcatccatgtgacaaacctgctccctcctccttttcctgcctcagtgattagtacaaccacccaccgtctaagccagagatctgggaagctaagttctactccagctccatctatcccattcagtcactgactcttacagtctatctccttagtatttgtccattctacacctttctttctattctcactacaaatctttcaacccttctcacctagcaagactgtaaaactcttttgcccccaatcacgtcccttaaatgcattttccacaattgcaggggcttttctaaaatgtacatctgattgtgtcacaccctgttcaacagtactgcttgaatacttgctcccacgatcacccatgaactgaagtccacattccttagtagggcactcaggcccctccctcggcagccctgcctgtacccctgcaacgccctttcctcaaaaccgcacaactacatggaaactgaacaacctgctcctgaatgactactgggtaaataacgaaattaagtcagaaatatataatgttttcggtaccga

SEQ ID NO: 226595 - DNA, 586 bp, Homo sapiens
tgataggatctcagaataatggcagccaggtgatagctcttagcatcaaacgcaaggagggccataattaccatatgggtagaaggcttagaatagaatctggggagattgatcttcagaaatctatggttctggctcatagcacatgagtttgccaatggcaagtcatctgcttccaataagagtaaacttattgagacaaggggttgctccgttgcccaggctggagtacatggcatgatcacagctcaactgcaaccttgaactcctgggctcaaataatcctctcacctcagcctcccaagtagttgggactacaggaagctgaggtaggaggactgcttgaatgggaggttgaggcttcagtgagccatggctgtgccactgcactccagtttgagatgccatctcaaaaaacaaaacaaaaaaaccagacagtaaatataggtgttgtggccatatagtctctgtggcaactactcagctctgctgtagtgaaaccaaagcagtcgtagaccataaatgcaatgtgtcactcagactttataaagcaggtagcgggctggatttggtttttataccctgc

SEQ ID NO: 226596 - DNA, 947 bp, Homo sapiens
tgataggatctcagaataatggcagccaggtgatagctcttagcatcaaacgcaaggagggccataattaccatatgggtagaaggcttagaatagaatctggggagattgatcttcagaaatctatggttctggctcatagcacatgagtttgccaatggcaagtcatctgcttccaataagagtaaacttattgagacaaggggttgctccgttgcccaggctggagtacatggcatgatcacagctcaactgcaaccttgaactcctgggctcaaataatcctctcacctcagcctcccaagtagttgggactacaggcacatgccaccacacctggctaacttttttgtttctttgtagagatagggtctccctttgttgcccaggctggtctagaattcatgatatcaagtgatcctcctgcctcagcctctgagtgttggaattacaggcaggagtcatagtgcctggcccaaacttaactaaaaaacagagaaggcaaggtgcattggctcacacctgtaatcccaggactttgtgaggccaaagtgggagaattgcttgagtccaggagtttgagaccatcctgggcaacataagaaaaccctgtatctacaaaataattttttaaaaattagcctagcgtggtggcacatgcctgtggtcccagctgttcaggaagctgaggtaggaggactgcttgaatgggaggttgaggcttcagtgagccatggctgtgccactgcactccagtttgagatgccatctcaaaaaacaaaacaaaaaaaccagacagtaaatataggtgttgtggccatatagtctctgtggcaactactcagctctgctgtagtgaaaccaaagcagtcgtagaccataaatgcaatgtgtcactcagactttataaagcaggtagcgggctggatttggtttttataccctgc

SEQ ID NO: 226597 - DNA, 639 bp, Homo sapiens
  misc_feature (163)..(163): n is a, c, g, or t
  misc_feature (531)..(531): n is a, c, g, or t
  misc_feature (540)..(541): n is a, c, g, or t
  misc_feature (567)..(567): n is a, c, g, or t
  misc_feature (581)..(582): n is a, c, g, or t
  misc_feature (592)..(592): n is a, c, g, or t
  misc_feature (607)..(607): n is a, c, g, or t
  misc_feature (613)..(613): n is a, c, g, or t
  misc_feature (618)..(619): n is a, c, g, or t
  misc_feature (624)..(624): n is a, c, g, or t
cccgggctgcaggaattcggcacgatgccagcacaaagagagcgggcaccagtatctgggacccaggagaaaaacaaaattaggcctcgtggacagagagattcaagctattattgggaaatagaagccagtgaagtgatgctgtccactcggattgggtcangctcttttggaactgtttataagggtaaatggcacggagatgttgcagtaaagatcctaaaggttgtcgacccaaccccagagcaattccaggccttcaggaatgaggtggctgttctgcgccacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacagtatatttctccatgaaggcttaacantgcaagttnnacctactggctctgtctctggatggncccagagtgatccnnatgcaggatnacaacccattctttncagtcngatgnntactnctatgggcttcgttt

SEQ ID NO: 226598 - DNA, 626 bp, Homo sapiens
tagagatggggtttcaccatgtcagccaggctggtgttgaactcctgacctcaaggaatctgcctgccttggcctcccaaagtgctggggggaattttttttttatttttaatgcagaaacaagaaaaaaaagtaccttatattaagacctatcattggctgacccgatcccctcaagaacagtcattgtgggctgggcacaatggctcatgcctataatcccagcacgttgggaggccaaggtgggcgcatcacaaggtcaggagattgagaccatcctggctaagacggtggtctactaaaaatacaaaaaaaaaaaaaaaagtagtcgggcatggtggcatgtgcctgtagaaccagctactcaggaggctgaggcaagagaatcgcttgaacccaggaggtagaggtcgcagctattttgctttaagggatatttccctttctttcctgaatgaaagaagatagagatctaaaccacaattacagaacagttggcattaagcaagtgttacagtagttaccataatgatctttttgttttttgcttacaatttttttcaatatattttttgaccaaatttcttaaaaacaactgaaatgcaagactagtttttatttaaaga

SEQ ID NO: 226599 - DNA, 464 bp, Homo sapiens
gaaatcaaagaagacaaataaatgttgggatacaacatgttaatgtattggaagattacgagtaaaaatattaattctccacaaattgatctataaacaacgcagcgccaatcagaatcccagcagttttgtcctgctggaaactgacaaactgattctgaaatatataagtaaatgaaaggctcagaaatagccaagagaatatttgaagaaaaaagcaaagctggaagacttacaataccaaatatccagactgatggtaaagctgttgtaactaatgtagtgtggtatggccttaccaatggacaaatcaatggaacaaaatatggagtccaaaaagaaaataatatactcacttgatttctgacaaagttaatcctgtggtacactggagtatgagtgatcttttattaaatgttgccttgtcaactctatgtagataaaataaatctgtgttaccagat

SEQ ID NO: 226600 - DNA, 421 bp, Homo sapiens
gtctctataaatactacataccactactcactgctgggaaaaagtaatcaataaccaatgaagctgcaaggcaaataaatttatctttcacagactacttcaacatcagaaacactggtccaacaagacatctaagggggactggaagccctggagttgcgtgtcatctatgaatactcagcagtgggaaccagagcacgaatcagaccaaaagtgcgagaaggatcccagagaagcaccaaaaccatcatagacaacactggagaaagtatttaatccaaatcaacaacccaaatcaatgctgagcaaagattagatttacatctagttatgtgttgggatcgacagagttaattaattgctctgaaaaagcaattaacttcattctatcaattaactcagatctgtttctaaagttaaa

SEQ ID NO: 226601 - DNA, 530 bp, Homo sapiens
tcagggacccagcacaaagcaataaatttagaaattgttcaataagtaacaatttgttcaactgagcaaatgaacaaacaccatcttagagcaaatgagttttcagatctttccctgccagcttgtttgtgatgggggcactaagcaaaccagccaaggagtaaagaggcctaagacacagcagtttgccaatgtcttcatttccttgggctggccctgagggacgctaaccaaggctggattctgactcctgtacctcaggtaatccaactaataaaaaccttccattaaccaagatcctccccttttctctattattagaaaaaaagaagttataagaaaacagtagggattttatcttaaataaaatgacttctcagggttggcctttaactgggtataaattcaactcaacctcctaaaccttctccagcaatgtttcccaaaatgtgttccaaggaaactatggaagactctctgagaaaagggatccactaaagtccaaaattctcccctcctagcgatccatt

SEQ ID NO: 226602 - DNA, 409 bp, Homo sapiens
cagggcagggttcgggccagcgcctgggctaggcctggtgggcccggcgcctcacatgatgtcgtccagcaggttggcgctggccacccagtcgagcgcgcgcggctcggaggcggccatgatcatgcacatgaaggggcggccggtgcgccggtccgtggggtagatggtggtgggcgtgaagcgcctgttggcctcgacgaactcgcaaagctgctcgtagacgcgcgggaactcgtggcgcaggaagacgccgcgcagccgcagctcgcgctggatgtggatgaaggccacctcgcgcgcgcgccggcccgcctcgccgtcctgatccaggcccgccgtgcccggcggtggcgtcaggatcagcgtctccatgtcgggctcgcggctccgcgccgggggcggccgc

SEQ ID NO: 226603 - DNA, 212 bp, Homo sapiens
attgtacccagaaagaactggagttagttgaggcactttaaaaatattcaagaaactcacaaattaaccgtgtcagtgcccaagttttgttcaggaaaaaaaaaaaaatccctttaaggaggaagtacttgaacaagaattttcatgagagttctaggatcaagccatttagaaaactgatattctcagaagcttgggagaaatatatctaa

SEQ ID NO: 226604 - DNA, 474 bp, Homo sapiens
ctagacaggtgaagttacttgaacaggtttacatagctaatgatggaagatccagaactggaatcaaggtctctatagactctctctcctcatctctaaaatattataaaaaatacatttctgatacaaatagctgtgtcacctagtaggttctctgttgatgttggcagattctgaaccctaatgcctttacagttcctgggatgcatacattcctgaaacagagcaccagccctggaagagttcatggtgggatagtggaggcagacatgtctgtctctcacttatttcatcctcttcccaggctgtaaataaccttggttgggccaggcgcggtggctcacgcctgtactcccagcactttgggaggccgaggcgggtggatcacaaggtcaggagatcgagaccatcctggctaacatggtgaaactccgtgtctaataaaaatacaaaaaattagccaggcgtggtaaa

SEQ ID NO: 226605 - DNA, 433 bp, Homo sapiens
gaaaatatccaaaagtgcgtccaacctacacaaaagaatgggcaaaagggacacatatcaatcaaattctgtatgagaaatatgaacgatagagctgcaaacctcaatctacagcacatatcaagcaatcaactttttcttgtaatgtcattacttttctccgctatttgagaccacttccaacatcactagtgacactttgtatgggtcccagagtgttattcaaggtttacagtattgcactaaacacaaaaaatacatgagaaccacaagagatcactttttactcactgtacaatttactggagagatgaactgctcacgtggaaatgattagcgtcgcatggcattttaagtggatactcacaatacttgagctcactagaatagcaagaggaggtggctacgaactattatagtacagtaggtagca

SEQ ID NO: 226606 - DNA, 292 bp, Homo sapiens
cactttggaaagcagtctaaatgttaaacatagactaagttaccatgtgactcaacaattttattcctaggtatccacccaagaaaaataaaaacatatgtccattcaaggttcatccatgttgcagcatttgtcagtacttcattccttttcatggctgaataatattccatcacatggatataccacattttattcaaccatccatcagcagatgaacatctgagtcatttccatcttttggctattaagaataatgctgctattcatgtacaagtctttgagtcgacgc

SEQ ID NO: 226607 - DNA, 542 bp, Homo sapiens
gtattgtatcgatttgtggtgtttggatatagtttttccatgatcccctacgaaaatatgcctctcatatgtaagaatcatgcctcctccgtgtacacttttcagacactgacaaggaagggtgttcaatacagtactgaattttcatatagcttttctgggggggccaaaataccaaaatcaacccatttcctacctttattctgtccataaaattgttagaaatatcaaaatcccatttcattccctgttaaatacatgtgaacgttgtctagacgctggagagcaaattctaccacctcttttgttcagcagtacatcagacgattgcatagacgtgccagatggaaccaaataataatgcacatggatttgtcataatccgtacaagtcattgacgcccacactgagccaggtgctgtgggagacaggaccatgtgtgaaagagaagacatgcttgcttctataaaagcatcggtgttattgaggagacctgacattaatgcagaatagcaaatgaccatgcaaattaattcactact

SEQ ID NO: 226608 - DNA, 448 bp, Homo sapiens
ggtggggcaagattcagtagctagttttgtctttttaaaaatgtctgtagtaactcacctttgatgatatgtaaacgtcttcaggcttgtcaacctccctttattatcaaaagttttacttactttttttacacgtaagactatcttgaaggtgatataactgaaatgaatgggcattagcagcctgaaatgtacagaaccaatattgtagtctatattcaaaatcttaaatcaagctttgattttcctataaaatgatcttttgattcctggccttcgaagaataacccatccttgtgttttagagataaaagtataactttcagttggtgcagagatcacagtgtagtagaactttatacctggaaggatcttagttgttcttagtccagttctcattttacagatgaaggcactgacatatgtttagaaaaaatgtgatttgtcc

SEQ ID NO: 226609 - DNA, 400 bp, Homo sapiens
tggagcctcctttataagcgtactaatttctttcatgagggctgcgccctacgacctaattacctcccagaagaccctacctcctaatatcaacaccttgggggttaggatttcagcatataaatttggaggtttggcattcagatcataataccatgtagccatattttcgtgcacattaccatttcaagcaaattgcctcttttgaaaaaaatggctgaattggttataggatatgtcagggtaagtttctgactttttttttagaatttagtatttattttgtatttaaaatcttgagtttttttcaggaacattgaaatatctctgaggagacgctttttaatgattttgcctcaaatgtaaaaatttaaaaattttagcaagatctgcataaacg

SEQ ID NO: 226610 - DNA, 388 bp, Homo sapiens
ataatccagccttatcccaaccataaaataaaagcagaatggtagctggattgtagctgctattagcaatatgaaacctcttacatcagttacaatttatatgcagaaatatttatatgcagaaatattgctattgccttaacccagaaattatcactgttattctttagaatggtgcaaagaggcatgatacattgtatcattattgccctgaaagaaagagattagggaaagtattagaaataagataaacaaaaaagtatattaaaagaagaaagcattttttaaaattacaaatgcaaaattaccctgatttggtcaatatgtgtacacatattaaaacattacactttaacccataaatatgtataatgattatgtatcaatt

SEQ ID NO: 226611 - DNA, 459 bp, Homo sapiens
gagtgtgtgtgtgggtagagaaaacagtgtgaatgccctgagataagattgtgcttgatgtgctttcagaaagtacaaagatgtttgggtgctggaaggggtaatcatgcaaataatagagagataccagggggccaccctacataaggccctgtaggccaaggtaaggattttggattttactcttattgacgtagaaagctattttaaacaagagtgccatgattgtcatgaattaaaaaaaaaaatcactctgacctctgtggggaaaatacactgtatagggtggggagagaccagtaggatgccattgccatgttctggggaagagaaaatggatgctttggactagggcagtggcaaatggaggtggtaaaaagtggttgtattctggtatatttctttttttctttttctttctttcttttttttgagacggactctcgctctgtcgcccaa

SEQ ID NO: 226612 - DNA, 463 bp, Homo sapiens
gtatgtaggtttttcttggttatcagaattaccatcctcttcttggccacttcacatttgaggttgctagccagggaaggttctcctgagtacagagtctccttgacctacagtggagttacgtccagataaacccatcgtaacttgaaaacaccctaagtggaaaatgcatttaacacgcttaacctactgaatagcttagccttgcctaccttacatgtcctcagcaacttaaagtagcatagagttaggcaaaatcatctggcaacacagtgcactgtagagtaccggttgtttaccctcacaatttcatggccacatgagagctgtggctcactgccactgcccagcatcacatgagagcattgtactccatacctgtagcatgggagaaaatcaaaattcaaactttgaagtacagtttccactgaatacttacagcttttgcaccgatataaaggta

SEQ ID NO: 226613 - DNA, 412 bp, Homo sapiens
gaatatgttattaaagttaatatcacctgtttctttttacctttatttaatgtgggtactagaaaaaattaagttacctttgtggcttgccttatatttatattggcagcactgatatcaaagctcagtagctgggcgcagtggcttatgcctgtaatcccagcactttgggagtccgaggcagggtgggtggcttgagcccatgagttcaagaccagcctgggcaacatggtgagaccctgtctctacaaaaactacaaaaattagccaggtgtgttggcacatgcctgtagtctcagctactcaggaggctgaggtgggaaggtcgcttgagcctaggagattgaggctgcaatgagccgtgattgtgccactgcattctagcccaggtgacagagcaagcccctgtctc

SEQ ID NO: 226614 - DNA, 200 bp, Homo sapiens
agagttttcagtttaaaattgggtaatatgtgcatacagaatttacctaaaaatgaaatacaaaaacctcagactgggccgggcacggtggctcacacctgtaatcccaacactttgggaggccgaggtgggtggatcacgaggtcaggagatcgaggccatcctggttaacatggagaaaccccatctctactaaaaaa

SEQ ID NO: 226615 - DNA, 220 bp, Homo sapiens
agtgaagaattaggctggttttgtaggtgctaagagggtcagtggaggaacagcagctccgcggaggtgggcttcagcccagctgggattttgtcattttcttcctggggtgcacaaggcttgctcgaggacctgtggtggtgagtgctctgtaactgctcaggcggacaggaaaccgccgtggagcacgcagcactgcctggcggtggttgctttggga

SEQ ID NO: 226616 - DNA, 461 bp, Homo sapiens
gctcaccccccagtgggtgcatctgtcccagccacacactcatggcacccaaaacacatcttggtcccatcctcccccgattgccagaacacacgttcaagtaccccctcaacatctcacgggcatctcaagcttatcatggacaagccgaacttttgagccacaccatccacaccgagctgccctacgccctgacaacttctcctagcaccctgcatctcagtgagcacagccccagccaccagctgcccaggccaaaaaccttgcaggcttcctcagctcctctccttttctcatgcccaacatccaatccagagacaaactcttttcaacctacctccaaaaagaaacttgggcacatgcctgtaatcccagcactttgggaggccgaggcgggtggatcacctgaggtcaggagttcaagacctgcctggcccacatggcaaaaccccatctctact

SEQ ID NO: 226617 - DNA, 447 bp, Homo sapiens
acaattttgagaaagaagtacaacatggaggaatcagccttcctgatttcaagacttgctgtatagctacagaagtccagaattttgtagtattggtcaaaggatagacattatagatcagtgaaacagaattgcagccccacacaaatatgcacaactgattattgacaaaggtgcaaagataagtcattgggggaaaaaaccttttcggcacatggtggcagagaaattgaacatccctaggcaaaacaaaacaaaagcaaaccccaaaccaaaaaacaaaaaacccatataactataaaactttgagaaaaaaacatagaagagaatctttgagatctagagctaggcaaatagttctcagatttgacaccaaaaacatgatccattaaaaaaaaaataagttggatttcatcaaaattaaaaactttttaatgttttaagaag

SEQ ID NO: 226618 - DNA, 740 bp, Homo sapiens
gtctttaacggtatttctgacacaaacacaataagcctcttgggactgaggcttgtcattttcttaatataaactgagggtattacacaaagccagttcattaaatacaatttgatgaaggtccaagaaatgcactctgaggatgcacaggaccttgtggaggtccagcttaacccaagggtagaatttagatattgagaagtataaaagaattgtcttcttatgattcagcttttgattaaaacagggcactggatagtttgagattagattgtctaacagcacgcggagtgtccttagggaagatccgtacagttaatgtgacagtgtgacagtcgaggtaagttgataggttcttaaaatcatagaaagcacctaacaagggctcctacctaatgtggcagccccaccaccatagcaagaaagtctacgctagtcttcattttaagaaatcactattatatgttcactgatgcccccctcccctctcaaatatagcacaaaattatatatactcatctggaaataagatacttatctattaagatactttaaaaaattaaataataaagattaacaaagttctataagggccattcagttgcaaatttgaactttagaactcaggttttctaattcctcgcccagtgttacttgcactgtttaggtcttttttttgaagtatgatacacctacagaaaagtggtaaatgtaaagtagatttagagattcaaaaagaa

SEQ ID NO: 226619 - DNA, 437 bp, Homo sapiens
atcttcctggtgctttattttcctgtgactggtcttgtgtccaatttgcaagacataatcctctgtactcttctcttgccttcctctaaagagaaggaacgtgtccatgtgctgcattgcctggagttgagggagtggtgatgcaagtactcttgtgggctgctgcaattggtgttacactgggtcacaccccaagcccactgctatggacatcagaatagcaccagggcttgcccaaggactgcagtcactgtgtcctgactgccactcagatttatttgggccctcaggccatttaattagctagtggtgaagatgactgggacttggtttcctccttctgaagcagaggacttccctctggccccgggctgctgtatatgctccttccatgggcactggtagaattctgtctggtaatgaggaggaaattaaag

SEQ ID NO: 226620 - DNA, 444 bp, Homo sapiens
ttgcagccaactagcaatatctcattcccagccccgtctcctgcctctgttaaaagaggtgggaaaagtgagtagttttcaaggtccgtttaagctctgctattctctggactggttgttcagctgacctttccctggtgggagagtcagaaattcctgtgccagccttagcatctttctgatacaatcctttgaacctctttgacacagtggtttccccattgttgatgagcagtgcatgacacaaggcttctctaacagcagcggggaaagacctctgcatttactgtgtttgtttatttctcttgttctgaaacagtaaatgctgttatttcagggtgacttacctaattcttacagtgtttatataacaccagtaaacatccatggaaaacatctttaaaagagatcattaaacacacttaacatctgtgcctaattaat

SEQ ID NO: 226621 - DNA, 513 bp, Homo sapiens
atacaattgtcactggataccattaattacacagcttgataggaaaactaatgaatatagaatatgtagctaatctataactttttaaaaattcctggaaaatgtgtaaatgaaactatgttgttggttattagttatcttaaaaatagatccattttctctgattttctcttacataggctaactgtagttatgcaactattcttaatgagaatttaatattatgagctattaacatctctaaagagttgtttttgagtgaaggtgctgtttattagcatcattggaaaagttttgcagccaaataagttcttgggattttacctgtagctgcaagagtttgcatgaatagtactgcttaaataagtccacctatgtataaacaaagtgttaaggtaaagtaagggataaaaagaggaaaacttctccagcttttggtgtatttgaatgaatgtactcttttgcactgtttcaaaatatatttaaaatacaaataaatatctaaaaataaga

SEQ ID NO: 226622 - DNA, 444 bp, Homo sapiens
ctgggaactggggctgtactttgcttataggaaaaaaaagtgtgctccttatgaacagaagcagctgctatgttggaaacttcatcgaacagatttcctactgtttggctgctttcagaaaattctgcctacttgaaataagagatcaaagattctatcaaaactcatttcaaatttaataatgaaatctagtcttcaatcaaacacaaagaatatgtaacttgaaagcaccacataatcagtatatacacatatagctcttaccatagtgaatactctagactataaattctgagccagagaaaagtttctgtgaatattgcaaggaaacaaaaatatctctaaatgaattcttagcaaatggttttaaaaatatacaaaattttaatttaaaaatacctaagaagctttgaaatatttactcaaaaacttagaaacataccc

SEQ ID NO: 226623 - DNA, 570 bp, Homo sapiens
cgtggtggtgggtgctgtagtcccagctacttgggaagctgaggcacgagaacagtgtgaacccgggaggcggagcttgcagtgagcagagatggcgccactgcactccagcctgggcaacagagcgagactccgtctcaaaaaaaaaaattcgctaagtgtggtggcgggcacctgtaatcccagctattagggaggctgaggcacaagaatcgcttgaatgcgggaggcagaggttgcagtgagccaagattgcatcactgcactccaccccgggtgacagaacgagactgtaacaaaaaacaaaacaaaacaaaacaaaacaaaaaacaacaacaaaaagagatttccccataggccttgggaacagaattcagcacccattctcagaggagttataccctactggcgtcagccacactgcaagtaccagaaaaacagaaagctttaaaaatgttttttggcaataatgaatgtgtgacatctttgggagacaagaatggagaaaggggacacgacattattattgggttaataataatggcaaaactgtcatgacaaatataataa

SEQ ID NO: 226624 - DNA, 436 bp, Homo sapiens
tggttttcttatctccttttctgttggtcacactgaaaccacctccaataccacattgttaatggaaattcacacacttattaggtttttccttctgtagaacccttccaactcctcattgttcttaccaaagaaagaagatgaactgtgagattatttgaggccccccccccctttttttctggtggaagtaagcaaagaacggaaagatctcacctttctatggataaagtaaaactccaacatgttatcgttttttaactgagttatttcataatgttgaaacatgaataataacaaaataattagattggttcttagagaagggattttaaaatataaaagctcattaaagcacttttcttgcttagtgtttaggtagaataagttcgctttaattccagtttgtgtcacttcctgtctctctctgaatagt

SEQ ID NO: 226625 - DNA, 246 bp, Homo sapiens
ggggacagcaaattattgaaggcactgtgtatcatccaacagccagctgatcccaaaatagttgccaccatgtaagaagtgcctttcacctccggctgtgattctgaggcctccccagccatgtagaactgatttattgttcctggtgttttcagacttcacagtgatgaactcagatgtggatccttatttcctgtgccaggatgtttcatcttgaagactggtgagattgggaaattccttttg

SEQ ID NO: 226626 - DNA, 266 bp, Homo sapiens
cttggaggtacttagagataggaattcaagatgaattttgaaggatgcacaattcagcactcagcccataacagacatttggatccctaaattacataaaacaacaacattggtcctattaattatttcattcattgacaaaatatatgtccataggttatgattatatattcctttaaattgtatagcacgtatgtaccccaatgatataaatatcttctctttccattctactcctatcctcttcttcatcgtatcctttttcc

SEQ ID NO: 226627 - DNA, 395 bp, Homo sapiens
ataatatgggtgaataatgggtgaatctactttgcttggatgaatggagaaggcttttgcaagactgagagtttgctagccagtgatttcctcatttagtccttacaaccataccctttagatactattgtcctcattttctagatgaagttactgagactcagaaaggtagggtaccttgtccatgataatggaactggtcattgaactgaaaccctggaaggcaacctgacagtatctataaaaacaaacaaagacaaaaaacaaacaacaactaaacatgcatagaccctgtgtcttagaaattccggttctaggaatgtatactacaaatgtagtttcccatgcataaagatgtttaaataaaggcgttgattacagcactgttgctagcg

SEQ ID NO: 226628 - DNA, 476 bp, Homo sapiens
atatgtgccacattttcttaatccagtctatcattgttggacatttgggttggttccaagattatgtatttattgagttctaattttctctcggacatggtactaagacatggtgtgatgggagagagagatgttagaaagacacctctctgaggaggtgacctttacgttgaaattctgaagaaagtagggcaggtaagctctaagtagaaggaaaatatgcaaagacctagggcagaaaggagtttggtccgttagacaaactcagagtaatcctgtgcagtgggagcttagtgaatgaagggaagagaagtgagagataagtttggaaaagtgagaaggaatcagtggggcagtctttctcccagatactgtcactttatcataaattaacttagtgaaactacactagagctaaaactgttactttaccttgaatataaagggagaaaatgctaagaacatttgattactgt

SEQ ID NO: 226629 - DNA, 611 bp, Homo sapiens
ggaagagctttgctcaaaccagccccctgacagccagtccctcaggcccagaagtcatgaatcgttcctccaataagtcattcagttggctggcagcaaacactgttaagattctggatggcagctgcatttcatattagattttaacagaaactcatgatgaaaagtctttaagacctaaacgtccaagtatattattgtataattttgagtattagaaaatcagtaggatgttctttcagcatttctgaaataacagtgcaaaaatagctccagcttcataaggccaacctttggtatctgtgttctgcaaaatagggtaagcaagatgccacaaaagccaggttgtatgtgtaattatcttcgctacaacaacaggactatcacactttaagcaaccctgtgggtctttaaaataaaaaaaaatgtaagacgtaaagaaaaactttcttgagagagaacattttacaaatcagaggaaaatcttgcagaacttttacattttataacaaataaattatatgctctattgttttcctctgagtacatcatcagtacttccataatacttttaatgtttaacttgagaaaaccagtagcttaaaaaaaca

SEQ ID NO: 226630 - DNA, 248 bp, Homo sapiens
tggacattttaaaaccttagttaaacctatcaggatgttcattgccctcccttagaaaatgcccaaaactgagaatctgagctaactggacagtatacacaggtacgctctgtgtatatcagagtccctgcagaagtcaagaaattacctaaatacatttggcccaccatagccattatagagaaaagacaaaatatctgctgttcatggaaataaattataaaatctgttgaaccatactatgttct

SEQ ID NO: 226631 - DNA, 569 bp, Homo sapiens
gatgggtgctaagggactttgtagttccctgaagttccagtgagtaaaaggtacccttggaattttttattccttcagacttttaaaacagagatcactttcaaaaattactctttctgctttgaatccatgttttagtaactattttgacactgtttggtcagaaggctgtgtgggtcaactgcaaataaataaaataaatgtgatttcagtaatttccattttgtaacaagtaattgagaaaataggattggatcagatatttgcttatacacattccctttcaggagcacttctgttctataaagaatgttggtatattgttaaggacacttcaagctttgggaacctttgaagtatccattgattcagttaacaaaattatgttgagtgcctaccctgggcctgggcctgtgttaggaggggacactaagatgagagtccaaagcacttcttctcagactcctggctgctaatgggttgctgcctctacttcttcacttagcagatagctttaaaatgagtaatgcattttaccatggagcccgtaagagacattcacccagttg

SEQ ID NO: 226632 - DNA, 171 bp, Homo sapiens
taagctcttccacattctactaatagatttcatcctctccccaccccaccccacttctaagtgacctggaatctgtttctgctgatctcaaccaaatgcaaacgaatgcacatttcgggcagcaggttgggggtgatatggctcatgatctgcagcataggggagcacata

SEQ ID NO: 226633 - DNA, 478 bp, Homo sapiens
atacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaa

SEQ ID NO: 226634 - DNA, 477 bp, Homo sapiens
ccaagaacttaggaagaaacacagcacaagagcattaacaaatgccagacttaagataaaggtatttttaaaaacgacagatttgagatgtttcaggtaaaaatctggcttagttgacaaaatttcaagaaaaaactttgggttggcggggcagaaggatcaaactgtctgtccaagttaagtttatcaacactgtattacacaacatttgtgactataatattgtttgtttgagactgagtcttgctctgtcacccaggctggagtgcaatagcacaatctcggctcactgcaacctccacctcccgggttcaagcgattctcctgcctcagcctctccagtagctgcgattacaggtgcgtgtcaccacgcccgtccgattttatttttagtagagacggggttttgccacgttggccaggttgtgcgactgtaatattaatttgcctctgagtctgcacacttagtagtccttt

SEQ ID NO: 226635 - DNA, 787 bp, Homo sapiens
tatctctagatgtatatacaaatggccttccctctcttataggacattgccgtcaattcccagcagccttgatcctttccttttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcatcgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcgg

SEQ ID NO: 226636 - DNA, 511 bp, Homo sapiens
cagggtggacagtatgattgcaaggcaagcaggggaggaagagccacttgagacattgctctcagctgctggggaggagctgcgagcaggcagcggtgggaaattgaggcttattgtgagcaaggtgccggcctccggggcgacggggagcgcagagcagcacatgaaagctgcctgcggatgagctgggggatggaccacacatgtggattgcaaggacagctactcagagagttcacattcctcccccattgaactgggtatgattgtaatggtttgttaaacaaacaaaggacctaaagctgtgaatgggagagaaaaaagacttaaggtgaaaaggagaagaggccctgcttgctagtgttccactctttttaagctttctcccccatttccttaacattcctttcccctttcagaaaagccagtgttgtcgcttggaaaacttgccttgtctcttcagtgccattttcttttaaaatggaaacctgatgaaatgttaatcagttta

SEQ ID NO: 226637 - DNA, 258 bp, Homo sapiens
tttcttctgataaacctggaaagctcagcctcccaggacctccatggactaggtcccctgtagtgataccttcttgatggccctgcccaaggccccagtcctgcaggaatacatggccatggaacccctgtctgcagtgagcaggggttcctgccaggaagggaaggggccgtgagcagcggggttcaccttctgacagcacaggcctcgctcctagatgtgtccttacagaatgtatgcaggcaatctccggcaccc

SEQ ID NO: 226638 - DNA, 181 bp, Homo sapiens
ctccaagctaagtgttcaggttgtagaaatatcacaacactaagaaatagtaagacatatgtcacacacactttagacagcaacagctgggctgagctgactgcaacacacaagtgatacgatcacttagtggctgtgtgcacccaaactacatggtcaccctcaaaatgttcaaaataaa

SEQ ID NO: 226639 - DNA, 102 bp, Homo sapiens
gtgggtgtggactaggactgtcccacctgggacatgtgggtcacccatcttattttcccctcatggggcctttcttctgtttgcctttctgctcctccactg

SEQ ID NO: 226640 - DNA, 707 bp, Homo sapiens
gcgaggtgggagcatggatgaatggtgcacagggatcgctcgctctatctcaaagtctctggaggaggaagcgttgttaccaggtcagagcaaggatcaggctgtatacctaagtgtgcgaatgtgagtgtgtcagtgtacactgtgtgtgtgtgtgatgagtcgttctgagtctatgggtctaaatgcaaacatatgaaattgctcactaacagtgtggacagggaagggataggggctcctaaatgcagtccaagcctccagtggaatgtcctgggacccaggcatatccgcaggaaccgataagcagcaaacaccctgccactgtttccctggaaagagcaaaatcgcaactccatcgaagccgaaggcgccgatgtccgtcctgtggtctcactgcagaaatacgcgccggttcctggaaagaaaacagtcccagaggctccaagaaacacccattctgagctaggctggtcccgtcctccccactctcccatccctgaccgccggcagaattacctgacctgtccccactgctccagatcgcaacccaatcgcgcgcccacctcccctccccgcctggttgcgcgggtctgggccccactgggataaaggaagggaaggggggcggagatggggccgccttccttccctgccccacccgcacgttcctccgcctctcccccgggtgaatggtgcgcggccgc

SEQ ID NO: 226641 - DNA, 457 bp, Homo sapiens
catgttgaccaggctggtcttgaacacctgacctcaggtgatctgcccaccttggcctcccaaagtgctggaattacagacgtgagccaccatgcccggctgagagtatctttattcttaaaaaatcaaaatgtttaggaaggcaggagacactaatagggctgggctagtcttgtggaggcagtggatggacgctttggctggcctagggaagaatctgtgattcagtgctgcagggatcaggtgatcctggtgagagaggtcctggaacaagggttaatttggtcatttttggaatgacctgggatttggcttatttattttatttttaaaatttcccgctgggcacagtggctcaaacctgtaattccagcactttggaaggccaaggccagtggatcactcgagctcaggagttcgagaccaccctgggcaacatggtgaaactctatctctc

SEQ ID NO: 226642 - DNA, 468 bp, Homo sapiens
aatgaattactgtattcttttgtatttaaggaatactgaccacattagaaaatgtaaacatttaatgcagagacgtgtttttgctagagttgaaatgtaatatttgttaacacagaggggagctaaaatttttggggggagttaattgatcatctagaataagggtcagaaatccttatagaggctgcgtgcagctgctcatgcctgtaatcccaacaacttgggaggtcgaagtgggaggatgccttgaacccagcagttcaagaccagcctgggcaacgtggtgaaacccggacgctacaaaaaaaatcaaaaaattagccaggcatagtggtgcatgcctgtagtcttagctacttaggaggcagagttgggatgattgcttgaatcctgaggtcaaagttacaatgagccgagattgtgccaccgtatgccagcctgggcaacagagtgagactccatctcaaa

SEQ ID NO: 226643 - DNA, 444 bp, Homo sapiens
gttttacttcctcatatgtgtactgaagtgttctttgctgtctgatgtatattaaggggtcttcagcaattatgaaaccattgctgcagaagcccagagtcacatactatagaaatattctatagtaaggacctaacaggattcacattaaacagaacttgactataaactaatggattcctactacagataataggaaatgtggttttttttttatttttttgaaacagggtctcactttgccacccaggctggagtggggtgacatgatcatggctcactgcagtctcgactcctgggctgaagtgatcttcccacctcagctactcaggaggctgaggcaggagaatcacttgaacccaggaggcggaggttgcagtgagccgagatcacgccactgcactcaagcctgggcgacagagcgagactccatcccaaaacgaa

SEQ ID NO: 226644 - DNA, 1350 bp, Homo sapiens
cagcaagccatcgatacaatttgaaaagaaatctatctcacaagagcgtagaatttgtccttgagatcatacttattattgtcagtagtaaaagaaaaagttaaccttgtagccactaataaaattaactgtatataacaaatattcagaagagcttcaagagtctaaattggtaagatgactcaagtattacttagatattaaattaagtactcataaatttttaagaaaccaacaatatatacctactatgtgcccacagaaatcaaaataaaatatttaagaaagcaacaacaaacacacacctttttacttgggcaaagaaattaaatcccataatttattagtatatagcaaatttgactcaaatatttgagactttcagtatctgtcaacaattttagagattaattcccaggactttaaaaattcctgaatataagccatttgaaatcagtaacagtaggaaatactgctttttctccctgaactttttaaatgataaaaaaaacttgaagaagtccatcaatatttagtatttatgttctcaaactatcacttccttttattgtctgtaggagtttaagccaatttcattttgattaatgttctctctatagctaatctttaaatttttttgaggctggacatggtggaagaataaaatcagtcaagtggtagattagcccaattgacttttatatcccagtctctgttatcctgacctaacttttttcctctatcaaatggagaaaaaatgatcagaaagatagtactatgctaatgtggaagagtattttaaaaagttttcaaaaactttgtgtaaaaggggaccagaatatacccaacatttccaaaagaagcaaaaacaagtagattctaatcagttcttgataatctacaatttcttcaagctaattacagatcattataactttgaggggtgactccaaaatctaactgtgacacaaatgtgctgaatgattaacaattcacttcatcttgtttctcagtactcattcataaaacaaatgctctcatatttttttgagaaaaactttaggttacctaaaaatgagaggacagtgtttcaaagaagatcaatgaagcatttttatatcagaagaatttaagaaacaaagatcccttgctttaacaggtcttagaaaaatctacgttcaatactggcttacttgcccagcacctatagcctaagactatactacagtctaaaggtctaaagactacaggctctaggcttagtcttagtctttagttagattaaagactatagtctaaagacttactcattcagcttctacaatttccactcacttttcaccttatgca

SEQ ID NO: 226645 - DNA, 601 bp, Homo sapiens
tcgagccggtaccacactatgtaatactatgctaatgtggaagagtattttaaaaagttttcaaaaactttgtgtaaaaggggaccagaatatacccaacatttccaaaagaagcaaaaacaagtagattctaatcagttcttgataatctacaatttcttcaagctaattacagatcattataactttgaggggtgactccaaaatctaactgtgacacaaatgtgctgaatgattaacaattcacttcatcttgtttctcagtactcattcataaaacaaatgctctcatatttttttgagaaaaactttaggttacctaaaaatgagaggacagtgtttcaaagaagatcaatgaagcatttttatatcagaagaatttaagaaacaaagatcccttgctttaacaggtcttagaaaaatctacgttcaatactggcttacttgcccagcacctatagcctaagactatactacagtctaaaggtctaaagactacaggctctaggcttagtcttagtctttagttagattaaagactatagtctaaagacttactcattcagcttctacaatttccactcacttttcaccttatgca

SEQ ID NO: 226646 - DNA, 425 bp, Homo sapiens
ggcgttttagttgaaaacttagctacacctgatcagtgtactgcagaactttgatgagtgggagtccctgatagattcctggttctaggctctttgccaccagatcaaccagaaaaaggtggtgttttgttttgttttgttttgttttttgagactgagtctcgctctgtctcccaggctggagtgcagtggtgcgatctcggctcacagcagcctccgccttccgggctcaggcgattctccttgcctcggcctcccaagtagatgggattacaggtgcccatcaccatgcccggctgatttttgtatttttagtagagaccaggctggttttgaactcctgatccgcccacctcagctgggattataggtgtgagccaccgcgcccggccaggtgttcttcatcagactgcagggacacctcc

SEQ ID NO: 226647 - DNA, 561 bp, Homo sapiens
tacctgattggcatgttcctatttgcatgtccccctctccccatagttttcaaaccctggctgcatgcagcaggctgtcatgattcagcagaactcaacacattgggtatttttgggcttgaactctcttggggggtctgtccacttaaaggaccattcagctgctaaatctccatctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactgcacttcaacccgggtgacagagcaagaccccgtctccag

SEQ ID NO: 226648 - DNA, 687 bp, Homo sapiens
tgaacaaccagaaggataaacaatagggaaacacgccaaaaatcttgaacttgagagtcagaactcacaggtaacaaaggtgtttagttatactatattaatgttttctaacttttaccatgagcatgtattcttttgcatctctatttgaatttatagcataatttttcacattaaaactggatttactttaataggcaatacagccgggcgtggtggctttacgcctgtactcccctgcattttgcctccagcagcatgacccctttgcagcctgtttaccaggaggcactcagctgtgagcctcttgccccacttgctggcacctccctgtcttgcccaacggtgctttgtggttttgtctccatttcctttggttgaatgacttcgaggtggaggggtttctcttgggcaagagcagtgcttcctcaatcactctgactgctggggtctttgcccctctgtcgggagcctcagcattgctcagagccttctctcatctccagaatcttgcaagtcactctctttccacgttgcccaacataaccctgtaagcccctcgagtttctctagtgttttccccacacattttgccagataagcctcatcaaaccaaccttgttagttagatggggcctatcacattattgtcttttgacagatgaggaaacaggcccagagttgaga

SEQ ID NO: 226649 - DNA, 414 bp, Homo sapiens
cagtgcctatttattcagaacttagtttcaggtctgttttgtactttacaaaacatctttcatgaaggatatatttgataatggaaagtattttttttttaaagctgtatagttctgaatcacaaatgattgtgctatcgtgtatattctgaaaagttcgtgattaaatcacctactgttgtgtgctagcacctcataaaaaatactcttcaatgagatcacatggacacaggaaggggaatatcacactctggggactgtggtggggtcgggggaggggggagggatagcattgggagatatacctaatgatagatgacacgttggtgggtgcagcgcaccagcatggcacatgtatacatatgtaactaacctgcacaatgtgcacatgtaccctaaaacttagagtataaa

SEQ ID NO: 226650 - DNA, 474 bp, Homo sapiens
agcaatctcattaatgtgagaaacaaatattatataaaatactgggatattatataaaatctcaacaagaaatgtatgggacacatggaaagaatccctaaaattgtgcttagataaataaagaggaatacttagcatttgtaaacatgtcattttttccccaaatagaattaaagttacatcacagggatagttaaaataaaggggaatattttgggaaatctgacaaatatttcttaaataaaaaagaaagtttgaaaaaatacataagaaaactagttcttagggagaaaaaaggaggaaatcaatggacccactttatcatgttatgaacactctcataataaaggagaaattagaaattaatacagtggaatagatagtcctgatgcattagttagactgaactatctgaaattaccaatatttaactgcttttgacttacaaaactggcaatttcatatcgttcaatg

SEQ ID NO: 226651 - DNA, 484 bp, Homo sapiens
ccggagtcagggggtgggggagggaggaccgaccgacactctaagaaggtctttggtcctcctcggtgaagagaagggttccatttcatttcctttgcttttctctcagtggatgaaaagatggggtcaggttcccattcccctcactggcgcactgagagattcgcgggtgcctaaaagctttctcctgaatgtccttatatctctgtcgggcgcgattttagattgaatctgcacggggcttggcgatttgtgtattccggtggggctgtcgtagggttctttttctttagatggttgggctttaatcttatttgttttcgaactctaaggtaggcttatcaggaatcgtttttgaattggaaaatttaaaggttttgtttgggattttttttaaccccgaaacaaagttatgtcaaattagattgtactgtgtgggggctctcgtgaaggaaagagtgtatttaacctggggtttttgttt

SEQ ID NO: 226652 - DNA, 504 bp, Homo sapiens
ctcccaaagtgctaggattacaggcgtgagccactactcctggcctaaaactaatgtaagaatatatttaaagttattcacagttccatcaacctggacatctgccaattttatttttattgattttcttctagaccatgtctgtttacagagattcttacatagctgtaatccttgtgtggatataattttatatttgttttttactttttttctgagttttttttatgtggctataaaacctctatgatttttgtttttatcaaatgtacaatgcctcctctaatgaaagtgcctttgtttatgtagccattgcaccatcattgggcatttgattttgattcagagttattctttattatgtatagtactttaatgagtgcagaacctttttcttcctttgaattaaactaggattaattctgaaggatgggtaggaatacttttatagacccttaataaggattatgaaattgatttttttaaagaatgacgccaagttat

SEQ ID NO: 226653 - DNA, 349 bp, Homo sapiens
cagcacttctgcccaggcagcccagtgagactggttctctttctccctctgccctccttctccttccagttcatctcacccttcagcctcctgtgatgttccgagagaggtgctttcctgcaggaggctgggccttcaacccatggcctcaagtacccctaacccgtctcccagggccactgactgaatgccctccagcccttgagccctcttcccagtgtcttccttttcaccccagtcgtgggctctccccacttcacctcactactaccctttgttgtgctgctgtcaaacagcagctccacgaggggtacccaggccaggccacaacaggatggggacctgctct

SEQ ID NO: 226654 - DNA, 282 bp, Homo sapiens
aattgcatgtatttatggtttacaatatgatgctttgatacacgtatacattgtggaatggctaaatcaagctatttaaatatgcattaccttacagacgtaacttttgtggccagaacacaaaatttactctcttagcaattttcaagtatgcaatatattgttattaaccacagtcaccatgatatacaatagatctcttcaacttattccttctccgttactgaaatgtaacaaacctgcccgttctgcacatgtatcctattacttgaagtaaaattt

SEQ ID NO: 226655 - DNA, 478 bp, Homo sapiens
cctttgcaaatatcaggtaaaaatgcatgtaggttctgtgaaatattcgtagtaataaattgagacaccttttaattagtgttacccttgtgactttctgttgtacataatcctttttctaaatacatcattaaaataattatttttttatcagcataagcttactgaaaggaaaaaaaatcttactgtgccttactattttacagagcgtcacatgataacacgttagtcagctgctgtcggctggtggtgccagacatcaaaggaagattgggaaaactttagtagaaaaacaagacctagagttctaaggatgctcagtgctgtccagctgttgatgtgacttgcatggtaaccagacatcactggaccatacacttaagagagaggaggagttttttttaaaaaaagtgggagccacctagaagtctggaagttcttttcttctctctcactaaagcattccttgttttagcca

SEQ ID NO: 226656 - DNA, 394 bp, Homo sapiens
aggccaggcatggtggcctatgcctgtaattcagtgcattaggaggccaaggtaggaggatcacttgagcccaggagttcgaatccagcctgggcaacacagtgagaccccatctctacaaaaaaattagccaggcatatgcctgtagtcccagctagttgggacatgggaggatcgcttgaacccaagaggttgaggctgcagggagctgtggtcatgccactgcactccagcctgggtgacagagccaggccctgtctcaattaaagaaaaaaaaagacacacaaacatgcacataaatacacacacacacacacaaattcgaaatgagaaagaaatggttttttaaatgagaacattattacaggagagccaacagacaataggagatcaa

SEQ ID NO: 226657 - DNA, 459 bp, Homo sapiens
agatgatgcagactaaaactgcattttacattttatatggctaagtttattgtttccttgtgttgtaatatgatggaaagtaatgggaataattctgcttcctgtccttagggaccagtaggaattttcccatgataagcattttgtccttaaaatactgacatcctgttaagagatcatgacactccaatgaccatgagaccctggctatgctagtcagccagggggctgaccattgacagtgatgctggtctccatgattaaatagtgtgggtcagcatgtcccagggtgacagaaagctgtgtgatcagtgtctgtcacatatctcagactcagggttcctttttaaaatgtgcctggatcgatgatgacttaaagatttatctaatttaaatctgaacaaaatgagtgaccaaaacacttctgtaccacttctgtgagctgaggtccagcacaga

SEQ ID NO: 226658 - DNA, 443 bp, Homo sapiens
gttccttttggtaattgtagatagacttgctcaacctctactgcacctccttctagtgtgccttcccatatttgtgaaactcaaaagctaaatactgcattttctccaattcctttacagttaggattccagataggaattaatgtccattaatcggtgagatttggatttggaattgacttaaattgagagagagacggtccatgaagcatccattttctggtatggatcagagcagaaatggtggggttatagagcctgcaactgtagccgcagttttctcttttttgctagacagctttttaattgcaatgtggctctgaagtttcttcatccctcccaatggtcaggtaagttatttaaatacctgtctgtcattgcttactacactgtccttttaatcttcattatataaacaataaagacatacttaatgctcaccg

SEQ ID NO: 226659 - DNA, 358 bp, Homo sapiens
caatgtaggggtgaagagtaggtctttagacccagactgcctggattcataccttgcttcactactaacttactgggtgaccttaggtaagttagttaaactctctgtgactcagtttcttcatttgggataacaatatttcttgcttatttttttgtgacgattaagttcacctagtaagttacaatgtggtaagcactgtttatgtactagatgctagggactatcataagcaagacagacgtggtctctggtctcacgcggcttacattctagtgggttgggcactatatgtggttcatctgtgccatgaaccatttcaaaaaagtttgaaaaaagaatcagtcttaaagagaga

SEQ ID NO: 226660 - DNA, 230 bp, Homo sapiens
aaagctgtagatattacactgcctaactttaaaatatactacaaacttagtacgcaaaacactatggtcctggcataaaaacagatacataggctgatgctcagaatagaaagcccagaaataaacccacatgcacatggtcagagttacctagaatacccaatagggaaggaatagaaggaatagtgtcattagtaaatggagctgaggaaactggatatctgcatgca

SEQ ID NO: 226661 - DNA, 773 bp, Homo sapiens
agccccttgctgtacaatgtcatcatgtcctatcaccactgcttctggctcacagtgggagtttacattttaggcatccttggatctacaattcataccagttttatgttgagactctttttgtgcaagactaatgtgattaaccattatttttgtgatcttttccctctcttggggctctcctgctccagcacctacatcaatgaattactggttctggtcttgagtgcatttaacatcctgatgcctgccttaaccatccttgcttcttacatctttatcattgccagcatcctccgcattcactccactgagggcaggtccaaagccttcagcacttgcagctcccacatcttggctgttgctgttttctttggatctgcagcattcatgtacctgcagccatcatctgtcagctccatggaccagaggaaagtgtcgtctgtgttttatactactattgtgcccatgctgaaccccctgatctacagcctgaggaataaagatgtcaaacttgccgtgaagaaaattctgcatcagacagcatgttaatgaatagaatcaatgttatgttgttacatcaagataggtctttggtttgattagatatctaacttattggatttattgttgagatttatgaaaatttagtgatgctcttttatgtaacacctctccaaaatattcctccggtctgcttccatcgaacttatattccaatgagcatatgtaaagaaatacaaagaataaaatcaaaagacttttgaggttta

SEQ ID NO: 226662 - DNA, 658 bp, Homo sapiens
  misc_feature (1)..(1): n is a, c, g, or t
  misc_feature (31)..(31): n is a, c, g, or t
  misc_feature (71)..(71): n is a, c, g, or t
nttctggtaccctgctctcataccctgtagnaccgctggttctggaaaaagctttcttcttcggtcccctngataggctagtgacaactgaaaacatgcagaccacaaaagatgtgagaattcaaactgagccatagctccatctcctggaagtgtatatcagcagcaacaagagtaaagacccagaggcatgagaaacacttcctcactgaagcactcacgttccgactgtgtgcaaaagaccttttgtgtctcactcactgagggagattgttcttcactcaatcaatgagaagaacagacgtcttagaaaaccttcagtacctgggggaaatgaatgagctcaaacacaagggaaagtcagcccgtgttcaagataagcccatctcaggaaggcaggcaccatgctcctgagactactttacccccagataagaaagcccttattgataagccaaaatcacagattattttattaagctcatattttaaaagaatgcaaagcttcctttaatgttactttccattataaatgtaaaattacagtttgcacataatatctggattctggttaactattttccatactgtattttgcaattgcatatctgcatttctatttttatattaaaaaataaatagggttatgcaaataaaa

SEQ ID NO: 226663 - DNA, 731 bp, Homo sapiens
tattcttttttagtttattgaaagaaattcacttagaaaacagccacacatacattcttcaggaattatggaccttttctccctacaaattactggatacttggagaattcttgttattcttctctgtagctttttgatatctttacattaatattttataacctttaatttttctcctttatacattaatattggtgactaaaaataacgtacttgagtgtcatttatttttacatgggaaaacgtaattaaggagacaagaattggacaaatgggccttattctgattgtttcagtagcccaggatcattagtacattggccctctgtatccctgggttccacattcattggattcaagcaaccacagattgaaagtatttggaggcggggaaatggatggttgtatctgtattgaatatgtacaggctttttttttcttgtcattttctaaataattcagtctaattcatatcgtatttacactgtattagtattataaataatgtagagattatttagagcatatgggagaatgtacataggttacatgcaaatattgggccattttatacaagggacttgagcattcgtggattttagtgttcatagggaggcctagaataaatcccccatccataccgagggatcactgtgtaaagaaggtggataaaggttataaatggtaattaagaagtgcaattaactggaaaacatagttgtatgagttt

SEQ ID NO: 226664 - DNA, 328 bp, Homo sapiens
ttgctttgggatgcccggggggactgtttctgacatgtggtccccctgtgagcctgtgtgtgcaggtgtgagggagccgtcagctctgtccctctgtgttctccatgtccatgacctcatcccgtctctgtctctcatcctggcttctaacaaccttttcacagctgattcctttggagcatttgtcaccgcttcagggccaagaaccccaatcctccccctgctgcttgatttaatttctgaaatggacagcacatcagtaggggcacccacggggcgggagcagagctgtccagagacaaaagattaaatcactgccatctttgga

SEQ ID NO: 226665 - DNA, 480 bp, Homo sapiens
cagtgtagtaacatagaaacaaagatgattaagacatagttactgagaccagacgtggttactcacacctgtgatcccatcacttgggaggctaaggcaggtggatggcttaagccgaggagtttgagaccagcctgagcaacaaagcaatatctcatttctacaacaaatacaaaagaaaaaccagctgggcatggtggcacacacctgtaattccagctacattttggaggctgaggtgggaggatgcctgaggccaggagatgggggctacagtgagttgtgttcataccctgcactccagcctgggcaacagagcaagagcttgtctcaaaaaaaaaaaaaaaaaaaaaaaaaaaaaaggagatatacctaatgtaaatgacaagttactgggtgcaacacaccaacatggcacatgtatacgtatgtaacaaacctgcacgttgtgcacatgtaccctaaaacttaaagtatatt

SEQ ID NO: 226666 - DNA, 698 bp, Homo sapiens
tagaggatccccgtgggttgaccgtggtttctggtacaagcggcgagtccaaggggctaagggcttccagcaccaacggatgaccaacggggccatgaacgtggagattggaaacccgacctacaagatgtacgaaggcggagagcctgatgatgtgggaggcctactggacgcgtgactttgcctggacccttggcctggcctgggatctgcagccctccagctggcatgagttgcgagggctgggggagccagttatttgggctggcatggggtggggacacctcagttctcctctgcctcctcaccatggctgcctgtcacaggccacggcccctccccttggttcagcagtgagaggtttatctgggagtttatctggctcctgctgtggccattgtcatcaacactgctgtgcctgccgtcatcaataacttgttagtaaaaccttcatagggttcacagctcagaactgcacagcgttcacaacttagaatctgtggtgtttcttcagtgcccattagagcctcaggctgtctctggctcctagaaagtcattctaccatctgttttgttcactgctgtatcctcagtgcctagagcagcagttgatacatggtaggtgctcagtaaatatttgataaatgaatgggaacctacattctaagaaatggatcgtcacccaccaaccacaaaaa

SEQ ID NO: 226667 - DNA, 1082 bp, Homo sapiens
tctccacaaccaggaacttccgtcaagcccaggtgagaggtgccaggaggctgcctgggtcctcaagggggatatatgtccaaatggccttaccacaaggccccttcgccctcaaagttctgctcctcccgggggcttcttaggatctaaaaggatcagtcctagccatctcgtcagccatctcagcaagggctgacggggcggaacagcaaagcagaggcgggtcctgagagcgtggagcctgaagcccggcgccagagggagaccaagagggtgagatgcggctggaacccagccagagcggagactgaagcctgaactaggggccgggcctcaggcctaggaactagccacgagctgaaaaggaggcggatggcccggacagaagaggcggggctttcagaccagagggcggagccaagagctgaaaagggtggtgatttggtccagaagaggaagaacttaggctccggaggcagagccaaaggctgaaggggactactccctaggacagaggccgggaggtatcgggccgactaagccgagtggcgcggaggagcggagccttcagccccgcggctgggccgagcccgaaggtggcgtcggtgtcggggagccgccgcgtgcaccggccgtcctccctgggccgcatcgcggtggtggtggaccagggctcgggcttcaccaaggcgggcttcgcgggcgagaaccagccgcgcatagtgctgaagagctctagcctggtgcccagctgggaccggccggtgctgcccggagcgccgggctgcgagctggcgggcggcgtggcgcgggcgcaccccatcaagcacggcgtggtggcggactgggaggcgctggaagggctgtgggagcgcctgctggtgggcggcctgcgggtgtgcccagagcagtggcccgtgctggtgagcgactcgccgttggcgccgcccgcgggccgcgaaagggtggcggagctgctgttcgagaccctggcagtgcccgcgtgccacatggctagcaccgcgttgctggcgctctgctccaccggcgcgttcagcgggctggccgtggaggcgggcgcg

SEQ ID NO: 226668 - DNA, 1196 bp, Homo sapiens
tctccacaaccaggaacttccgtcaagcccaggtgagaggtgccaggaggctgcctgggtcctcaagggggatatatgtccaaatggccttaccacaaggccccttcgccctcaaagttctgctcctcccgggggcttcttaggatctaaaaggatcagtcctagccatctcgtcagccatctcagcaagggctgacggggcggaacagcaaagcagaggcgggtcctgagagcgtggagcctgaagcccggcgccagagggagaccaagagggtgagatgcggctggaacccagccagagcggagactgaagcctgaactaggggccgggcctcaggcctaggaactagccacgagctgaaaaggaggcggatggcccggacagaagaggcggggctttcagaccagagggcggagccaagagctgaaaagggtggtgatttggtccagaagaggaagaacttaggctccggaggcagagccaaaggctgaaggggactactccctaggacagaggccgggaggtatcgggccgactaagccgagtggcgcggaggagcggagccttcagccccgcggctgggccgagcccgaaggtggcgtcggtgtcggggagccgccgcgtgcaccggccgtcctccctgggccgcatcgcggtggtggtggaccagggctcgggcttcaccaaggcgggcttcgcgggcgagaaccagccgcgcatagtgctgaagagctctagcctggtgcccagctgggaccggccggtgctgcccggagcgccgggctgcgagctggcgggcggctccatggtggcctccctgcactccttccagcgccgctggataactcgggccatgtaccaggagtgtggctccaggctgctgtacgatgtgttcaactgagtcaggctggactggggggggtggcactgcgttgggggacagctctctatctaaagagtcaagtgtttggagctggcagggtcctcctggaggttggagctgactggatgggtcacccccataccctttctgggccaggagaaggtatttgggacccatgggaccctcattttgaactgcagtttgaatctccccaaccactgccagttcagagaatgccagtccagctgcctacccacagggccctactttatggcaataaaggtgatgccccacttgtgtccatgccacaga

SEQ ID NO: 226669 - DNA, 567 bp, Homo sapiens
cggacacgcctggcagacaccgtggtgctagccggcggctccacactgtttcctggcttcgccgagcgcctggacaaggagctggaggcgcagtgccggcggcacggctacgcggccctgcggccccacctggtggccaagcatgggcgtggcatggctgtgtggaccggcggctccatggtggcctccctgcactccttccagcgccgctggataactcgggccatgtaccaggagtgtggctccaggctgctgtacgatgtgttcaactgagtcaggctggactggggggggtggcactgcgttgggggacagctctctatctaaagagtcaagtgtttggagctggcagggtcctcctggaggttggagctgactggatgggtcacccccataccctttctgggccaggagaaggtatttgggacccatgggaccctcattttgaactgcagtttgaatctccccaaccactgccagttcagagaatgccagtccagctgcctacccacagggccctactttatggcaataaaggtgatgccccacttgtgtccatgccacaga

SEQ ID NO: 226670 - DNA, 484 bp, Homo sapiens
cactgaaagcagagcatggacagagggaggacagacagaatcgagccatctcaagaagaataagcttgaatgcccagaggcagcatggtgctgggaagtgctaagtccagaaatcgagtttttcaagtgataaacggtaattggttgtgccttccctttgcatgtaaactttgctaacacttcttagcactgtgaactctactgcaaacttaactgctttgcagagacctgaaaagagctcagtcaggtgaaaaattcaaaagagatgaacactgggaagagtctgtaataggacactagcttgtacgtatgtgttctttggttttgatccttatactaaacccttttctattctttctgatcccccatttccacatacacactttttcatggtctcacctcacactcggttaagtctttatttttctccctttctttctttccttttttttttttttttttttggtaagatactctgagtata

SEQ ID NO: 226671 - DNA, 273 bp, Homo sapiens
ggagaggaatgttggtgcaccttttatattttttttttcaaggatctagacagaaactggagtgtggtagcacaagaaggttaagttccaatactgatggacattacaatgttaactttccccaggctcaaggttttttctatcgttcaacttgtgggaaagtatgtgagtctgtcctctggggcttgaaagattcttaattacagatgaaaactaagaacagaaggatttgggaaacccagaagcaaaggtgttagggtctcaatagtcctt

SEQ ID NO: 226672 - DNA, 1168 bp, Homo sapiens
gcgatagtttgctcagaatgatggtttcatccatgtccctacaaaggacttgaactcatccttttttatggctgtatagtattcaaacatggaatatattttaagatagatataagactaaagcaaaggtaaggaaaggatggaagaataacgtgtgtaaatgatatatgttctgaaaaatagaaataaagccaataaaaatgggagcagaatggaggaaggcagataaaaaggggagaatagaatcagactgtcacaaagttaataaataattgggagtcaaagaattcattattgaaagctgacaaaccagatagtaggagagtaagaacaaaagggggctaaggacattataaaaagtattagtgtaaagataaccactagaacaaaaatgcggactcccctaaatagaaaaacaggcaaagaaaacaaatcacagagtgaatttaacataatagaaacagtaaaaataatataaaataatatgacaggcttaagactaaatatatcagtaatataaatatataaatgagctgaaaatcacctaataaaaggaaaatattttcagattgactttcaagcaaaaccaattcattgctctgtagaagagacatacctaaaacaaaaggattcagaaaggataaaactagtaggatgacttaaaggcatacaaagatgctcttagcagtgttaattataagacccaaataactaccaaaatgctcttcagaagtagaatgaataaacaaagtgtggtgtattcatacagtggaatactacgtatataatgagagtatgaatatgaattttacaaaacaacatggatgaatctcatagtaaggagtgaaagaggcatgaaacaagagtgcatcctatatgattccatttatatgaaattttaaaagaggcaggaccaatctatggtgatagtaatccgtatcatggtcacccttatggaagggtaatgactggaagggaagccaaaggggctttcagagcactagcgatgctctattttttatctgggtgctggttgcatgattttgttaactttgtgaaaattctttaagctggatacttaagagttgtgttcctttctgtatctacgttacattttaataaaaggtttacatttaaaaatataaactatttacaagcagaagatgag

SEQ ID NO: 226673 - DNA, 470 bp, Homo sapiens
cccttttggagggagacctatgtcaggagactgaattcttcattggctgcaacccaagcccctccctaccctgctagagagataaatggtggaaatggggaattgaatggagagctgaggggaccgggatggggagaggggagggaggaggctgggctgataagtaagaattgcagggactaaggacattttccaagaaatgttctcctaactttaatgtagtttaggtaacaaaataatatatgaagtatcaatattgacatcctcaaagaggaggaagctgctcatcagagagctagtataactgcacgaggctgcacagcagagacaggatcaaagcaggtccagtgaaaactctataggcctccactacagacccacttcagaaatccacattctagaatgttccagaaccgatcatgtaacacaggtgccaaagtacaactgaaaaataaactttaatgtcttga

SEQ ID NO: 226674 - DNA, 568 bp, Homo sapiens
accctcttctgccttttatctcacgagcactcccgtgccctccccccaactcactgtgcgttctgaaactcatcgtctgttgtcagcaaaattcctgtgattccatcttctcggaataggaagttccctctgccttctggccttactgaagcccactcagtaccctgcagccctcttaagtggaatctttttcctcccactccccatgtgcggtgagcctagagcaggggtgtgtccttgcctcttcctcaacctcctcacttggaacagtctgtcttcacctctacccctcacagccaggcaggcatatctcttgttactggtgaaggcactgcctccaaagtctggattgaggcatccctccctcaggccaggccctccctcatgtggcgcttccctgtgctcttcaaaccaccaggccctccaagctcctggcccagccccttttcgccaaccatcagcccctctttccttgctttcctcccagcccagtttagaactcttggtcatctgcatgcacttcccatagtgccctccatccttcgtttatgctcacctggcaaggtct

SEQ ID NO: 226675 - DNA, 491 bp, Homo sapiens
atgcatgaagatgaaacatcaatgaactcatctctaaataaatgtatcggtaaaattctggttcatgccaggcacaaaagtagcctaatcatatacacattatttaactcacagaccatctgaaggggctcgagaatatcactttgagaaacactcttcctaaaggatactgacagaggagttgtcaataactgagaaaaacacctccattttagatttgtaacatcagtaaccaattaagctgggagtaagctatctggttaaatagccatctctttattgttattcatggggaaaatattacttctttccacttttaagaacgacaaatccattacattttcaggttgtgcctttctaccactgagattgatttgttgatctctctaatcgtccttattggtatcaactttcatgtaaataatagtcaagtcttaaaagcttgtatacatggataagtaaataaacaactccacactgagatgcgatga

SEQ ID NO: 226676 - DNA, 345 bp, Homo sapiens
acaccccacctttcctcatctgggctgcaggtccaggacatcctgtcaaggatcagtggggccaaaggtgggaagataatggcccttgtgtctcaagcagaagaaacagttttccagttttgttttgttatgcttttgcttttttaggaagaatatggaaggcatttccttttagaaagatgggaccacttaggatggaagatggacagtagggttttaaatatcttgtccaaaaggacagcttccaactcttgttttttaatccctttctttcttacaagtaattctgcaatggaaaaagtggcatctagagaaaattagtcagttggacaagaggttgttgaa

SEQ ID NO: 226677 - DNA, 415 bp, Homo sapiens
gctgtgctcgctaccctctcgctgtctacagtagaaattccccatcaccacggacaccagccacctggcccggcagtccacgctctcagcctcatccctccaacgctccctccttcgggtcccatctaccacaaccaccaaacacccatgccacttcaagccacctcccccacgcacatgtggctccctctgcctccttcccttgtctcttaggggccagctgagcagcagctttgaggcaccttctgctgagcacccccccaacagtcaggcagcccctttcctggcaccccagcatggctctcttttccctgcccactgggaggagctccttggggacaggggccaagtctgactaattctcagatctccagcacccagcacagggcctggcccagctccaaagctggctgga

SEQ ID NO: 226678 - DNA, 368 bp, Homo sapiens
agttttgtttttaaaactttgaagaatatattggaaaaacataccaaaggatttactttgagaactttctaaactgaaatagacttctgggaaagaactattgttctcttcttcctgtttatttatgttattactcttcttcaaaagggataacagtatctcctttatatccacaaaagcagtcaaatcctcccttgaagggactctgtattcgggtagtcctgaaatatctcttgctagatttttgctccaatgtgataattgtaatataaaaaattcttttggtgtattttgtttattatttggtattttaagagccagataaatgtccaacttttaataaaatgtgttaaacatagaaatgtgta

SEQ ID NO: 226679 - DNA, 319 bp, Homo sapiens
ttgttggtattctcccctgttggttctaagtgttactgttgtgtgaccatatggcaccagaactgagcgtgtgtgtgtgttgaaggaaagaggaagcatttcaggtcaccatgattgctgattagtaagaagggcactttctttccatttccttgaatgagtgcacactgacagttcagaaggtcattgacactgaggtgggaccttagtttcccacctcacaggaggcatcccctggaggcttgtttattgtttgcgtacgagcacttgaggagggaatgcctggtgctgccattgcagagccaaatgcaggggccta

SEQ ID NO: 226680 - DNA, 471 bp, Homo sapiens
gactagactcttccactgactcagaaaaagaaagcagagaaggagagaagccagtgctgttcatactcgggagaggaaaaatgtgtttgcccctcccaggtacacaaagagagagcccgaaatcaacatccgcggttgccctgagatagcatcacccatcgttccgccggtgcgccctccctgagatggtggcgtgtgttgtttgggctgtttttcatagccgccgcagctgggaattcaagatgctatacttaggcagaagtccatgaaggaattaattgatatgagccagaagttgattgccatttaagtactcagcctccaccattgccaagtttccctctttgcagaaagaactgagcttgcctgcaaactggctcattcaggatgtgagcacaagatggaattcaacctttaatatgctgcaacacctgcttggaaataaaggggctctgtgcttttccccccaaa

SEQ ID NO: 226681 - DNA, 397 bp, Homo sapiens
atggaaaggatgaggagttgatagcgattacattgttgtgatggttgtaacatcaggctacacttgactagggaatataaatgttagtgagaaaagatttgcacaaagaaaatgctaataaaagttgacataaagtgcttgtgctgtggtgggcaccatggggcacaataatgaaacttcacacatccctattaccattccctttctacagagaaggaaaccaagactcagggaagaagtaactggcccagagttatactttgattacataatgcgacatttgtccaaatgaatactggagcccagagtagggggggtaacccagaaaaataaaaccgccactggttccagcagtgaattgggccaaattgcaaataaatgtggtataaaataaaga

SEQ ID NO: 226682 - DNA, 490 bp, Homo sapiens
aagtttctgtgaacagcccggaagtgtattcagaattgaatgggtgagcacacacacctgctggctaacagaagccataacttatcatggtctccaagagatccctgagcccagtctgttcagaatcatgatagaaaggaatgcttgattgatattcagctattcagtttgttaaaatacatttatgaaagaacaagggacactttatttagcagctatgcttgtaataaattacactaatgcaaaatatattgccagtgatcttttcccccttaccttaacagtacttttatttgtactttgctgaaagtgactaaattacatatatttacaattcatccatgatagcttttccgtgagactttaatccctcccttttgtgaaaatgaaataatgaagcttaaactatttaaaataagaatgttattcctccatttatttgggctttacttttccttcttgagaaagaaatatataaaatcataggact

SEQ ID NO: 226683 - DNA, 638 bp, Homo sapiens
ataaaatttattgctaagttattttctttagttgtacattttatgtctggtatattttattttgaatgctatgaaagctggtatgaaatgtgggaagctcagtgtatcagtttatgatgtctaatttgaatatttgtttcatttttaattggcctctgttaatatgaacattagcttattttatccatttaatactattatcattcacagttctgcatgctaaaatgtttgaatcagagtgcctttgtttttattttaagacttttgcctgcatttcataaccagccatgcttatgcagttaaagttcaaagtttaaaattcctatgcatgctttccttccctatgttgagatgaaatgctgtaatttactctttgatatagatgtactttacccatatttgtcttggatgactacattttactcagtttttcttgtacagtacataaaccaaccattttctgaccaaattcctgcatttcctatgtactgacctatattttattttgtttttgttccccaattccttatttttttcttctgcattgctgtttcccttccccatttcatccttttccctgtgtgttcaccttccctttccttgtcttttcccaaatgcccattcccttccctgtctta

SEQ ID NO: 226684 - DNA, 520 bp, Homo sapiens
agcttggtaactcattaccttgtactggttctccttttttcctcctccctttgcttttctctcactgttgcttccttgagagagtactccctacttccttggaattacctttaactctgtcttttagagattccaatttgaggtagataatttttctcacctatgaggttggcaaaaagctaaaaatatgactaatctattagtgaggctgtagagaatcagacactattatgtattagagcaaactaatttctctatttgttaaaacaaagactggaaactgctcaaatgttcatcactaggtatcttgttgaaaaagctaaggaatgtttatataatggaggacttcacatacataaaaaaaagaccttttatatgttgctatggagtgatcctcaggacttattaagtgaaaaaaatcagggtaaagaaacatgtaagaaaaggggataatagatatagataaacagatataaatacataaatatagatacacatacaaatatgctcatatttttct

SEQ ID NO: 226685 - DNA, 226 bp, Homo sapiens
ccgaaaacatggctaatacacatcttccatatgataataaaatgttataaatcttactctgcctcagaaaagcttttactaaaagattatctatggtaatcaatttgagttcatggaaaatttcaatattccacataattcagacagttaaatgtcaatgaaatctcaaaacatttgaataagataaagtcttcttagtgaagaattttatattaccggtagttag

SEQ ID NO: 226686 - DNA, 659 bp, Homo sapiens
agatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagctcatgcctgtaatcccaacacttttgggaggctgaggtgcgtggatcacctgaggtcaggagttcaaaaccagcctggccaacattgcgaaaccctagtctctactaaagatacaaa

SEQ ID NO: 226687 - DNA, 413 bp, Homo sapiens
caggaaacatgatagaatctagtgtttcggtaatatgttatctacaatctccagttttctacaaaaatattagacatggaattaaacagaagagtgtgatctataccccaaaaaaggcaatcagtagaagctgacttagctcagatttgaatttagcaaagacttcaaagcagctattttaattatattcaaagaattaaaggaaaatatggtatcagtgaatggaaaaatgttctgagcagggaaatggtaaccattaaaaaaaaaaaaaaactggaaatcctagagctgaaaagtacagttactgaaatttaaaaaattgccaggtgagctcaaaagcagtttggcattgtcagaagaaaggaacagcaaacctgaacacccagtagaaattgtcctgtatgaggaataga

SEQ ID NO: 226688 - DNA, 506 bp, Homo sapiens
ctatccattggcctctcaataatagagagctgtgttgacatctctccctttaatggtgattgtccatttcctctttttttttttgcaattttataactttatttgatgtatttgacgatcagcgattagttctcatccacatcgactgtctttagatttttgaaagtggtaacaggtatgtaggtaaccaaaatatagagcttatttggtgaatcttcatcctcattacgttttctggacaaccgcacacggataccgtgtgggtcataccttattcctttggcccagacctctttgttgcacctggtatcaatgtgcacatctggagttcccatctccttcatggcaaattgcagaatctctttgagttcccgaggggcacgcttcttaagcccactccatggatgcatttgtgaatattgatggtgtattctcgggtcaccacctcgttgatggcagaatggccctttttcttctcatcacccttctttgcaggagccattctc

SEQ ID NO: 226689 - DNA, 680 bp, Homo sapiens
tgaaacggagtttcactcttgttgcccaggctggactgcaatgtcgcaatctcggctcactgtaacctccctctcccaggttcaagcgatgattctcctgcctcagcctcagcctccccagtagctgggattacaggtgcctgccaccacgcccagctaagttttgtatttttagtagagacggggtttcaccccgttggccaggctggtctcgaacctcaggcaatccacccgcctcggcctcacaaagtgctgggattacaggtgtgagccaccgcatccggcccagaagcattttttaaaacatagtttctcacaaaactgaaacatacaattgccctatgacctactcaaaccaagtctaagtatataaccatgaaagataaaagagtaagaccacaaaaagacttgtataagactgttcatagtaactaactgcaaacagcccaggtgaccttcaacagtgaatagattaattatggtatacacatacagtggaaaactacacactaataaaaagaaaggaactactgatacacgcaacaaagacgaaactcaaaaacattatgctgagtgggaaaaaaaagccttacccagaaaaatacacacagtactataggctctatgggatcccatttaatgttaagttctaaaacaggcaactctgtaacttagggcat

SEQ ID NO: 226690 - DNA, 383 bp, Homo sapiens
tgcttgcttcgcgccccccacccgcccggggaccgcgactaagtccccgacgcagctcttcccttttcctgaataccctgggactctgctcccgagttccagctccgaggactcaaagacagtctccgttcctcactcttcaaagaccacctccttttctagaggtgggctccccgaccttgcgcttctagagctgcaggagcggcgctgcacaggtctgacaagcccagctcattggcgggtatctgagccatcagtctgaaagacatttggggaaaattcatagaacatagaaattcatattatacatattcatattatacattcatattatacattgtgtatattatataatatatatatagtccataaattaaaaaaaa

SEQ ID NO: 226691 - DNA, 546 bp, Homo sapiens
tgctccacaagggagtcccacttcagatgtggtgctgggcatggtcactcctgctggatgtttagaaggtggaaagcaaggacctagggaaataccaggtacaccctttccaccctcatccagagcaggacaaagaggccaggcgttgtcaggagcccaggtctccagctggagggaacgtcaaccctgcagtgggagcaggggcccattgcacatcctaggcagagatggtaacgtaggcaccacaggtatgcagggattggtacccctccctggcatcagaaagaagccaaacaaggagctttctgcagaatgaaaccttctttcctttcagaagcactgctgactgtttggtggttgccactggggcagtgagcctttggtccattctgaggttgggctggtttctcctcttggccctcccctacagaccataaaggaaatcagcaagaagtccccagcaaacatccacagatggccctgccacatccccctctccgagaaacacccaagaatgatcaataaacattaaaaaaaaaaaggtac

SEQ ID NO: 226692 - DNA, 103 bp, Homo sapiens
aatgggaacgtctgaagacatacttcataaaagaggttatctaagtggtcaataagcatatgaaaggtgctcaaactcatatccatcggggaaacaaatgcaa

SEQ ID NO: 226693 - DNA, 192 bp, Homo sapiens
gataagatactcaacatcactaaccattaaggaaatacaaaccaaaactgcaatgaggcgcaacactttggtggatcacctgaggtcaagagttggagaccagcctggccgacacggtgaaaccccgtctctactaaaaatacaaaaattagctgggcgtgatggtacgtgcgtatagtcccagctacttgg

SEQ ID NO: 226694 - DNA, 573 bp, Homo sapiens
  misc_feature (569)..(569): n is a, c, g, or t
aagggtacttgataattttttgagatccgctcagattgaagagtgacaggaagagttaattagagcagttttaaggataaatttgattataagcacagggaggaagcaagagtgtaatttgatcatgaatggaaacattcgagctcttacccagtactaattaaaaagaaaaatagtaattactgagtagctattatatgcccatgatagggggcactttgtagaggcttaggatgtatcagtggaccaaataggcatggctgtccccagacagtttacatttttaacttgaggtgacaaatattaaatataaaataaacattaaataatatgagttttagaaaatgagaagttctgtgacacaaagctaaagcagaaccagggtaaaggtgatgcaggattagtttgttttaaagttagaatttagtgtacaaaataaggtaaaaatgacttattaagtagacagacctactaacataatctgtaccagaagagagaaaacaaagaaaagaagcctcacatttgtgggtatgatatttatgctggacacataaagcaagttacagccncaaa

SEQ ID NO: 226695 - DNA, 150 bp, Homo sapiens
aggaagaatccctaaaaaatatctttccttccagaggcttcaagaaacctttgcctggaaatattcagcctcagagcacagtgctatgtcacccaggaaatagctatcatgggaaaattcaaggaaaatattcctgctcaaggaaaaaaa

SEQ ID NO: 226696 - DNA, 569 bp, Homo sapiens
tatatatgtgtatatatatatacacatatatacgtatatgtgtatatatatacacacatatacgtatatatgtgtatatatatatacacatatatacgtatatatatgtgtgtatatatatataggaatccgtgggattttacttcagtgacataaattcatttgaagtagatattaaaatacattgtataaatatttagtatgacatccaacttttctctaacaagttaataaaaattatcctctataagttataaaacaaactaagctttttacatttattagaaatttgaacactggttatttaatattaagtaattattaaatttttttaatgtgaacattactgtggtcatttttaaaaaatcatcttatatagatacagactgaaatatttacagaataatataacatctggaatttgcttcaaataaccctggtggagtaaatgagggaaaagatggaagaagaaagactggctgtgaggggaagatgaggaatggacactggggttcattatactcttctactttagggtatatctgaaattccccataataaaaactttt

SEQ ID NO: 226697 - DNA, 110 bp, Homo sapiens
aacattttcatcaccctaaaaagaaaacctttgacccattagcagtcattccctattctcattccctcccagcccctggcagccatgaatttactttctgtctatagatt

SEQ ID NO: 226698 - DNA, 227 bp, Homo sapiens
acagctgagaatggagaatttgaaaaagaattaattttatcaagttatcctatgtatatttttatttatgtgaaaaaggtgaagatttttaagtcaagtaaacaggaagtgttatacaacagtttaaatatttagagaacatatcattatttttgaaaatccaagtagaagtctaatggtattgtcagaacaccactgcttatctcaaaatgagacatggacttctg

SEQ ID NO: 226699 - DNA, 228 bp, Homo sapiens
ctctatttgaggggtggtatttgtgcctggtggtgttatatgctttatatccaaagccatattgggacatgcgaaggtttctttttttaaaaaaaatcaaatgtaactccataattgtatataatgcttatgggctcgcaccatagtgtttggactagattgcagagcacattctatgtttttaaagtactacaaagtgagttcacttaacatgagccttatgtgagt

SEQ ID NO: 226700 - DNA, 447 bp, Homo sapiens
ctccatagctgtcacttaaaggcatttacaatgtaattcgtggtcggcagggcacaatgttttcagcactttgggaggccaagacgggaggatcgcttgagtccaggaggtcaagaccaccatgggtaacataacaagacccagtctccacaaaaaaaaaataaaaaattagcctagagcagtgatttgcacctgtaatcgcagctactaggaagaccgaggcaagaggatcacttgaacttaggaggctgaggctgcaatgagccatgattgcatcactgcactccagactgagtgacaagagcaggactgtgtctcaaaataataattaataacccgtctcaaaataataataataataataatttgaggtcaatttaaaatatatttttttatgatggaaacactaaaaaatatagatcacctatattatgtatcaaaataaca

SEQ ID NO: 226701 - DNA, 447 bp, Homo sapiens
cccaaaccccttgtagtcactgatgattttcattgggctatagatgggaaggcaccagtcataaatattttctatgaatgagtgttctagatattttttacccaaagatgtagcatatcagtgggtcactattgaaaacatgtttggaatgaagcaggaaaataagtcaaaagatctcccctcagttcctaagcaactttgttgtaaaaataactgtgaaaactgggcttaaatgaaacatacattcgaatgcctggagtaagaattattgatagcccagacttagtatcccccccacctttccaagtccttaaagcattggctttctactcaggaggctgaggcaggagaatcacttgaaccagggagtcgcaggttgcggtgagccgagatcatgccactgcattccagcctggcaacagagcgagactctgtctcaaaaaaaaa

SEQ ID NO: 226702 - DNA, 422 bp, Homo sapiens
gatagaagagtatgtgaactaaataatgcagtggtaactgcatgaatcaaattctaagtggtatgacaaatggtaataactgatgagtactccccactcttagcatcataaagatgttgtatctttaaccaaattatgaatgactgaaacaggattatacagtggagaatcaatgtatattttttaaggacaaaattatttttgtagatttaaaatattacagtaattcatcttggcattatgctagatatccatacagaaaaaagactctggtgtcaaataaatgactccaaattcagttgtgctacttagtagtactcatatgagttttgtaattctcattttttctctacttcgtaatgagactaataatgcctttgcagactgaagttaaataaagctatctctatttgcagatgaca

SEQ ID NO: 226703 - DNA, 387 bp, Homo sapiens
aagccaagcccagggcacctggcgcctgtctgctggtccgtggttctctgcaccctggtgacaggatactcacagttctgtgacgcagcctccctgggccgaggtttcctcacctgtagttggcgggcaataatggtccccacctccgtgggcttgttgtgaagattaaattccttaataaatgtgaaatacttagaacaatgcctggtacatggccagtgccatataaaaaaaaacagttgtaatatttattatcactgggctgggcacggtggctcccgcctgtaatcccagcactttgggaggccaaggcgggcagatcgcttgagcccaggagttcgagaccagcctgggcaacatggcgagaccccgtctctacaaaaaaaa

SEQ ID NO: 226704 - DNA, 434 bp, Homo sapiens
tgttgctttttgtaggtagattattgcatatagagttgagaaaatggataaattttgctttatttattagatacctctgaaaagttttatgataaaattttttgcaagtaaagttacttttctgaatttgtaagaggaattcatatttttaataacctttctgtgactttttgtgtaaagccagtaagtatcttatgcagctattctcaaagtgcggccagaccactaagagttcctgatacctttttagtgagtcggccaggtcacagctctttccatagtaataccagtacattatttgttttcatcactgtgttgacggtggcactgatactataaaagaaatgataggtaaaactgctgcagcttatcctgaataaagacagcaccaagctgcatcagaagccattatattcatcactgccacatatgtg

SEQ ID NO: 226705 - DNA, 631 bp, Homo sapiens
gagagcttttgctaaagtggttctgggatgggatgcaggtcactgagtccgtggaaactcagaatgttgagaagctgagcacagatccagatgccctgcccccatcagttctgcttgcaccaggtaaatgggttgtttagacagtgaccgctccaaaattcttagcatttataatcagtttacacacttagtgtttgaaatatgttatataaaatattttatcaaaaggggtagagggtggagagaaacacgtaacttgagaaatattttttacaaatgtccacttacccaggaaaatgtgtataataaagatgacatatgtatcaaaactctcagtgtctcattccttatagatattcaatagccattactttttcttctctgtgggcttaaaagctggtagaaacataacaagacaaatcagaatgaaagaaaagagccccaaattcccaattcgaaatccaaatcaataaatctaaaaacattgcagtattgtaatttcttatgcttgcttccaaggctctgttcaatcacccggaaccaaatttctcttaagactggtgcctgaagagaaacaagctcaaataatgattctggagaactttcgcttttgccctgaccatcagccagc

SEQ ID NO: 226706 - DNA, 536 bp, Homo sapiens
cctttttaaaaatctggattgacagaaaactctcaaataacaatacttcccctgacccactcatgcctgctggcagcccatcaatgcagcagctgttgaacataaaaacaatacttgggctaaggtaatagagacagacttctaaaaggaatttgctgggcgatctaaaatgaaattcacattgttccaggcttgacctgagatagaaatcaggagtctgttccctgatatgacaaagccaaggcaccagagccacctctttttaggatcgacgccaatgagtgtgagcacatcgctcaagccaaatggcacaggaagtccagttctgtggacacattctgcccacctgctgaactgtgactgggtaggatggagtgtgaaacattgagagaggggtaggctgaggtggtgaggtgggaaagagaccatattctaaaaggaccatttttctgacaagtgggagctttgtttgttcttgtctgtgtgtgatttcttttttatttatttatttattttttttgcatttttattgtaca

SEQ ID NO: 226707 - DNA, 353 bp, Homo sapiens
atgggatattctgtaaccattaaataatgttgtagaataatatttaacaaaatagggccctagcacggttgctcacgcctgtaatcccagcactttttgggaggccaaggctggcagatcatgagatcaggagatcaagaccatcctggctaacatggtgaaaccccatttctactaaaaatacaaaaacaaaattagccgggcatggtggcaggcgcctgtagtcccagctactcaggaggctgacgcagaagaatggcgtgaacccgggaggcagagcttgcagtgagtcaagatggcgccactgcactccagcctgggtgacagaacaagactctgtctcaaaaaaaaaa

SEQ ID NO: 226708 - DNA, 372 bp, Homo sapiens
agcaagtaagaggagtcagagcttatggagggagggtgtgtgtgtgttgtgtgtgttgtgtgtgtgtgtgtgtgtgtaaggaaaagtagaagccaaatgtgagctcttggtttggtggctctgatcagctgtggaaatctatgtttcaaaatggtagaaagaggaaatcatcacttttttttttttggagagggagtctctgtcaccaggctggagtgcagtggcacaatctcggctcactgcaatctccgtctcccagctactcgggaagctgaggcaggagagtcgcttgaactcaggaggcggaggttgtggtgagccaagatcacgccattgcactcacgcctgtcaacaagagcgaaactccggtcc

SEQ ID NO: 226709 - DNA, 264 bp, Homo sapiens
caattgtgagaatcctggaaacaggaaactttacttgtttccaggtattttttacctgtcattttaactagtttaagcctaaaaatagtctttgcatattactgtccaaagctaggagttgaaagaaacaggatttgaacccaggtcctctctgacttcaaagataccatcatttccttcattagattcctaccccattgttttcatttgcactgttatatttcacattattttgtgtgtattctcccaccccaccaccctgca

SEQ ID NO: 226710 - DNA, 352 bp, Homo sapiens
cctcccaaagtgctgggattataggtgtgagctatcacaccaggccaatgaatttttgagaatggtttcgttttgctgaccagactgagtgcaatggtgcaatcatgtctcactgcagcctcaacctcctgggttgaagcgatccttcctcctcagcctcccaagtagctgggacaacaggtgtgtcccattagccaccacaccaggctaatgtcatcttaatcctcttctttctcattcttcacacttagtaactcccataagtttacacgtttacacttgctttctcccacagtcccacatttttttgcaagctctgcaagtgttatccagttgttgctgggcatctccc

SEQ ID NO: 226711 - DNA, 281 bp, Homo sapiens
caagtacatgatggcatgtgttgagagctgtgttctctttgttttggttagacatgattcctgccctaagagctaatctcatttggagggaaatgaagggaccaagtacagtattcaccgtccaccagttaggactgaacacatagcccaaggtgtttaagaagaaaaaggccaggcgcggtggcttatgcctgtaatcccagcattttgggaagccgaggcaggcaaatcacctgaggttaggagtttgagaccagcctgaccaacatggtgaaaccccg

SEQ ID NO: 226712 - DNA, 412 bp, Homo sapiens
ctcatctaagcctgatcagctcccaaaggccccatctcccgataccatcacatgggggccatggctctaacatatgaatttgcagggtatataaacactcagtccataataggcagttgttgttttgttttgttggcagcatgaggcttccatgctcaaaaagcaagaagaagaataagggcctctctcccaagctcagtggaggtcatctaaacacatcccagtggctctgactaggccactggctcatctgtgaaacaatcagagttgtcagtggggagcttagtagtctgatcaaacaggttatggccctatatcctggaccaggttgagggaaaactgcacccagggtccccgaggcagggagcagggaaggggtgaatgtaccaaagaaatgcaatgagcttttgcc

SEQ ID NO: 226713 - DNA, 545 bp, Homo sapiens
ctgtcgaatgcaaagagcaggatgtgatgatagtcttgagttaagcttgttttgattaggggaagatgtgttaccacatctgtctcagatgctgaacatagtccctgtgttgcactgatgagctctgttttgtaaagtctctatagttgatttctgttattcttaaggctttaaaaatattgctgaataattttacaaatagttgataaaaaactatttaggctgcatgcctgcctgttagtaatagagaaatgtctccttataataagtaaaggagaccaaataaatttgtatgatatacttttgcattagcttaaaataaaaatataaattatatacagaacgatgagttaccttttttcatgtttttctgcctttattatatgtgctttatttcttaaacttgcatattatcttactttaaatattaaaatacttagcatggctgctgaaggtcttaatttgtcaaaatggattattcttagggactctgtaatggttaattgacaagatgcttcaaataaattagacttaatttattatag

SEQ ID NO: 226714 - DNA, 394 bp, Homo sapiens
agctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggccaccggaaaaaa

SEQ ID NO: 226715 - DNA, 556 bp, Homo sapiens
tctaaaatttttctagttttaaaattctacaactaaggcatgggtgtggataatttttaaacctcatatattatgtacaacatccttctactatagttccactacttatgggtactgggaacatatgtaaattatataagctttatgaatcagtccttaatttataaaataaagataatggcactaatattaacctagtggaattgtggtgaaggttaaataaaataaagatttaaaagtacagcacactatctttggctcataataaatcctcaataacaaataacaggcatcaaaatatctcagattcactgacagttaagcacagtccctatctatttatagagcccagactggccatgacttactttgtagagacctgtatgaagtcattcacatagacccttcaccaccccagaagtgagatatacagatatctttcacaatgttcaatgccctaagcaggatggcacctaggatgtttctctcagggaacactcacagtccctcagaccctgctccatcaatctctgagatctagtccataaggattcct

SEQ ID NO: 226716 - DNA, 427 bp, Homo sapiens
tccatccctcaataccattcccaataaagcaaccgctatagactcccagatatgtagccaaattccttctgaggggtcattagcctaaacgcagcatacataaaaacacagcaggcatgaaaagtaatttaaaaaaaacaaatgcccttctaacaccaaacacactggttatcctaataattccatgtctccgaaactcaaattccagccatcaattcaatccacactaaatgacaatcactctcaaaacatatcatatcagttcaaagtaacaattatatatgtccacaataatatccaaagtgccaccaaaaccatgttaatgtcaagttttcctttaactattgtcatcatagagtttctccttttatcatgaagaaatacggaattaaagatatgaaatgaaaaaaaggaacattctggccgg

SEQ ID NO: 226717 - DNA, 370 bp, Homo sapiens
agactgttgatgccacagtgacctgagaaaatggcatcagttccttattttttaatgacaacattcatattttattaaatataacaaagcttcaaactgctatatgcattatttagctttttctgtttacctatttcttattttaaaaatccctatatagtctccaaagtttatatgatcactataacatagggactattggatctctcacggaaagttgatttcagactcatgggtacccactgtgcagtgtgggtaaaatggatttacaaaccattcagagttaggaaatccaacccagaattccacccatgtaatgcataatctaggctttttcttctggctattaaaaaaagaaagaaagaaagaa

SEQ ID NO: 226718 - DNA, 599 bp, Homo sapiens
tccaggtgaaggatcgcggtgtcacctttaggatccctcgcctgaagtcaggactcacctgagcagaatgatggcttctcagtgaatcccacttcccacttgcatttccagagacaagtctggttcctctagattcacacacacataaagaaatagttatccttctccttgcccctgatctcccactgaacaatgcctgggatatgtgggttttggagtgtctatcaggaaggatgtgtggaggatttctcgacccctattattttcctttctgtgtacaaggcatgtgtcggttgctacctgagcagaggtggcagctccatataggctggctaagagaagaaaactgttctcactcagattctataaattactcgcattctcactttaatatcaagtatgatatatattagagtgcatggttttggctagaatcaatttggaaggctgtcaaataaaacacaaaatgggaaaataaatccaaaggaaaattgatgacatgattttactcccattacattccacttaacaaatgcatatgttttacaatatctttaataataattattaaacatagtaaaatacttccaaacttggct

SEQ ID NO: 226719 - DNA, 478 bp, Homo sapiens
agagaggggaatctcactatgttacccagactggtgtcgaactactgggctcaagcaattgtcccgcctcagcatctcaaagtgctgggattacagacgtgaaccatctcgcctggctctgtcatttcttaaagttcaaatgaatgtatgaaatcccccctcaattcttctcaagctagaaatggtgaacaaatttccttagacctcatcacacattattcatatatctctgatgcctagggtatgatttgtgtcatactttttgataatttttatgtgttcatcttatctccccttttgtattataaacttcttgtgaagcagggagtatttcattcatctatttatatggtattctgcataaaacaatgtcgtgcatatacctagtagatacacaattaaatgtatatgcaattgaaaaaacaaacccacaaatacactaataaaatagctgaatctctccttcagatattcaagt

SEQ ID NO: 226720 - DNA, 282 bp, Homo sapiens
catatcccagctatagtcagcaacaacaatgaaatgtaataatccttttcaggaagaccctggcagggctgtcaacccaattaattccagcaaagtaacgtgggctctttcatcaaaagattcttacatacaaacacacacaccttcacaagtgcacatgtgcgcacacatacaacacacgctttgttctgttttgttttgctttctgctaaaatgaatagaaagactctttaaaaaagaaaaaagaaaaagaaaatagctcttggtgaaaagcactcattg

SEQ ID NO: 226721 - DNA, 148 bp, Homo sapiens
gtgcccagcctaaattacttttgaccactgcctcctcccagtcctcttcccagaggtaataattgttattaattcggggcataattgtttatattaggcatctttatatgctaggaactgttagtacaaaatgagagaaaaagaaaaa

SEQ ID NO: 226722 - DNA, 237 bp, Homo sapiens
ctgtaaagagtatgtattttttttggctttgtaaatcttcttagaacataatacattgtcagagatttttttcttttttaaaaaatgacacatattaccctatagtaaaattatataaatctacctgaacttcatttgctccacctttttatttccaagttttaaaaaatgcagcttagcctaagctttattagttatgcaaagtcaaaataatgaaaataaaatgagattaactgg

SEQ ID NO: 226723 - DNA, 357 bp, Homo sapiens
cagtctgggcactgggctcacgggggtgggacagcacatgatcctgcgcccagggagccccaggctggaacaaccacatccaaaagcaaatgctgggcacccggagtcccccatggatggatgagtaaacaaaacatgctggagacacacaatggaatattatgcagccttacaaaggaaggaattctgacatgcactacagtgtggctcaacctcgggctgaaccttcacatggggccaagtgaaagcagccagacacaaaagccacacagtgtgcgactccattcatgtacagtgtccagaaccacatccatagagacagaaagcagttaagtggctgccagaggctgggtgaag

SEQ ID NO: 226724 - DNA, 502 bp, Homo sapiens
tggagatagtgaaaaacagataatttaaaatgaaagtaataatactttttttttgagacggagtcttgctctgttgcccaggctggagagtgcagtggcaccaccttggcttacagcaacctctgcctcctggttcaagtgattctcctgcctcagcctcccaagtagctggggttacaggcacctgccatcatgcctggctaattttcatatttttagtagagatggagtttcgttattttggccaggctggtctcgaacccctgacctcaggtgttccacccacttcggcctcccaaagtgctgggattacaggcgtgagccactgcgcccagcctggaaagtagtaatacttttgatggccctttcaattgtgttcttttcagaagctatcactaaagaaagctgatgttgagttttaggaaactgtttcatttcttacctggaattttaacacttaactgaattaaaccaaccaaccttacctaaacaaagttttctg

SEQ ID NO: 226725 - DNA, 313 bp, Homo sapiens
aagattaaaagcatgctgaacactcagtaaaattagtcaattagcagaatattatcaacaaaaggaactttcctaaggctccagctcttgattactgatctactcatttaatacagacttctaggggagtaatctgtaactatgcatccataattatttctacttaaaataatcctttcatttttatatgtgacttaagactaaaagtttagatttaaacagctcaggaatgaagagttaatcactgtaataatttttttaagtctccataattacaagtactatgtgtggctgtatattttatcttgactac

SEQ ID NO: 226726 - DNA, 405 bp, Homo sapiens
gcttaccaccatgccagacttacatagagacgggggtctcactctactgctcaggctggtctcaaactcctgacttcaagccatccttctgtttcagtgtcccaagcacaagctactgtgcccaccactaaatttatagtaaactgaaaactaactcactcactcactgactccctccctccttccttccttgctttctctctctctctctctctctctctctcctttctttcctttctttctttgcgacagggtctcactttgtcatccaggccgcagtgcagtggcgggatcatggctcattgcagcctcgacctcccaggctcaagtgatcctcctgcctcagcctcctgagtagcgggaactacaggcatgcaccaccatgcctggctgactttaaaaaat

SEQ ID NO: 226727 - DNA, 409 bp, Homo sapiens
gaacaaactccggacacaccatctttaagaactgtaacactcaccacgagggtccatggcttcgttcttgaagtcagagagaccaagaacccaccggaaggaaccaattccggacacactagtagttaatgactgtgagttatgaggcacatgaatctgtgaaattggaaaaagagtatctatttgggttcaaaattatttccgtcaacccctgtggttacttctgactgattttttttcttattaagacatattaatgactttttaactttgtaaacatttaatttcttactttctcatttatttctttttcatttgaagccaccagttttccaaatttcaagtcacctaagcttggcaaggcagaactatctatgatatcatcattaaaaatatactatgcaatata

SEQ ID NO: 226728 - DNA, 722 bp, Homo sapiens
cacagtggctcacgcctgtaattccagcattttgggaggctgaggcgggcaaatcacttgaggccaggagttggagaccagcccggccaacatggtgaaagcccgtctctactaaaaatacaaaaattagccaggcgtggtggcacctgcctgtaatcccagctactcaggaggctaaggtgggagaattgcttgaactcaggagacagaggttgcagtaagccggactgcaccactgcactgcagcctgggcaacagagcaagactccgtctcaaaaaaaataaatagccgggcgcggtggctcacacctgtaatcccagcaatttgggaggccaaggtgggaggatcacgaggtcaggagatcgagaccatcctggctaacacagttaaaaccccgtctctagcaaaaatacaaaaaattagccaggtatggtggcgggcgcctgtagtcccagctactcgggaggctgaggcaggagaatggtgtgaacccaggaggtgaaggttgcagtgagccgagatcgcaccactgcactacagcctgggtgacagagtgagactctatctcaaaaataaataaataaataatacataaaaacaaaagtgaggtcttttcacacatacccttttcacatttaaaatttctcacaaaggtaaggttaaaaattttagcagacccaaatccacatatataagaaattcagcctataatcaacagatt

SEQ ID NO: 226729 - DNA, 223 bp, Homo sapiens
caagcagagagagagagagagagagagagagacagagagagagagacagagacagacagaaagaaagagagaggcagacagacagaaaaagacagagacggacacagagagacagagaaacagagagaaagagagaaagacagagagagcgagagagggagagagagagagaaacagaaaggcagggagagagacagagagagacagacagacagacagacag

SEQ ID NO: 226730 - DNA, 363 bp, Homo sapiens
ttaaaacaatctagagttattgagatccacacactgaagatagtaaatgaatctcctaatagtataaagctcccgcaagcatgctaggtctaggttggggctaactctggaaagaagagagtaaatggacaaaggaatagggagaggatgggaagggatagaaaaggaagccccacctttccaaccctaagaactttcaaagtttagtttttatctctgttctttcaactatagaaatttccattttacctaaagtgaaggaaatcattcagcttataattttgtttttacttagttaactccattattcccaaggaatgagagagagagagagagagagaaagagaaagagaaagagaaaga

SEQ ID NO: 226731 - DNA, 521 bp, Homo sapiens
cagtttctccccaggtggagcagtccctcagtgaggactgtgaacgaatcttcaggaacccccactgtaggagcctcaaactgagccccacgggagatgctctagactgagaacttcccataaatgatacccacggggaacgtttagatttagaggttgcacagaattgctccacatctgggagaccaaaagacagtcctctggaaggtggctggcccaagctccccagtgggggaatcaggatgtcagagagatcctctagaacctgctgttcttgctattgcatgacccctccctggcaccagagcctccctcctggctccctcccctgtcacttgccagcctgtagtggtgcttgctgcagccctccctggttgctttatttatttattttgcaccaacagggttgctgcagactcattcttgcctggtttaaaaagagagagagagagagaggaaaaaaaaaaggagaaatgctttctggctcttttctccacctcagtcttggcagcagcggccgc

SEQ ID NO: 226732 - DNA, 591 bp, Homo sapiens
ggagcaatgttagtagaaaatcaccaagagagagcatgtaaaacaggttttttaagattatatatgcaagtgtaatgtgcatattttgtaaggatataacttatagatcagtgaattttcacaaactgaatatacccctgtaactagtaccctttcaagagagaacattaccagcactccacatgccctcttgtataaagcagatgttcctaactgggtgtccatgggctgcttcagtggttctctggatttccctgaaattgtttaattgtttgcaagagttgtatatgtatacttttttttttttttttttttttgagacgtagtattgctctgttgcccaggctggagtgcagtggcacgatctcggctcactgcaagctccgcctcccaggttcatgctattctcctgcctcagcctcctgagtagctgggactacaggcgcccgccaccatgcgtggctaattttttgtatttttagtggagacggggtttcaccgtgttagccaggatagtcttgatcgcctgacctcgtgatctgcccgcctcggcctcccaagtttatgtatactttttttttttttttccta

SEQ ID NO: 226733 - DNA, 338 bp, Homo sapiens
tttttaaggaaacttattggtaatacagttggttttttaaactaagaacaatgataggccaggtgtggtggctcacatccaaaatgccagcgcttcgggaggccaaggcaggcggatcacttgaggccaggagttcaagaccatcctggccaacatggcaaaaccctgtcactgctaaaaatacaaaaaaattagctgggtgtgctagcacacgcctgtaatcccagctactcaggaaactgaggcacgagaatcatttgaacccaggaggcagggttgcagtgagcctagattgcgccacagtcctccagcctgggcgacagctagattctgtctga

SEQ ID NO: 226734 - DNA, 556 bp, Homo sapiens
agaaattctgggtgaggcctggtcttccgtgttttaacaagtcctccagcaaatcctgatgcatgctgacatttgactaccactatggcaaaatggctttctactagatgcttgtatattgactgtcataaaatcaatgcccctcatcagtgttttatttcggactttctcgcctattcatgggcatgtatttgttctttcaaatgaacataaattccattccattaaaacagtctgtggttccaatggggcattgcaataaattatatattaacattaggataactggcatttttgtgacattaagtgtttatatctgagaatacaaaatgtctttttatttctccatcgttttttttttataaaggtcttctgactttctcgccaaatgtattcataaataatttatagtttgaggtcattatattgagttaagtactttttctattccatttctagatttttgttacccaattagagaaaaaagctattatataaactaaatatttatcttatatgtagccactttattaaattatcttatttattcaagtgg

SEQ ID NO: 226735 - DNA, 669 bp, Homo sapiens
cggccgcagccaccataaagcctgcggcgagattgcgaccggcgccaggtgagtaataggcagcaaaatccagagtatgttggtgcggagtcgcggggggggggaggggcggggtgcgctgcgggggtggcagggcctgagctgagacgggccctggggacctttgaggctggggctcccccgaggactgggagatttccagggcgcgctccttctgcgcagcggctacagcctgaagggggcagctctggatccagcgacaacgcgcggtgtccgcgcctctgagaaggtggtagttggctggttgcgctctcccgaattggggaaaaaagaactcagcctccaaaagggaagaaatgctttgcttttctcttctttctcagtccaaatttgcttacctcctcccttctctccccccgcccccgatttggggaccctgctcagacgtgtgtccagcctctcttactggcgttcctctttttttttttttttttttaatctcctgtgtatctcatttgtatattgtgatgttaatgagtaactcctgtagcgctgatgggcggggggtggaggggatgaacggctcgcagtctctctggattttgctgcctattactcacctggcgccggtcgcaatctcgccgcaggctttatggtggctgcggccgc

SEQ ID NO: 226736 - DNA, 503 bp, Homo sapiens
gtgtttttgtttttgattttgcaatgactttaaatatgtgcaaaagactttaaaagatgtcagttcacacagtactagcagtaacctttctattccacttcagggtggtaaaatgagaatactggaataggagtctgactagttataggttctagtgctagtttctcctacagctaaatgaccctgagtaagtcccacactttctggatttgagtttggtcatctgtcggtgggggaattggactagcccagtgactctcatctaggaatgatcgtacccccgagaagacctctgataatgcggagatattttaggttgtcatcattgagcagagagggagaagagccaatcataattccaagagacagaatcctgaatgttgaaatcctgaaagatgaaaatccctaaagtctaaaatcctcaaaatcacagtcacaaaagactaaaatgttgaaaataataaatgtgggaaaagtactttttttacttctttaaaatatgt

SEQ ID NO: 226737 - DNA, 434 bp, Homo sapiens
cttgacagagaacctggtctggccctacaacctgcctgggctctcgctacgctcctccgtcgcaccaggctctgatggggtagagagagccagggacctagtcccccaccttcccgaaggaacggggtacccgctgtctccagcagcccagccagcaccaagaatctcggctctccgagagcggctgaccttggccgccggatctttggatttgtgagggtcacagtgcaccacaccatccctccctgcaccgggtggccctgccgcagtgtccacgcctcgtcctcctgctcggctccgccctattttcgccaagccaatcctggaaggttgactctgggccaggaacggagctgcagtccctgagcgccctggtttcaaggcgcctcccaggtcaagaatccttcgaataaatcctactgtcttcaaggtga

SEQ ID NO: 226738 - DNA, 795 bp, Homo sapiens
gtaagtcaaggacttgcatgctagaatcagacagaaaatccagaaaagccacgttatttaacagaaccctacaaggtcagctttgagtcaaagcagaccacatttctctcggccctcgcgagtgaggtcgccaaatactcgacgcctcaagagcgagccgaggaggcagaggccgaccaagccggcctctcggcagccccgcccggcgccccgcggagaacgcccgggtgcggctcgagggaagttgtgtcaagtcccacgcgcggcccgcggagaacccaggggcggcccgcgcgcgtcggcctagcggggagggctgctccgggacacggtgcggcggccgcgggcgagttggacgcgctggcagagccgggccgaaggcggcgggcgtctccgggcagccatgttcgcggcgcccgcccgcgcagcaggacggagccctgacagcaatgtttgctacggcctccctctgcagtcagcctaaagcaaggagctggaggtagatgaggcaaaggtaaaggagaccaaaacagtattttaaagaaaaaatcatttatcttcaaataggctccaaacctaagatggtgtatactgttagaggacaagaacctgcttctagccatctttgcgtctccaggacctgacttgtgaccattcaataagagtttgatagatggacagactaatgaatagatgaagatgattagaagccaaaatttctgaatcttcctagcacccagaacatggcttaacatcaaggaaatgctcactaaatactgtcataatggaatgaat

SEQ ID NO: 226739 - DNA, 289 bp, Homo sapiens
cattccagcctgagcaacagggcgagactccgtctggggaaaaaaaaaatagaacccaggaccgggcgcggtggctcatgcctgtaatcctagactttgggaggctgaggcgggcagatcacttgaggccaggagtttgagaccagcctggtcaacatggagaaaccccatctctactaaaaaaaatagctcggtgggtggtgcaaccctgtaatcccagttactcatgaacccgagatcacagcactgcactccagcctgggctacagagggagaatctggattaaaa

SEQ ID NO: 226740 - DNA, 480 bp, Homo sapiens
ttttccaatttgctttggtacttttcttaagtacagagaagcagaaactcccccatcctcttcagccctccatctggctcctgctgttacttgttttcacccgaattttgttcttctgtgattctctgacttgacgagggccactagcatcccccaaacagacaatgcgctgcctctgcgtgctggcaggaggccacctctctttgtgctgactcagcagccaggctcccaggctgtggcacaagtagcattcctgggaaaagcctctccccgttataaacactcatgaaaacaattcctcactgggaagagaactgaaatctgctgctcaatcttaatgagaccacggtttagttagccttttggtctgattacagtttttaaggttcatgctgtatcattcagcataaatcgacattaaaaaataattcttttctgtgaacaactcacccatgaggtttttagggttttttttttcct

SEQ ID NO: 226741 - DNA, 372 bp, Homo sapiens
aaaacggtctcaggttagagttaccaggacatctgcctctccagcttgggggtctctcacgtgcccctctcaggcaagatcgggcctatcattggcttaggttttaggaaggtcccaagctcatttgccaagggctgagcttccccataactcccaggacacagggagaagacaaggggagggaaactgagggacggagatgaaagcgctcgtcccagcgaaggacccgcgcttcaggcgctgggccctggcggcagtgaacaagctgggggtggggcgtcgggccgcgcccccgccctccggacccccagcgcggacccctgctccggggcgggggcgctcacagtcgcgcgaacccggaggtgcggagag

SEQ ID NO: 226742 - DNA, 1110 bp, Homo sapiens
gatataggtgcacagtatgttacttaagtaacggatgagcccccctaaacatccacgtgtctctgcaggaacctgtgtaagtattgtgaaaacccttttcttccagggaaaaattattggaaattccttaactgagctatacttggtacttgctctagaacatttgggaaatgacaaactcaggctggctctcctctctaacctcactgggctataaatgttccttctaactctgtaatgaaagttcagtgacaaactagatagtgaacctgtgaaagtcattatttacatttgctttaaagggacagttttaccgttcaacttcaagagtttttctacctctttaacagttaatattttttaaaggaagaaatggaatgtaccttcaggggtcaagctgttaactgtatacctgcctctagttagcttggtttatcaaaaggatttttaaatgattcaaggtaatgtttaggatatttgttttaactcctgctgtgctgtgatttaaaaaaaaatagtctaagaaacaaatttatccatgagataaacatcatattttatagttttagaaaaaagggttgggggtggaatttagcctagaacttaaagaaacaacctctgcgaatttctcttgacagcggagttgcttgtcttgacttctaataatataaatccaggcagtttgattatccgatttgcaagaaactttaatggaattctggggcatttgtcctgttttatgtgcaaatgaaagtctaaaaaatatgaggaagatattacatttttcaggagcctccattttttcagtctaagagaatgataagtgagaggcctattgtgatgaagttgcattggacataatgtgggaagtgaataaatagaaccaagaatcttcatctatctctgttggtctttcaggattctcttagcatataggaaaatgatttaccttccagatctcgaaggacttccaatagcatagatcaggtttaatttgatggtctataccatcagaaataactaatatctgttttctttccttttagagtataatcaattatggataggccagaatatttttggcttcaaaacaaaaggattcataagctt

SEQ ID NO: 226743 - DNA, 428 bp, Homo sapiens
cccccccacacacacagtggcctctgtaacatgcccacacactcagcttgcagatagacaccctatcacgctgctctgcactgtgaaaagctaccctgcccacaggcaaccgctataacgtacagacaagatgcctccttcctgttcactcagcaagcacacacaatcgatgggatagaatgctggcatgtgtcctcccccaacaaagcttagggtggtgcaaagaggcaggggctggtgatcggggcatccaattggtagccccacatctgcctcgggtttctcagggcccccagtcttcccatgtgtaaaataaaaggcgtcagccaccgcttcacattttttaggtaaattcatttaaaggtgaaattcacaacatagttcttactggaaaaccagtatcacttgtcaaaaaagtaactacaaaa

SEQ ID NO: 226744 - DNA, 408 bp, Homo sapiens
atttacagtagttttaacaatctgttccaatttttagcccttatattttatcgtgaataaaatatgaacatgtctatgaacatgtccatactttttaataagaaaacgacctttaactttgtatcatggtggaatttgtaaaagctattgatagttttgttcagacagaaatttaagaattatagtaaatagttatgatttggttggattaaaaattctgtaagatctgatcttagaatcttaatcttgccaatgatgaagattctaagtgatggtgaggagttgtctgggaatagctgtatgtcataacaagctaagtttgtttataaagcatggtagagctcaaagggaaagcttttatgaaatctggctctagcactttttgtcaaaataaatcaatgaacacag

SEQ ID NO: 226745 - DNA, 636 bp, Homo sapiens
ttgcagtcaaagaaccctgctggctgttacccctcccttgcaactcttcctgaccctaattgtcttactttcatgtttttttttaaatgccagattttgtgcatttctcccaatatcccagggtgcccaattttatctctcctccctccccaaaaactgtacagccaaaaagactttaaacactttttaaaatttaattttattagccgggtgtggtggctcctgcctgtaatcccagcactttgggaggctgaggtgggtggattacctgacgacaggagttcgagaccagccaggccaatatggtgaaaccccatctctactaaaaatacaaaaaaattagccgagcgtggtggcgggtgcctgtaatcccagctactcgggaggttgaggcaggagaattgcttgaacccgggaggttcaaattaaagcttttagtttttatttttaatagaatccagctaatgcaggacaaaaagtcttgaaccagattttcttttcactccctttttaataggagaagggaactccataaccaaggcttagaccctcttgaggagagaggaacttgaggaaaccataaaatcttacctttttcagactcattaacttaaaatggtttgaaatagcttctgg

SEQ ID NO: 226746 - DNA, 481 bp, Homo sapiens
caagagagtagtcaaattatattggcagtttgttccctatgtacaaaatggttgtgttccaaaacctcagcttaaatccattatttagaatttgaaacacgatctattaaacccattatttatttgagggatagtgccatattaatattacaaaagtattggacttaacaaagtttgacttttctgcattcaaactctcaagagtcctcaaaagcacatttcctccttctctagccagggaagcattcgagggacgtgagtcttcctcccagcccatcagccaggtactgggagcatgcccaccccaggcctaagaaacccacagcctcctcagagctgagagcactggccccggtagtgggatcagggagatgggctggggcatctctgagaaggccaaagcagtgtgtccaatctcttcagagcaccaatccctggacttcttggactgccaatggaattaggcctttgactttctcac

SEQ ID NO: 226747 - DNA, 462 bp, Homo sapiens
agtgccaccacttgccaggtccactggccgaaaggtagcattctcccttccttgaggattcttgaagaatatctaggtgagagaagggaagaaatactgattgtagagccccagagctgagtggatggcacactgcagttgattgcactattttccctgctgggaatcccacaagcgtgcacacacacacacacacacacacagaccacaactgtgttgaagagggtggatgtggctagtcagctgcagatccaacatgcaaactttgcaacctctggttcagctccagtgtccaccctggggactatggcactataaagtggcacagaaaagtaacttgttttcaactaaagtcaagtggagccaggaatttgaaaacttgaccttattatattgctcataaagagagacgacttttagatatgaagattttaagatgggcaaaagcagcaagcttactgc

SEQ ID NO: 226748 - DNA, 358 bp, Homo sapiens
aagacaacaaggagcttgtagaggttatttgcttttaaagattattggtaggggagtccttctgttgtttataaggagtgagaacagtttgaaaagctcttctctcaactacctttctggaaaatttttaatgtggtaaaactgcacgtttaacacaggcccaactgcaaacaaccaaggtaaattcccacaaaagccatctcccctgcaccaccccctggtctagtcaacactgtaaatagaactgccacgttattattgagaaggcgggtagctcccatgcaaactacatatttgattagagtctgaactctttgctgaaccatgaatttgaaataatttaggtgatacatataaa

SEQ ID NO: 226749 - DNA, 665 bp, Homo sapiens
caggagatcaagaccatcctggctaacacagtgaaaccctgtctctactaaaaatacaaaaaattagccaggcgtggtggtgggcgcatgtgttcccagctactcaggagactgaggcaggagaatggtgtgaacctaggaggcagagcttgcagtgagccaagatcgtgccactgcactcaagcctgggcaacagagcaagactccatctcaaaaaaaaaaaattgatcatttcatattttattaggacttagatactggtctatcacatcaggagcttgaacaaataccagtgcctgggtttgagtcaaaaactctaaatttttttggtgtaggactctaatataggcatattttttttaaaaaaaatcccacaaccagttccttatatgaactcacttcagaggcctggcatttaatttacccattaaaaacaaaacaaataataaaaaaaaaacagacttctcaatttaattaaattattcaaggtcacagaaggtagcttaccttcaacttactacagcataaggttactgtaatttaagatttaattaagttcattttaaatattttaaaattcaataataaaatacatatgaactcaaaactttccaatacttttcacagatgaaacatacagaaaattacattgtttcccatttgta

SEQ ID NO: 226750 - DNA, 368 bp, Homo sapiens
aaggtcaggtttaggaagggagcctggattcagatttcccaacattagatcaggaactctggaactgtaaaccagagggctacccagagccctgcctcagttcttctactggggtggctgctgggacgataacttcacagtagaaaaaaggagaggctgctgttcttctaagccagagaggttgaacgccttctgctgcacagccgctgcctgtgtgtgcgcatgctcccttccctctagcgtgtctcctcctggatgtgggaaatgctgtcagaatgcttcctcctgccagatcccatgtagccccccacctcccttcttccaggagttctggtttctgttatgccagcctcttcctttcctgttcg

SEQ ID NO: 226751 - DNA, 519 bp, Homo sapiens
ctgtcataggctggtacttttgtcttgtccctttcatacattaatgtatacttattcaattttgggcttgtttttctttgtgatttttaaccatttccatcaatatgtgtttattaaagtacaaaagattatctcttggatggtaaagggaagatgaagaatgaactttgaaaatcttgtagccttacagagctgggataaccagtcataaggagacttgatctgcattgactttaataacaataataataatagacatcattttggataacctcttacattttatgcttttattttctctttatctcatttcattctcctaatggcctttttcagatgaggaaattgagactcagagaggttaagggtcttgacgaaggacatatacctagtaagtggcggtgtttgtccgagaggatggtgctcctgctctgtcacagtgggcatggggattcaggccactgccaccgaatttcaagagcccaagcacagagcccaaaactaaattgtgagggttta

SEQ ID NO: 226752 - DNA, 539 bp, Homo sapiens
agaagtgctttataagcattgtctcattttataatattcctcataacatatgagattatttcatatattataatttgatgatttagatactataaatatccccattttatagataaggaaactaaggcataatatttagtagcccagtatcacacatgacagtgctaggatttgaatccaagtttctcactccagagctcacaatcataaccactatgtcaaatatcctttcagttgttttagtattatgtactctacttttcacagagtgaaacttctgttaactttgggaaacaaatataaatttattgggtgttctttatgttctagtctctggaaaggaaaggctaaaaagattttgactttttccctcaagaagctctttttgggaaagacagacgtggagaagtgattattacatgtgttaggtgctgtaataaggtggtacaatgtgcagaacagaatagttatggcaatcaaggcatcacagagaaagtgacattttcactgcttcttagaaaataagtatttttgaggtt

SEQ ID NO: 226753 - DNA, 263 bp, Homo sapiens
agagccctagacagcttcctgggaaataccattacttaagagaatgtggttcaatctatgtttttgtagcctaacagtcagtgaaccaaaacaatgaacaatcatgggaattctgactctcctgtgttgtcttctcaagagagcctgacaattctgctggttatgtccacttaaaacccaaatcaaaaaccttatatgtgtacagtcctgttgactttcaaaatacattgctactgctacatatattaaatcctcatttgact

SEQ ID NO: 226754 - DNA, 353 bp, Homo sapiens
cagtctttgcgtctgcaaaacctggataatcactccatataccacctgccgggaactaattttcttgtcatttcataaaaaaagattcccagtcttctagacaagttgcaaggactgactaacgcgggggaatgcttgcatatcagcagaccagaggtggtgtagacgccaagcgtggaccgagtcccggggcgccccagaagtgtcttctccccgagcgacagagttaatgcctcgcattaacagctatgagtccctcttgggtttctcccactcccaacacccttctctgagcccctggccaccgtcgccttctcctctcgcgccccactgaccaaacatccctttcatca

SEQ ID NO: 226755 - DNA, 220 bp, Homo sapiens
atgtgccaggcactgcagtaaacatggaggatagcaacaaaacagacgtggttcttaccttctggaaatgcttagtctggcatcaggcatgttttccatacacacaaacacaataacagcacaacaagatgagtgcttttatgaagctatgaaaaatgaagctgtggaaacagagttctgagtgtttagtactgcccaggtatcagaatttgaactaagt

SEQ ID NO: 226756 - DNA, 389 bp, Homo sapiens
tcttcaggggggcactctttgcttccagacattatccaaataagtttctatcaagagtgagggtgacataacaggtgaagcataagaaatataaagcatgcaggtatggaattttaacaagaaaccaagtcttgggactttctgaggggaagaaagttgtaatactccgggaacatttgaaattgcatgtccagccataggctgatagtggggagataccattattctagttgtagtccagaatttgcacagtttgttttattgttcatgatagaatcatattttcttcctacatctaggacttaacgcttagcattagaaaaaataaaactattcatagtatcttccttctttgttttaaaataaatgacaataaatattattaccaa

SEQ ID NO: 226757 - DNA, 226 bp, Homo sapiens
gaacctgggaggcagaggatgcagtgagctgagactgcaccattgcactccagcctgggcaacaagagagaaactctgtcttaaaaaaaacaaaaataataattttttgatatctcattattagaacaaagttttcatagtgcaatcagagcagttttgaaatgtgaatatactggtaaactttttaaattgaagagttgtggccagtatctcattaagtctattc

SEQ ID NO: 226758 - DNA, 235 bp, Homo sapiens
aaaaggaataagatgcaagccacatatgaaattgttaatttcctgcagccacatttttaaaaagcaggaaatcataggagaaatgcattttaatttaacccaatatatccaaaatattatcattccaagaagtaatgaacatcatataatttattaataagatattttacattactttttatactaagcctttgaaatctggtgtgttatacttcttggggcggccggatatact

SEQ ID NO: 226759 - DNA, 354 bp, Homo sapiens
cagtataatgaggagccacaatttttacaaaaatgaatcctgccagaattaaaaggcatacatgattctttgaagaatttcactaatgcatagaaactgcggtaacagaaaagaatactttgacttcctcactattcctaaatcacagcagattacagattcaaaatcaatcagtattctctgctgaactctaattaacacttaacattattagtcacaaatgtgaaatcttgatcggagatggcctcaggtattctaaatgtaaataaaattaggtttagatcccttttaattacctgaggtgctgtgagcgattacaatggcaattgataaacttaatttcttattaaagca

SEQ ID NO: 226760 - DNA, 452 bp, Homo sapiens
tgttcttgccccttctaaaccaccaagcaaaagacaaaacagtagttaaatataattaagtgaatttcagtgaagagtgatctagatttctaaaacaacacaccaaaagtacaaaccaaagagaaaagatggcacagttagaacttctgtgtaacaagacaccaaaaacaaaagtacagatacatgactggctaggagaagatatttgcacatacaataaaggatgaacctcaacaagataaatagcccaattggcagggcagtaggggggcaggtagtggaggaaggtaaggatgtgaatacgttatttgcagagaaataaatagaaatggccaataaccacataaaaagatgtccaacctcactaagtcatggtagttggggatcgtaacaacctggagcttgtggtatcttgtggatccaccggccatctttagttaacaattactttt

SEQ ID NO: 226761 - DNA, 467 bp, Homo sapiens
tacagtcccaccagcaccatgacagtttacaaataccatgggaatgccaggaagttactctatatggtctaaaaaggggaggcatgaataatccaccccttgcttagcatatgatcaagagataaccataaaaataggcaaccagcagcccttggggctgctctgcctatggagtagccattttttcattcctctactttcttaataaacttgctttcatttcactatatggactcgccctgaattctttcgtgagcaagatccaagaaccctctctggggtctgggtcaggacccctatttggtaacagtcctacaagccaaatttcctgcaaggtgttaaggagactactccaaaaataactttaaaaattgtagactgcatgaaatagagtttgaagactctaaatatctccccaaaaagtccattttcacttccctcttcctcatttgaaaggccattgttct

SEQ ID NO: 226762 - DNA, 446 bp, Homo sapiens
aaaaaaaaaaacaggtttttgtttgtttgttttcctttaatggaataaggtctttagaactagactccttggcggttctagcttagactacaagaagccactagaagcctctgtattgtttctggattctgttaccttgggcaccgttcgtactgatgtagtgtttgcttttgttctttcgttatgtcttattcctccagtattaggaacagccctaggtaacgtttctgatcatgaagtgaatctgaccttgaaataaccctgaactattcccgtcactatggcccgtgtcaaaaacttgcggattgttgtgatcatgaggtttccattgatatgtttgataagtggtttaaaataaatatattttattgtaagtatattaatatgcaagatatgactaaagcaatatgatgtttgactggtttattaaaaaactattcacatta

SEQ ID NO: 226763 - DNA, 434 bp, Homo sapiens
attaaatattttcaaaacatagcttattaaactatatgaaatttacatatctatctaaaattactttccatttccccaccacaaagatgcagaaattgaacacaaagatggggaaacttgcttgggacttagagcatgagtcatattggatccttatgaagccagtaacataacacagtgctaatggagtaacacagcagatgtgaataatacccagggaccataccacattgtatcaatgtttcccaacctttgtcatgttgtagcacacatagaaaatattgtacagcatactggtataaaccagaaagaattagagaaaaaaattactttttttaaattatataattgatgaaaaaatgtagaagatttgaggaaaaatactgaatttgtatggaactttcaaataaaatcttgccagatgttttaattga

SEQ ID NO: 226764 - DNA, 420 bp, Homo sapiens
tcatgtcctgtgcttcctaatcaatatttaaatatagatggtcaagagaagatgactctaaaaggcaatcaaaagttgcaaacattcttgtatggagaatcaagtttaagtagatgcattaaatttatcacattaaacttcacaacaggtttgaggagagaggtgagaccttcttttgtagaattcaaacttgttcagatatttgaatacatatacttgagagaaagaattacatgaatttagtttatcttcaaggacctttatatatttcatacacaacacaatttctttgtgctcattatttaaaaataaaaatatgtattctaataggggctatgtatatatttgatatataatacaatatattgtatgtataacacgtatattgcacatgaatgtgaaaatatataaaatcaatat

SEQ ID NO: 226765 - DNA, 451 bp, Homo sapiens
attttctgggccaaagctgggagaatacatgatcaaaactgattctctcatcttcttcttcctctttctctctctttctctctatcacaaagggccccaaaatgacagatttcccctgcatcatgccctccatacttcagtttcttagagataccctaataaaggatatgggtattttctctgcacttagggagaactccataaactggttcaatcaggctgcattgttgaaaagccaaagggaaggattaaagaaatttggaaatggtttttcaagacaacgcctggcttgcaaggttattgtcttgctgaataattctatttgacatgccaaaagagaaatattaacttgttctttctttttgcattccttctgttataaatcatagtcttcttccaggatgatggatgcctcaagacacctagagcaaaggtcaagaaaggaaggaag

SEQ ID NO: 226766 - DNA, 478 bp, Homo sapiens
caaataccacttttgcccaggcttttgtgacatgcagtgctcctgcccagcatggcaccttattttgacaaggaccttgttatctttccaccaagttatcacttgaaatgataatatagcttgtatgttgttcccaagctgtcgtatattttcctggttgtttgattttaacaatgagaataataaggtttaatactcctccctaagaaaagatttgcttatttcccaatttgaaattactttgctaagagggatataatgagttctatagtgaaacaagtatgtgttttatcctaatttctgaaattattcctgaaaattcaagtccattgtttgtctcccaccctatcctttggttctgtcacctcagaactaacaccttgacaaagtgtttcttttttgtccttctaccctccccgcaaaagtttattttttaataaatcgtttctggcaccaacccaaaccacaattacttaaa

SEQ ID NO: 226767 - DNA, 342 bp, Homo sapiens
cattaatagtggttaatggtccctggtgggattatggctgtttgtttttctttttatttatctgtattttctcacctttattaaatatttattagtatataattaaacacttttaatgagccaagaatatgaaccgtcagcttacaaaagaagatatacaaagagcaatacttacgtgaaacagtattctacttgttgaacaataatcaaagaggtgaaagattagtgcgatatcatttttatatagtatgcagcagtacagtttggtactggaaaggtgataatgcaattatactgtatagtatatctgagaaataatatgatgatatgtatcaaccttaa

SEQ ID NO: 226768 - DNA, 463 bp, Homo sapiens
aataaaatgctgctgcagttactgatactttaactatgtttgaaaaaataaatattccgttgcagcaatgacaaagacctttttagattccattgtggtaacacatcaattaagagaacaagctgtagagctacatcgttcaacaccagagctaccagtcacgtacagctacaaagcacttgaatgtagcgagtctggattgaaataggctgctaagtataaaatacacaccagattttgaagacttagtactaaaaaaagaatgtgaaatacctcattaatatctttgtatatgatcacatgttgaaatgaaaatatttggatatattaagttataattttaaaaaccttgctttttaatgtggttcttggttagaattacgtatatggatcatggtgtatatttatgctggacactgctgctctagagccagattctataaagtgtattcctggccctgcc

SEQ ID NO: 226769 - DNA, 522 bp, Homo sapiens
agagtgtaccacatggtagggagtaactacacatatgtcacatgtattctatgttttatctttctttctaactgagagataagagtgcttagttagccatgattccttggcctagtgttatggaaatttgccagatctttatagtaaactagcccagtcctacataaaacatttaaccaatattcttcccttattatgaaaaaaagattaaatttaattatttcacagaaatatttcaactgttatagtttcacatttttaaaaaataaaatttttagaacatatgtttcaatgtgtttcttcctgaaattttgttgtcctctaatccgcaagacatttcaacattgtttctgaacacgtattctttggctgttcccctcacgtagagaatagaaagaaactaaaaaagaaattaacaatgattaaaataatacatgaaataggaagttaagactatagtgcattatttacagtaagtcatttttatttggtaagatgatgcgctgtgttaaggtcatcagg

SEQ ID NO: 226770 - DNA, 196 bp, Homo sapiens
aagagtccacaccatgagcagtaatagcatctggataactagtcacaatttagctaaaaatgtaagtgaacagtttcatatttagaaactatgaacaaagtatgaacaattatatgccatcaaattagataaactagaagaaatgaataaattcctagaaacatgcagcctaccaagaataagttatgaagaaaca

SEQ ID NO: 226771 - DNA, 485 bp, Homo sapiens
gtttagcttgtacttgatttttactaatagtctaagaactgaaatccacagataactgtgaactccgtttagtcagtagtattactctctatccagctttttttcttttttttctatgcctataccactaacatattgtagaattaatttattttgaccttttctgtctccccccctccctttttaagaatttcttttaaagatggtgataagtaagtgaaactttgaaaggtaggcagtatcagatctacataattaagaactgcaggcaatttatggattactttcctttaaacttccaaagatgtaatagtataccttttagagatgtggctactgctctctggagagaattagggtaagcagattttcactcatactttatgagctcattaagtatgggcagttcaaccgtttagtaagtaaaacaaaatatgactattttgaagattaaatctgtttatagtaacctttagattatgtac

SEQ ID NO: 226772 - DNA, 394 bp, Homo sapiens
tcagcctcccaaagtgctgggactacaggcatgagccaccatgcctgaccttttatatgattcttatgaggattaaatgagtgaacatttatataaaatgcttagaacaatgcctggtatgccaaaatgttagttattattacttttgttttttgagacagagttttgcttcttgctcagctctccactgcagcacaaaagcaaatacgtaaacaagtgggtgcggctgtgtttcaataaaactttatctggaacagacagacaagggcctgatttgacccactggttaaactttgtccttccttggcttgagtcccttagcacgttctcatccatttcatttatttattttattgttatatatattttttgagatggggtctcactgtgtcac

SEQ ID NO: 226773 - DNA, 527 bp, Homo sapiens
gagaataataatatatttgtttttgaggccctggaacatctctgaggactatcgccctacagagaacagcttttttgatgctccatgaagacagaattccagtggatccacaatgggtgggaggaagtctaacaagactcaaagccaagtacaaggggtgaccatagcacagacaatgacaggaagaatccttgcttctggaaacttcccgtaaaagtgcaacattacagaaggtacagagaggcacctctgtgcccaaggctggagctcaccttggagaagagagccatggaaatgctgggcttggtgacaacagcaaggacaacatcagcatcaagtagcaaagatgcacctgtttcccagcagggaaccagctttgctcctcacgggcaattagcaaggtttgacttaatttaaagcctacacaaccactgatctctgagaatatgactgatgttattttctgtactgagagtaacagtaaaacaacaataatgacaataaaaaagtggcctcgctggcctcac

SEQ ID NO: 226774 - DNA, 274 bp, Homo sapiens
cacacacacacacacacacacacaaatatatttctgttacctgtatgacatgagcattgtagagttggctttcagacactgatgcctggtaaatgctttgttcaaagcatggtgaattatcattctcatcctgtatcaagactgctactttgcaataggctctatgcccactactttcagctaaaacgatgagttgaacctcatttctgacttcaaaatcaagaaacttgggttctttcacagtgagttgtcctatttttatttccaaggagaa

SEQ ID NO: 226775 - DNA, 408 bp, Homo sapiens
ttttaaatggtaaatttaagcagaggaataatccctccattaagcagaggaataatctctccagcagcatttgttctaaggtgaagaaatggagtccatgtcacaaggaatcagtgacagaaccaggtgttaggtccaaatctctggactctaaatattgtgctctttctgctctaatatttcctgtgtgttttacagtctgtcttattagttatttatttaacactgtagaattgatttcctgcatattagttatacaagtgtgcctcctcttggccatcattattttttatgggctgtaccataaattctgacacttggcccaacaggttgcttttatccagtatagactattgaatgcatgaaaaagaaaaaagtacaccaaaaatatacatttttaaaaggcca

SEQ ID NO: 226776 - DNA, 269 bp, Homo sapiens
tgggggaacagacccactgcactgcccctcgtcagaccatacctgcactacgggcctgtctcagaaattctgctcaacagggatgcgttcggagagaaggacatggatggtgaagaatttggaaataccttatacaaagaatggtcaagggaactgggaacattccggctgcaaaagagattaagtaagagaataatttaatctacttcacccaggatttattgaggctccacttcacgttaggttctgtagggaattcaaatatgaac

SEQ ID NO: 226777 - DNA, 369 bp, Homo sapiens
atcttacccaggcctcttccttcaaaagaaaagtctgtctttgagacactttagatccattcagtgggcagggatgtctccccctgccacctgccatcacagcccccacctcagattcaagaacagctgccacaaacacagtgacctgcaggaagtgaaagagtgaagtgactgggggcagagtaatagcagccagtaaagactgagggatcattgtgggctttgagaactatttcaagaattttaggccagtcgcagtggttcatgcctgtaatctcggcactttgggaggccaaggcaggaagatcgcctgaagccaggagttcaagaccagcctgggcaacaaagcgagacctcatctctacatta

SEQ ID NO: 226778 - DNA, 480 bp, Homo sapiens
caaaccatctccatctaagcatttatcaaatttctctttaaacttgaaaatcaactgaagaatttaagtcaagtttagaatagataaatatgtctttgagtatattttacaatgtctgtttgatttagtagatccttctggggacaggtctttctagagtttggagagttaccaagttactaaggtgtatttcctcagggctgcttcttgcttgttctcagagaagttggccaatcactgacaaaatgcatttcttttcccccttttcctgtcgtttgttttatttttaagctagcacttgtattttggaaaaattatttactcaaagatatcttgggcaggaaagaaaaatgttttacttcagttatttattggatctctataaagcaatatgatttctcctaaggctaactatatagtaggactagcatcataaaaaagtcatgtctttaaaaatgccaaaaatttgattttttgtat

SEQ ID NO: 226779 - DNA, 622 bp, Homo sapiens
gtagaatgtttcacagagctccagactggcaccataaattagtcagtaagaaaaaatgtttaatcatttgcagatgataaatttgagacactgataagagacaaagttaaattaggtcagaactgagattagattatttacctatcctgatatctaggcagggatagatagtgtcggtcattgacctcagaaggatctctgattcaggttataagcaaaatgaataaagaggcagtggacagggaagctggagcagaacctggagatgtagcacatgcctagaaatgaggtgtttcattttgtactgtgtttcttttgcttttcaaattacagagacaatataaataggctgttaaaactatcacatagtctagaaatgtaaggccaacttaatttgatcttggctaatgtgtttattctttaataaactttttattttggaatgattgtagaggtacaggaaagttacaaagataatagagagttcccagatacgcctcagccagtttctcccgttgttaacatcttacagtaccatggtacatttgtcacaatgaggaacccagtttcggtactttactgttacctagacttcagacttttttcagatgtcattcgtttt

SEQ ID NO: 226780 - DNA, 683 bp, Homo sapiens
atctaagaattaactgtgttctggaatggcacaaattacaaatgaaactcaagggaggtaaagcacacagtttttggatgatcatgttgctagttatgggattagttaagatttggccctgagttccagggctcattaatgctacccaaattattatcatttccaataattagcctagataccaagcccacagaaaacaggcaagaaagtcctggcagactagatggctcaagagcccctctctgtatccgctaatgctggttggcaccactaatgctggttggctccgtttcatgccattagcctgggagttacttcagggcgaagatggtgtctgggtaccaggtcaaatccccgcaaaatcactgagccagcctgccttggacatgcagatttccactgtggcggtaactggatggtggatagagggtaaaacagatctgagtttgataaagtcagaaccactcactggatgtgtgtgtgtgtatgtgttggtagggggtggacctgtgccttgtaggacatgtggctgcatccctgacctccacctacccatcacgaaaaccaccaaggcctccaggctggcaaaatgtcccatggggacgaagttgccctaaatcgagaatcagtgtctgaaacaaccctggacacgttgtgctgtgttgctgcttcctgcagaagcc

SEQ ID NO: 226781 - DNA, 466 bp, Homo sapiens
actacagaaaccaaattaaccagtagcattgtgaggaaagagcaaggaacaatctgggcttgggccctgggtctaccatttactaactactgagtagtctattcaacctctctaaccttctgtttccttattagtaaaatcatgcttaactcacagagcttttgtgaggaataattgaggtaatggtcataagtaccttgttaactgcaaggggctattcttatatgagggattgttaacaataaaaaagaaactgcttcattcttttcttggaaggtgcctggagtactacagcaagttcaaactcctgcccaatttcagggtctttaatgatcctgtcctcccttcctcattcaacttgttgccaacagcatggcccctccagcctagctgggtgcctcacagtgctatgtgcacctgactctcatgtgtctgcagatcaaaccaataaacatttaggaacacc

SEQ ID NO: 226782 - DNA, 540 bp, Homo sapiens
ttgggccaacgcaccgtcccacactgacagtgcccccgtgtcgtgcatgtattctgcgcattttcctgtgctaaacactctcccaaaacatcgtggggcctgattcttcctctttgttccaatggccctgggtgactcaagtgcccattcaatgaccaggacacagaggtcttagagagatgctccttgaggccccaggtgcgagcctgtaccctgccggagcatgaggcaagggacagggcatcgtctgtggggatagtgggggtagtgggggtagtggtcagccagatttggtgactctacttgctcaccagacgatcctacacctgccacctccgatggatccactgcctctgtgcctgcctgtactgctgatgctccagtggataactcagcatcccagcctaggcccaatgccactgaagatggaccttgccccctggggacccaggagtcctaccactcagctgtccccaggagtgcccagaccctcattcttatccaggacctaggagccctacccctggccttccctcatca

SEQ ID NO: 226783 - DNA, 423 bp, Homo sapiens
gctacatctatctttgtccgattggctcataaacaaagtggtcatgggcagcagcgaaggaagctatgcatgggctaagcaatgttcacttccactcatcaaagctgatctgacaactgccactgctgagtgcccaacctgctacctgagatggatactgagcccccaggaggaccagcttgtgacttggtagcaaaaactcgactgccatgaaacattgggctctaaaggagaaacaacaaaagatacaaagagactgtggtacattttctcgtttatattaatttaaagggaaattgtttcatatggttctgaaacactaacaatgcaattaattcaccagaaacagaaaaaaagtctttgtcttgctaccatactcaatcagattgaataaagaaatagaaggcaaatttgctaaagcaa

SEQ ID NO: 226784 - DNA, 448 bp, Homo sapiens
ccagctttattaatatgattgcattcctttactgtagcacctaacaccagtactcagttaaattttttgctgaataaatcaatgaatggagaggtaaagaggaaccagaagttggggttacagaagtcactgatggaagagtttcaagatagtagaagtggtcagccctgttaagtgacaagccaaggactgaagaaagactggcagatttggcaatcagatgaagtgacctgaccaaagagcagcttgtgtgaagtagtgaggacaggcgctggtctgcgactggtttaggaggaaatggaaatgaagaagaagagataggaaagtggagattatatgatgacaagtatcaagataaaaatgaacacatttggcctgctacctgaattttttaaatcggctcaccaaaaaatatcaggcttattgaaatattggaatatctgatgaa

SEQ ID NO: 226785 - DNA, 375 bp, Homo sapiens
caattgctttcagcagttgtttctgcagacaaacccccagtgcttgctctaggctggtgccaagggctgccgcctgaagcttgctgacagcccagctgctaacctccaggtcagagaaatgataccaacttcacaatcagagggaataagacagaagactcaggtgggcccacactgggctcaaccttttgcttcttgatttttcccctgtccttcctcatggttccagacctgattgttaagtactaccatgcctctcaaaagctgtctctcttaaccaggtctgataggacaaagctatctttcaagaagaactcaaaaactgtagaggggaataaaacaatttttaaaaataaagaaaaaagttgagtcaaa

SEQ ID NO: 226786 - DNA, 580 bp, Homo sapiens
  misc_feature (570)..(570): n is a, c, g, or t
ccggccctgagcagtccatctaaaacacaagcccaacctggttgttgccttgttttaaagcttcctgggactttcccatccctctatgggggttggggagggcaagctcttcagctggcaacgaagccttgcgtgttctagtgccttcttgcttgaccagtcccatttcctgcctcagtccacagcatcatactgcatttagttcggtgaatcccctgtgcattcttaaacctttccaccttgctggcaagtcagtctagaatccctttctcagcctcttgtttgctcgtggcctccagttctgtcttgaaaatcctgctgataacaccatctctttgaagccttcactgaacttccccttcctgacagagctaattactcactacccttttctgcttcggtatcttgattaggcttccattattacaagtagattatagtggggtaattacacatttaaccatctgatcacctactaggccctgagatccattcatctttttttttttttttttttttttgaggtggagtatcactccagccctggcgacagagtgagactctgtctcnccaaagacac

SEQ ID NO: 226787 - DNA, 444 bp, Homo sapiens
cagtctggagtgcaggggcatgatctcagctcactgcaacctctgcagttcaagcaattctcctgcctcagcctcccgggtggctgagattacaggcatctgccaccatgcccaactattttttgtatttttagtagagatggggtttcaccatgttgggcaggctagtcttgaactctgacctcaggtgatccacctgctttggcctcccaaagtgctgggattacaggcatgagccacaatgccaggcctatttaagctgattctttaaagatgagtagaaatgttttccaggtgaataaaaccttgagacattattccaagcagagaccagcaggtgcaaagacacagggatatagagatgttgaagtttaccaaacactgctagatttagaaaacaaaaaggaaacaatcaaaatcaaaaattaaaattaaaaatcacca

SEQ ID NO: 226788 - DNA, 473 bp, Homo sapiens
  misc_feature (131)..(131): n is a, c, g, or t
  misc_feature (152)..(152): n is a, c, g, or t
caggtttaaacatttttggcaagaatacttcataagtagtgttctatactttatattgcatcacttcaagagtatctggttgttccatgtttttgtggggggatcaaaaatttttgggaattttcaccttncctgggtttttaaaaaaaagnggggaaaagacaagcagaccaagtatggtggctcatgcctataattccaacattttggaaggcccaggcaggaaaatttcctgagcccagaccagcctaggcaatatagtgagactccgtctctacaaaaaatgtttttttttttgtttgtttgtttttaattagcttggtgtagtggcacatgcttgtaatcccagctacctgggacattgaggtgggaggatcgcttgagcccaggaagttgggggctgcagtgagctgtgatcatgtgccactgatctccagcctatgtgcctgtataacagagcgagtctctctctt

SEQ ID NO: 226789 - DNA, 432 bp, Homo sapiens
caggtttaaacatttttggcaagaatacttcataagtagtgttctatactttatattgcatcacttcaagagtatctggttgttccatgttttgtaattgattactctgttaaggaaaagacaagcagaccaagtatggtggctcatgcctataattccaacattttggaaggcccaggcaggaaaatttcctgagcccagaccagcctaggcaatatagtgagactccgtctctacaaaaaatgtttttttttttgtttgtttgtttttaattagcttggtgtagtggcacatgcttgtaatcccagctacctgggacattgaggtgggaggatcgcttgagcccaggaagttgggggctgcagtgagctgtgatcatgtgccactgatctccagcctatgtgcctgtataacagagcgagtctctctctt

SEQ ID NO: 226790 - DNA, 780 bp, Homo sapiens
gggctttagcgcgagctgggcggtcggcccggtcccaccgaactgcatagggccgtgtagccgggggaagtcagccccctgctctgagaagcagactctgcatctgtaaaaggctaagcgtgcccactggggcctgtggtcaggattggctgcagtgaggtccgcaaagcccctaccgcatcctgcgccttcgttagggtgagcagtcatggggactcgcattgtgccaccacgtagcgggtctcactgggtccgcttgtctgctcgaggagacagccggtgaggacgggagctggcctgctttgcccaggctgtaacctcagcctccgcccatacccacagtaagcatccattccattgatattcgctaaatgagtgaattattactaagacagagggccgagtggaagcgccataaatcacgtgagtgaatgtaattgttgtcgctgaccctatggagcacttcccttgccaggcactcacccatcctaggtatgtactttacatgtaattgtcatcttcatttgtcttcacaacaaccctgtgaggtgggtgctgtggttactcccattttacagataggtaactgaggcacacagagcattttgttcaaggacacactgccagtcaggggtaggagcagaatgagaacctatggagcttgctcttaggcaccctgccacactgctcactgtgggagagaagcagccaggcagacgtgtgcagcttggaattccttgcacacatggctgcggcaggtcaattaggtgccctggtgtg

SEQ ID NO: 226791 - DNA, 575 bp, Homo sapiens
gggctttagcgcgagctgggcggtcggcccggtcccaccgaactgcatagggccgtgtagccgggggaagtcagccccctgctctgagaagcagactctgcatctgtaaaaggctaagcgtgcccactggggcctgtggtcaggattggctgcagtgaggtccgcaaagcccctaccgcatcctgcgccttcgttagggtgagcagtcatggggactcgcattgtgccaccacgtagcgggtctcactgggtccgcttgtctgctcgaggagacagccggtgaggacgggagctggcctgctttgcccaggctgtaacctcagcctccgcccatacccacagagaaaaagtagtcataatacaaaagaaaaatggacaatgcttggataccataataaaaattaacactaccaacaaggagcatggacattgtgtggcttcagatgtaatgtgaaggacaacctccgttgaaaagggcaactgctgtagtattctaatctggaatgcatcacctaatcctatcataagaagacattaggaaaaaaaaaataaagataattccatttttttaatgg

SEQ ID NO: 226792 - DNA, 1364 bp, Homo sapiens
ctctgtttatttatttttattattacataatagatcttcttctgaatattcttcaaccaggaaaagggttagaaaccttggggacattacctcattgaaccctcaaaaccaagcatcgttggcttttttacaaatgaagcatgcttggtctagacagacaccaaataccatgctgtcatcctcactggtgtcctttgatactgtggtcagcagccgcacttgaccacaaggtttataggcccttaatgacctggccttgtgcacagccgacaaagcaccttctaattatttcattttgtgcagcaatggagaggtgcatgaagactccattccaaactccaaagctcagggactttcttccgaacagtctatactctgttgtagtattattcccttccatcgacgtctgtttatctgtaaacagcatgccagagatctggaggctcttttatgtctcaagtatgtaaatgtaaacacttgtcaacttttgacattgttcatttaagagtgtttttctcctgtaggaagaaagaaatacagctgggaagttgatgtccttattcacagagaagggtaccagttgtagttttcagaatctgtttttagcccatagtgggttttatctggttggttagaattaggtggaaggagggaagagcagccaagcactgagcagtggtcatgggcctgctggtgcaatgatttgggggtaagagaagaccatattgggaaggtctacgtgagaaagtcagagtaaaaaaattgaggaccctttttgcagaagtggaggcttccaaactcagtaataagtgtcttctagcccctgaatacacacaaagcaagaatactttgtgtttacccactgccccctgaccactgctgaaggcagaaagggacgatcacctacagtacctggtttgggtctttattctctcattccagggagagaaccttaactagatggactgactgactgttcattggctttggttgggtagattccctgcttccctctataagttgacgccaaaaaaggacaccgaccagcactgcagtcatagcaaatgtctcaaggagacccacagggtggtttcttcaaatacactactcacacacagcacatggagtcatggacaaacagcttaactgcccattgcctttgagaagtcctggaccaaaggccatagctcagccattgaaagatcttccttctgactgatatgtccctgcatagctccaacctgtgcaggcagaggatagggctgttccaaatgtcgctcacagagctgcctttgcctttctgcagatcccaagatacacacaaagcagttaacatgggtaaataggccttcctctgtaggaga

SEQ ID NO: 226793 - DNA, 4372 bp, Homo sapiens
  misc_feature (1337)..(1337): n is a, c, g, or t
  misc_feature (1609)..(1609): n is a, c, g, or t
aaacttggagagacgcaggacaggatcccggcggcagaaggacggagagaaaggggaccccgggacgggaaaggcgcagagcaggcgcgggcggcggcggcggcggggcagggcagggcgggcgtcccggcagagggcgcgcggtcgccctgtcgccctccgccccgccggggtcacagtgccccctccctcgcgccctagccgccctgccgggctatttttacgcgcggacaccggacaccggacaccgggctggggcggcggcggcggcggccgaggcggccgaggcggggccgcaccggggccgggcgtcggggccacacgtcggttcgcgggtcgccggggctgcgcgcgccatggagccgcggtgcccgccgccgtgcggctgctgcgagcggctggtgctcaacgtggccgggctgcgcttcgagacgcgggcgcgcacgctgggccgcttcccggacactctgctaggggacccagcgcgccgcggccgcttctacgacgacgcgcgccgcgagtatttcttcgaccggcaccggcccagcttcgacgccgtgctctactactaccagtccggtgggcggctgcggcggccggcgcacgtgccgctcgacgtcttcctggaagaggtggccttctacgggctgggcgcggcggccctggcacgcctgcgcgaggacgagggctgcccggtgccgcccgagcgccccctgccccgccgcgccttcgcccgccagctgtggctgcttttcgagtttcccgagagctctcaggccgcgcgcgtgctcgccgtagtctccgtgctggtcatcctcgtctccatcgtcgtcttctgcctcgagacgctgcctgacttccgcgacgaccgcgacggcacggggcttgctgctgcagccgcagccggcccgttccccgctccgctgaatggctccagccaaatgcctggaaatccaccccgcctgcccttcaatgacccgttcttcgtggtggagacgctgtgtatttgttggttctcctttgagctgctggtacgcctcctggtctgtccaagcaaggctatcttcttcaagaacgtgatgaacctcatcgattttgtggctatccttccctactttgtggcactgggcaccgagctggcccggcagcgaggggtgggccagcaggccatgtcactggccatcctgagagtcatccgattggtgcgtgtcttccgcatcttcaagctgtcccggcactcaaagggcctgcaaatcttgggccagacgcttcgggcctccatgcgtgagctgggcctcctcatctttttcctcttcatcggtgtggtcctcttttcnagcgccgtctactttgccgaagttgaccgggtggactcccatttcactagcatccctgagtccttctggtgggcggtagtcaccatgactacagttggctatggagacatggcacccgtcactgtgggtggcaagatagtgggctctctgtgtgccattgcgggcgtgctgactatttccctgccagtgcccgtcattgtctccaatttcagctacttttatcaccgggagacagagggcgaagaggctgggatgttcagccatgtggacangcagccttgtggcccactggagggcaaggccaatggggggctggtggacggggaggtacctgagctaccacctccactctgggcacccccagggaaacacctggtcaccgaagtgtgaggaacagttgaggtctgcaggacctcacacctccctagagggagggagggagggcagggtggagggcaaggctggggggaggggattgggtttaggaagagctaggttaagtcataacgagtggggaaacactgagtcttgttgggtcttgggttgtgtggtttggtagctcctgtgggtacctcctgaagcagcagcgaatggcaatgggttgtgttgtgttaatgaagactcaattggttcatattactctgagttgtgcaaagctcatggagccttttggggtagtgttgagataggtttggtcgtatcattttgtgagtttcctaggtcagtgttgggtttggttgggttgtgagtctgggatagtgtggtccagctgcattgtgtaggattctgtggtttggtgggtcccctagggccatgttgggtcaagttagatggtcccccatggcattgttgagatcgaatgtgtgtggtgttaagtttcgttgagacatggtggaaattgtgtagctctgtgattcttccaggggcatgttattttaggttctgtgaacttgcgagtcatgtagaaatgtgaagagtccagtggtagaatttgagctttctaggtcacattgggttaagtttgtatgaccaaatgaatcttgtagggttctgttgggcttaactgtgtagaggtgtgtggctggacatttttcgtggccacagcgagttgagttgtgttgaattgtacaaccatatgagccttgtaaggccagttcagttgggtcatgccactgtttgagtctcatagggccatgctgaattgagttccattgagttgtgtcactatgtgagtcctacaggaagttgggttgagttggactgtgcgaacgagttccatagggccacatcgggctgttttgcatttagtggtagcaccaggacccaaaggaaatagcagtggggaagcatcatgtatctgggagcatgcagtggcgagggctctgggaggtgtgccgagctggctccccagctcgctgtagggggcgggactggattctgtatccatgggattgggtgttcatccagaggcgactgggtaaattaggaagaggtggatgctcctcctgtttaccccacatccacttcattgtgctgttcactcccattctcccctacagttttatgctcagacatggaggtcagagccacaagggaaaggggagagggggagaaaactgtactctgtccagacatgatagagggacagagccaaaaggatagagaaagagacccagaaaaaggaagaggtggaaacccagagagacagagacccaaagggagagaaacagagactcagggagagggagacaatgacctggagggtggggtatggcagagacgcagaagagaggaacagaaatccagagtggggagacagagaccaagagcaggggatagaagccgggcgaagtggcccatgcctgtaatctcagcactctgggagaccgaggaagggggattgattgaggccaggagttcaagaccagcctgggcaacatggtgagaccccatctctacaaaaaatacaaaaattagctgagtgtggtggcacatgcctgtgatcccagctactcaggaagctgaggcagaaagatcccttgaccctgagaggtagaggctgcattgagccatgattgcaccactgcactccagcctgggcaacagagggagcccccgtctcaacaaacaaacaaaaagagccagtgggggagggagggacagagacccagagggcagcgtcagacacccagagttggagacagaacaacagagtctcagggaaagagaaccacaatagaaaaaggcagaaaaggccgggcgcggtggctcatgcctgtaaccccagcactttgggaggccgaggtgggcaaattacgaggtcaggagatccagaccatcctggctaacacggtgaaaccccgtctctactaaaaatacaaaaaaattagccgggtgcggtggcgggcacctgtagtcccagctactcgggaggctgaggcaggagaatggcatgaacctgggaggcggagcttgcagtgagccgagattgcgccactgcactccagcctgggcagcagagcaacactctgtctcaaaaaaaaaaagaaaagaaaagaaaaagccagaaaaagttggtgcccctgaacccaagagtgatgtacagtctattccatagaatcacagaacaatcctgaaccaggcctgtcacctaccctccctgcagctcaggaaggctgtcagacaggctgggggcctcactctgttttccaggggagaaacctgagtctcagagcaggggagtggcttcccaaggtctcacagcttgtccccaggggccaggcaggctgtctgtctgcttcacatgtccccatcagcctgctgggacacacgggtcctcctgagtcccgtagcctcatttcttacagacggggaaactgaggctcagagcagcaggtgttacccaaggtcacaaggccgaacattttcagaaatctttcagaactcaaagggcatttagaggaagaaggctgaaatcactaacacatatagggcttcctttggtatcaaagtactttacttgggttaatttatta

SEQ ID NO: 226794 - DNA, 431 bp, Homo sapiens
gtcctgccacaacaaagaatgatccagccccaaacatgagcagtgtcaaaggtggagaaatcccaggttaaactctgtggctttttctttccttattttcagcgaggttgcacatccgttctgtatttgggggtatcatcatttgatgcaattatctggctggttttggaggaaagagggaggtggcaagccagagccagcagtcatctggtgccagggctaaagagcatctccttctccctttccttggtctcaaaggacccttgtctttgttgcaatccctgtgctgtggggtgtcacatctgttgacagaagtaccatttatacagaagccgcagtggggttggtccacaatgggttaaccaccacagggccctctgcccaccagagctgtttactgttcaccaaagaggctgattcttaggactcta

SEQ ID NO: 226795 - DNA, 374 bp, Homo sapiens
tccctcggaggcctgtctcagcatttcctaagtcagcataattgcactagttgcttgtaggacccctagttccattagagaaaaaaaccctcaaaagttcttagtgaaagttcttagcacctcagtttgaatgtcaaggatcatcgccctgaggttttgtcagttagcctgtgataaagcagcaaaaatcaggacactgcccagccctgcagagtgaccatgtggaaaccaacagttgtccccatggttttacaaatgagatgactgaggcccagaaagaggaagtgacacttgccggtggtcaaatagctcagcccaccacctgtttttatatggtttgcaagctacgaatggcctttatttttgaagtggtt

SEQ ID NO: 226796 - DNA, 276 bp, Homo sapiens
caggagctgagatcgtgccactgcacttcagcctgggctacagagtgagactccgtctcaaataaataaattaatttaattaaattaaaagtctacctgtgaaccatctaaaatcatctctgcatgccacggtttggaaaacaccaatttagagaagaaataacaatgatcatgatagctaattctgacatgctacttcatttgtatcaacccattgagtcctggcaattactgctggacaaggcagacagaattattataaaacctgggtttccc

SEQ ID NO: 226797 - DNA, 612 bp, Homo sapiens
aaaacagaaacagctgaaaacctaaagaaacccacagagaaagcagattttaataagctaagtgttatcctatacaaagcatgacatttttctcattactagtcttgcattacaaaatttttacttaattatatttttaatttcatgaataaacattttgtgaacagtttctctcttcttacataagttcacaagtaatacccttgagtttgcttcctgcaaatactaaaatttattcatatttatatgaatatttacagaaatatgttttcatatttacagaaaaagtttgttgacttctcttctaggaataacttattttctgagttgattcctaggatattaaattgggttattcaatagtttctccatgtattcaacaaatatttattgaatatcatctatgcataaggaagctaccatgggaatccctttaaaaatatagatataaataatatatggttcttgtttttaagaagcttaaaattaaatgaaaaagatgagaccaggtgtggtggctcatccctgtaaccccagcactttggtagaggctaaggtgggaggattacttgagcccaggagtttgagaccagtctgggtgacacagtgaaa

SEQ ID NO: 226798 - DNA, 510 bp, Homo sapiens
agcccagccctcctcaggtcacttaaccacaccatcttagggagcccagcccactctcagcctaaagccatcagtgaaagtgcaaactcagggactgcagtcagttagactcaacagctctcatcccccaggtcctgtccacaggctcagcgcgctatgtcctgccctgcccacgctggggtcaagaaaggaagttttgctcatcttccaaggcccagctcagccgcccccttctccagaggcttcctccttctccaaggacagatctgctacttatttgcctcttcccacaatacttttttgaaaatcttttccacagagagccccagggatccactcgctggcctcaaggatttgtgaattcctaaaatgttgtgtggattttcgtatatgagcatctgtatgtttttatctaaggagaaaacaacggatagctttatcaggttcttaaagaggtctatgtcctaaaaacatttaatataaatatgaatatgactctactacagtata

SEQ ID NO: 226799 - DNA, 674 bp, Homo sapiens
attcaaaagcagttcatccatcctcggtatttacatacagctttaaatatgtagatttttttgaattatgcattttggtattctatcattttataaagggctgccagcaatttacaaaaaaaaaaacatggtctacattgagttctgttttgatctgccctctccatcagagtgtttttaaatgcttgtatcatgaattaaacatagaacaatctcattcatttaaataaaatccgcctactgagggccatatgcatggtttgggtcaaatctgtggaagcgtcattgtggagaagaatgccctctggccatgtcttttctgtttcaattgtccaaggtctaagaatgaacaccaaagaggaaggaacacatcaatctgagtcaccaacacttcaaagatggtctttctcaaaagaccaatacactgcaggctttcatcacatataaactgacttaaggaatttcctaaaggaggtagactttatgtagaattgcttttttttttttttgaggatttaatggtagaaggacttctttgtaaatataaaaataattatttaacattcatgatgatgacttacgtagtaacaattttattccaatcattatgctaagtgctttacataatttattttaaaaaccatataagatagttatgatcattattcttcatg

SEQ ID NO: 226800 - DNA, 313 bp, Homo sapiens
gagaggtacatggaagagtcgctgctgtttcatgaataaaaacaggtcattacactgtctttggaatccctatgtaattattttatgtcttgttgtaacctactggttgacagaaataaaggaatcaaaagagtgtcttttcagaatcattctaatttgttcatagttttgggaaatattccacaaagataaactggccatggtgccatattgtgcaactaattaatatcggtcaagggggggttgtttgtttcattgacaatagcactggtaaattaaaagtaataaattcagttgaaaaccacgtgtaatt

SEQ ID NO: 226801 - DNA, 337 bp, Homo sapiens
aatcaaccccacaccacactaaaagcctagcagatgcagaagcagactcacatccagacataagaattatttgccacaatctctactgttctgcatataaagtctgccattcagtcaaaaattacaagacaaaaaagctgaggaggaaaaaaccctctttatcaagagacaacaacaaacagaaccagataaagcaattaacagaattatcagagaagaaaattaaaataactatgattacccttttaaaggctctagcacaaaggtaggaacatgcatcaactcatgagaaatttcaggagagatgaaaatggaaatgcaaaaaataaaaaacagt

SEQ ID NO: 226802 - DNA, 2210 bp, Homo sapiens
  misc_feature (1044)..(1044): n is a, c, g, or t
  misc_feature (1287)..(1287): n is a, c, g, or t
  misc_feature (1592)..(1592): n is a, c, g, or t
  misc_feature (1950)..(1950): n is a, c, g, or t
taattaaaagtaaaatagtacttcacaataatagtgatcctccaaaagaattcagctcaatgaaaaaacaagacagagacagcttcctaacagactgcatatctcaaaaataagctaaaaggaaacaattaaatcaaaactttgggcctaaataataacataaatcaccacataaagtacattattattatttttaaaaacgttccataccaagattgctaataatctgagtggtatgttttaaagatcattctcaccaagagagatttggagaagggagagaacataatctttggtgctttgcctcttactattttgccaaaattaggagtaccttatcaatagtatagcaacatttcggccactaggtggcaggttaaaaaaaaaaaaaaaaaaagctaaaacagcaaaagctaagcatatgggtgcacagtaagttgctaaacgaagagatcagaggtaccaaaggcccaattcttccaaatctacaaatgccaagaagtgtgatgaaacaagaacatcaaagtaggactgaccttgccaaggttaggtctgaaaacagtcacttctcatcactaacagcattctaagaaaaattgacatttgaatagtgggtgattcatactataacctcaaggaatagatcaaggatgagtctggggaagaaggactactggatgaagaaataaaatctcacttcttgagtttagtggaagaaaatatccaaagatacagggaagccacccacccaaccatcctcatattccacaactatatctcaaaaatactaccccctctgtacagaagtacagagaattaacaacggagcagtccccaatacacacaaaaaagctgaagctaccttccaagaatgtgcaccaaactctaacaaaggtaatcaaattgtaacatcatgaagacatgaccagattacaataaacggcctgataaaagaatatgttaataataataggatcacctgcatgctagttataaagaatggccagtttggcattctgaatcaagtatatggaaagaaaatgncccatcccataaacatggatatcagattcagaaagccattaagtcttaaaatgaagacaaatgtattaatgcatcacagtctgatgacacagtctgattaacatgatttaactaatccctctgggctctgattccaagctcaacagacaaccttattataaattgtcttgtcttatatacgaaagcaatgtttttcaacttctctgcaacctaactaaagagttcagtatactcccaacagtnaacagtgattcactagggtgatgacttttaactatgaggcatcccacatatttgaacctccaagggattgttattttaaaaagcacccgaatccttgagattctttcttgtgtgtacaaattatggaatacatgagaaattttgtacatgtatataatatgcagtaatcgaatcattcagggtgtccatcacctgagtacaatgtatttttccattctaccttgctataaaacactgaattatttcttcaagcttcctgtatatctgtacactttaactcactcctcttcatcttcccctcctcntacccttcccagttattgttatctatttttccacactctatctccatgtgttcaaactgtttagctctcagacattcttatgacttccttccactggttgagaattacgaaccaaataaagaataaactgatctaaattcaattaccttaatgattacatttctttctgcaaattaaaatttttggcattttggttttatatgtcagtttctgtgcccttggttaatgtgaggcatgctgagagtcaaatgacaaatatgtcaacggaccttaaatggaggtcacctagtccaataccctgtttaagaataccctctattttccaacattggtttaatctggttagtttctgtctacnacctgaggataactgcactgacagctgaccccagaaataaaaggaaaaagagttgcttttagaactccagtctctccttcaaaagctaagcaaacttgagtaggtacttcagcgaaaagctacattaaaaatgcagtgagagaagacagatggctcagaggaaaatgggcaaaaggacccaagtgggcactttgcaaaaatcaaaatgactaataaacatatgaaaaggaacacagcctcattagccagcggggaaatac

SEQ ID NO: 226803 - DNA, 254 bp, Homo sapiens
ctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaaggtgtccaatgaaaggctgttggaaaaatgccttcgtgatttttgtgtgctgagacatggctgagggtgggctggattccatgaggtga

SEQ ID NO: 226804 - DNA, 594 bp, Homo sapiens
cgcggtggctcacacctgtaatcccagcactttgggaggccgagacgggcagatcatctgaggtcaagagttcaagaccagcctggccaacgtggtgaaacctcgtctctactaaaaatgcaaaaaataaaaacaaaaaaatttagctgggcgtggtggcatgcgcctgtagtcccagctacttggggagactgaggcaggagaatcacttgaacccaagatgcagttgcagtgagccaagattgtgccactgcactccagcttgggtgacagcgggagactccatctcaaaaaaaaaaaaaaaagagtgaagaaaacgatacaaaaatcaaaaacaagtcacgcacgatggctcacacctgtaatcctggagctttggaaggctgacatgggaggagggtttgaggaaacgagcttgagaccagcttgggcaacacagcaaggccccatttccacaaaaaataaaaaaattagctaggcacagtcgttcgtgcctatactcctagctacttgggctgtggcagaattctacccatcacccaggagactgaagttacaacgagctatgattgtgtcactgcacttcagcctggg

SEQ ID NO: 226805 - DNA, 344 bp, Homo sapiens
taatatttgttcagatcattcatcttgaatatatctcaacaccttatgacagaaacaaggaataattaagacctttataaaaactgcccaagcagattaatttagacatttgacattctattttccatacccaaatgtgagtatttttcaggctatatatttcagtggccttcacgtatgcagcataattatttggaaaagcatttggtttttacagacttttaggtcaccatggtagtttggaactgtagtaaatcagagagattaagacatttaattatttctataggaactctatattgtataacaacattattttttcatgactatttcatatataatcc

SEQ ID NO: 226806 - DNA, 447 bp, Homo sapiens
atgtagtatctttgggtgacattttctttctttcagcacttattttcctattatatcctggcctataaggtttctgctgagaagtctgctgttagtctgatggtggtggggggaggcctctctgtaggtgactggatacttttctcttagtgttttagaattttctctctgttattgactttagacagttggactataatgtgctgtggaaacctttttgcattggggaacactgggcctcctgcatctgaatgtctgaatctcttgctagacttgggaagttttcatctgctattttgataaataggtttttcatcccttttgttctcatctcacctttggggataccagtaattcatatatttggttgcttgtagtatcccatatatcacaaagactttgttcattcttttttttttctttctttatttttgtctggttagtttt

SEQ ID NO: 226807 - DNA, 329 bp, Homo sapiens
atagtagaagtctgctggccatgaattctctcattttgttctttaatctgaacaaatttttttttttcttttgaagcacatggttgctggatgttgaattctgggtgatagctggtggtgtctgcccctctcccttcaaaggtgttccattgtcaactggccttcattctttctaataagttgttagccatcatttgtatctttattaccttgtttgtaatgtttctctttttttttttttgggttgatttttttttctctttgatactgattttttagaggattgataatgatcctaggtataatttacttggtatttatacttctcg

SEQ ID NO: 226808 - DNA, 437 bp, Homo sapiens
ccgtgttctggagccttgggtgcagacccggggccagggccaccccagtcacgccagcgagaagccctgatgacaagcttttgggcagagccacatccacgccggctggcaactttgagcatgacccctgtgccaggcactgctgcaggccacacatgcagcttctccctgagtcctcgcagagccctggggtgggggctgctggctggatgccctcagaggctcaaaaggatgaccccaaccaaggtcacacggctaactatcaagacaggattctaaccccagtccatacagtccagagcccaagctttaaaccatcgcacggcgagggtgctgccccctccccaaccatgctccgtgtgcctctcccacccccattacccttgacctcagcccacgatgctttggtaaaagctgagagttgctctttttttctt

SEQ ID NO: 226809 - DNA, 636 bp, Homo sapiens
ggttgtagtgagttgagattgcgccactgcactccatccagcctgagcaacaagagtgaaactctgtgtcaaaaaaacaaacaaatgaacaaacaaaatttaaggcaaagaaaagttaaggacattgcctgaacttacatagctagtaaatggtggagctgggattttatcctggcaaggctggcttcaatacctatgcttttatccagagttactgcttttagctcagagaaagatttgacatatggtattgtcatagttcaaaaccatgactagtcttgtgttgggagactctaagataaatggtaagaatgtagtcttttaaaatggttaatgtttatttcagggttttttctactgaagttatatcaacactacttctttaaggttaatgagacgtttaactgaatatactaatttttcgtatctttgtgaaaagttagtcattggttaaaaaaattatgtcagaaactagtctaggcactaggaatacagtaagcaaaacagcaaaaaaaaaaaatctcagagtcagtgagcttatgctatagtgggaggaggagcagaaaaataacaagtaaaatacaggtgataataagtgctgtgaggagaataaacagaaggatagaaagtgctagg

SEQ ID NO: 226810 - DNA, 586 bp, Homo sapiens
cactgtgttagcaaggatggtctggatctcctgacctcgtgatccacccgcctcggcctcccaaaatgctgggattacaggcgtgagccaccgcacccggcccaacatttttttttacatgaaagacatctagagacaatatcacagtaaaaattaatgaatcatacaagatccttggtttaaatttctttcatttgactattataccaacgtcccctgtgaaggtacacaattcatattagcatttaaaattgtttttaaagtcctataatttaaaaaacccctttttcatggaatttcctgaactattttgatttgaagatgtatctatcatgccaacttttctggaacacagtgaagtagattctatatatatatatatttttcctatatgagttattgaaaattgtatatataaatacaaatgtgtattttattgtggtaaaatatacatgacataaatgtaacattttaacaatttttaatgtaagcttctatggtattaggtacattcccattgtcgtacaaccattaccaccatccatctccagaactttttcattcccaaactgaatctccaccccca

SEQ ID NO: 226811 - DNA, 352 bp, Homo sapiens
gcacgtccccaaagaacgccaacagtgcagcacaggctgtacctgggaatgactgtaggcttcaagggcaagtcattgaaatcaactccccttgtccctccctcaacaacacacaagatgaaactcaatggtgggggacagcagcctctccacggctaaggggctgggggctcagtcctgccctgcacctcccttgggtcagggctgcctgtggccagcacacttcttgcccccccagctccagctctttcaggacggtctcctaccacatccctggcacagaccctggacagggaggctcactacagacctgaagaggctcaagctgccaaccccacagtgggcacctgcc

SEQ ID NO: 226812 - DNA, 438 bp, Homo sapiens
cacctgctccaaacagtctcttcatttcagaagccttcagttctactcctttttccatcactgttaatggattaaccttgtcttaatttgatgcaaggactgataacctctctgacgtgaccttgcctcctttgcagctgtccccagaccaccttgcatctcagaattgctttctaactcttttcatcattttcttattccctactcttggaagactctcctttacaaggggtgtccctgctattttcctagacctgtttccttagttttctccaagatttcattttgtcagttatctttttattagaccttctttatttttttctagcttgtttccctctgtgtaagcatgctcagatactctgatttttccccctaactcatggcccctctttgaacaaccacgtttttcctcattttcatttcatcttaaagcct

SEQ ID NO: 226813 - DNA, 340 bp, Homo sapiens
gtaagtagtttggtaatttgctgttataaattgattagagtagcagttctatagccaatctgataggtttagacattataggtaatattccatcccttctatgtatgaccaagagcttaccatttaatctagtgcccgaaaaaggctttacaaagttcatggtctgttgaggaactttgtccctttgagccttgacttttattagaaatattctatatgaggctgggcacggtagctcgtgcctgtaatcccagcactttgggaggctgaggcaggcagattgctcgtgctcaggagttctagaccagcctgagcaaaatggtgaaactccatctctaca

SEQ ID NO: 226814 - DNA, 481 bp, Homo sapiens
ccagaaggtggaagcaacatcatgcccactggtggatgaatggataaacaaatgtgatatatgcacgcaatggaatattattggaatattattcctttttaaaggaaggagattctgacacatttcacaatgtggatgaacaatgaaaccttgaatacattatgctaatggaaataagccaaacacaaaaagacaaatactgtatgattccacttatatgaggtacctaagataggcaaagtcatagaggcagaaagtagaatggtggttaatagggactggaagatgacaggagttaggaattactgttttacaggtacagagcttcacatgaaaaagttctagagaggaatggtgggaatcattacaaaacatgaatatagttaaagcaactgaattgtacacttaaaatcgttaatgtgatacattttatgttacatgtattttgcccactgaaaaaaataaaaatatataaacacac

SEQ ID NO: 226815 - DNA, 483 bp, Homo sapiens
agaagtgttgcttttcatttgttcttaagacactgctctcgggcaccagatacaccaaccgagcgattctcagaacccctagcatgggccacaaaccaaacacgcagagccgcagcgaggacagagggtgccgcgtggcccttcctgacattctttcatctgcacactgtaccgtcaactcattttctgcacggaatgaagatacatcactctgctctggaaaactacatttagcatctccttctttttgtggggcagggaagttttcatcgacaaagcgtttgtattgcagatggctcaccatatgccacgttcctgcacgttatcaccttgtaagcagattctgtcaggttttaggagtaaaagcttaattaacaagtggtgtgtacaattatgtacttaattatctactgcttttatttctttgttgtttcttgttttccaaaagtttggtaacaattacaggcaactgttgcctaatgc

SEQ ID NO: 226816 - DNA, 500 bp, Homo sapiens
cactgacttaacacgtttctgagattttattaagggcttttatagtgtaccctcagcttttaagagttgttttctgggaggaattcatgatctatcataggtaagtattaaactagaaaaagtatgcattccaaaattactttttttctgaacaagaatgagaatatggctttaattgtgttcaaaattgttgcatttcatgagcttgcatttgctaagatggattaatttatgatatctttgagaagttcatgaaaacctgacaaatgtccacgtcaacttatgctttatataagttagcttgtgtgttcagtcactttttttgtgaagcagtgtaaccatactagtaataatttatgtgaaaagcatctcactctttcatgaccgcaaagttcctgcaggattttcttatgatcaaatattttacattgtaaaaatttttcgatacactgaaacctaaatatcctataggacaaatgaaacagtctgattagaaatgt

SEQ ID NO: 226817 - DNA, 292 bp, Homo sapiens
ctccactattgtcctatgaccctgccaaatccccctctgcgagaaacacccaagaatgatcaattaaaaaaaaaaaacaaaaaaaaaaacaagccaaggcaggggcccacagctctctgtgacccacctgggcagacctggcccgtgatagaaggagagggtgatggtatgagactcaaacccctgggcttgggcactacgtatccttggacaagtcacacacctctatgaattccctttgctcaagcatatgatgcagttgcttaattaaactcttgtgaggaccaagaga

SEQ ID NO: 226818 - DNA, 195 bp, Homo sapiens
tcttcctttagtctgtctgcctgtttgtgaactattaacacgctgtcttatttgttgagggtttagattatattttactgtctaacagggttagtcccttcagttttctttatttcctcctctgagctttttttttatggttagttttctatgtgaatttaagaattgtctcaaaattgtctaggtctcattcca

SEQ ID NO: 226819 - DNA, 316 bp, Homo sapiens
taggacctcaatggggccttcccaccttcctctcaggaatgccttgcaggaggccaaggagccattttccaaaaggcaagaagtaccaagtaacctggaacaacctgctgggtttctgagggcgagaagctccttccgctaccgtagcaaagccatttggtttaaaatcctcataaaagcaacaatgctcatttcctatattgggttgtatttcctaattaccatcccagagggaaacctagggagaaggaaggcagagaagccagcctcacagccttcatttgtgcatttaaataaagtgtgattaaaaagcaca

SEQ ID NO: 226820 - DNA, 773 bp, Homo sapiens
caggatttgaactccagcagtgcggcaccagaggccctactcctaaccactctgcgattctgcctttgtcatggtttggggtcagaagttctgatgtggaatgttgacccaggcactgtgtgactgcacctctatgaatgttcctttcttctttagtaaaataggggtactaatggctaccttgtgacattgttgtgaagattaaatataatatgtgtcaagagtctggtgaccagaaaatactcaatgaaaggtaactttagtgtttttagtggtggttccatggcccgctggatcccaacttctgcatcccgacagggaagggctgctgagctataactgttactgtccagagaggcgatggaggcaaggaactgtgtaagggccagcaggacacagctgttctctcacactatctatagcagaggacacttccctgcccacattcatcaatcccgcccattcgtcgatcctgctcatgctttcagcttcccactacagagtcttgtgtctatgccagagcgcttctccaaccatgggaagttgtttggggtaagcaggaagaagagagtggtgaaaatccccaggagttgatggataaatatcccagtcccctgcctgtctccctaaggcccccagtagaattgagccccagttgctcatagcagtaacctgctcccgaacacactccatactgattgccttctcttccctgtctcacttccccactgcccttctgagatcacctcccaaataaactacttgcactcaaa

SEQ ID NO: 226821 - DNA, 446 bp, Homo sapiens
ttgaaattatgtatccataatagatacataaagacctataggataagttgcaaacatagcgtatttgattgtatatcagttgtatgagtctatgaaacacttctgggtattaccagaatcaattttgtgagaaataatatatatatataatttaaaaaattatttgtatggaatttccacttgttcggtagaaatattattttattcattgattattttattcattttattgtattcattatattttattcattatattattttattttattcattatattattttattcatttattattttattcattgatatttagtgtaaaagtgggccttgtggcatgtacctgtagtcccagctactccggctgaggctggaggatccctagagcccctgtgtttgagaccagccttgacaacatagtgaaaccctgtgtctacccgaaaa

SEQ ID NO: 226822 - DNA, 465 bp, Homo sapiens
agactgcagcaaaagattatttaacatactttcttcccttttatggaaaagagagctgttctcctttttgaaccatattcccctaaataccctcacaatcttcttaggcctctcactccttcattttcttttctagccccttcatctcatccttattttgaattcagatgagttaatacagtttgatggcctagttcagattctagaaagggacagctgttcagagatgatagtgacatgcttttctcttctcacattgcttctctttaaagaatttacaggacttctgcctacatttacatctgaaaacaatagtttcatttggtgtcacatccttgcccaaatttattgagaatattggtaaaggacaacatatttacaaggatttctttattaaaaactggggagattggcaagtgacactgttgctaaataaataaaaataaaaactgagaaaagcaataa

SEQ ID NO: 226823 - DNA, 537 bp, Homo sapiens
ggggaggcgcggccagggctgcgcgctccgcggagccggcggggccgggaacaggtgatcccagtgggagccccgcgccctgccgagttcgaggggcgggagcccgcgctcccgggcgcatctgcagccgcccagccgcggctccggacccaggcatccctgcgctgtctggggcccgggggaagccccctgcccccgcaggctcggaagtgcctgctcctgctccctggccactccggctcccagctcccggcgccctctccgcggcggagaaagttgtggacgtgtcccgatagtcgagcccgggcgctgtcgcgaccgggccgggtgtgcgcgcgctcggggcggcgctgacacgccagccccccatcgcctcggtcccctccggaaactgcttctgaagctgaaactttgggcgcctaccagcgcgggcgggagcctagggggcggagggcggcttggtgcgggcctgcgggcgcccctcggcgcggacagccgggacgccgcggacggcatgtgacggtcccggcggccgca

SEQ ID NO: 226824 - DNA, 385 bp, Homo sapiens
taggacttttggtttgatgctggaaccagttaagactttggggaactattaagaggggatgattatattttcgatgtgataagacatgagatttgggaggccaggacagaattatatagtttggaaatttatcccctcaaaacctcatgttaaaatgtagtccccagtgttggagttggaacctggtgaggggtgtttggatcatggaggtggatccttcattaattacttggcccatcctcatggtaatgagtgacttcttatgagatcttgtttaaaagagcctagaacgtccttccctctctcatccatttttcaccatgtgacattcctgctccccctttgtctttcaccatgattgcaagcttcccaagaccctgtctca

SEQ ID NO: 226825 - DNA, 373 bp, Homo sapiens
ctgccctagacctctgtttttctcatatgaaaaatggatacaaaatgtgtcgtcatcctatcaaacatcaatgcctcaaatccaagctccactacttaacagccctgtgatcttgggcaaggtttacctggctgtgcctcaacatccttatttgtaaatgggtatcataatagtggcaaccttgcggggttgttgaaccattaatgtgtgaacgtatgtaaagcgctcataagaatatctaggacactgtgaacgccatatgagtgatagatattattatcagcctttatcacagagctgtactgcagtttaaataaaggaagaggtgtgaccagggtttgcaaactctgaagtcccctctggagaggtaagc

SEQ ID NO: 226826 - DNA, 322 bp, Homo sapiens
cacatagtactcaatcagctgatgtaccaatcaactttgctatgccatggaatcactgcccccctcgtggccccaaaccagctgacataatatagaaagggagaagcagttgtcttaaaagaaactgctgcactgtcaggattgaaagaattatggcagacaggctgtgcactaaagcccacagggagcagtcaagggcagtggtggcccagtgttgtcaggtggtagagaccagtgtagggaagcagcagtggcgggcggattacctgaggtcaggagttcaagaccagcctggccaacatagtaaaaccccgtctctact

SEQ ID NO: 226827 - DNA, 411 bp, Homo sapiens
cgggactgttacggtggcctgggccgcgctgaggcccacagtcctgagcacttctccccttcggctgcagggtgctatcatggtcacttcctgtgtccggatgctggtgggcttctcaggcctgactggctttctcatgggtttcatctgctccttggccgttgctccaactaactgcctagtggccctgcccctcttggattctgcaggcaataatgccgggatccagtgggggatttctgccatgtaagtgctccctggggagggagtgccatgtacgttctctttggtggagagtcacccagaaagaataatggagggcctggatattggtaaactcttgtggtttacaaagactttcatgaatgttatcaaaccttaaaaagcatcaaagttgttacccataattca

SEQ ID NO: 226828 - DNA, 423 bp, Homo sapiens
tgaaattgaataagtttcaaatacgaaaatttaggaacatgatacaaaacttttctctgtgcaccactggagtactgcttttgaaatcaattctctctgtcctggattacccttagagctcctgtctcctgcatggaggagggtggagggcatttaacatgtccatctctcaccccattctacctgagcttccagcaccaccacctctgggcagttccgcttttagtcagcagctcccagttcccataattttgacttctgtccttgctagtccagaagaaatggctcttctgggattgaattcctccctttccccagcagaaatggattggggcagaggaattgcggactccatggcatagagggtcctggaaggcttgtcattagggtatcagggtgggaaggggagtgaagggaggggaa

SEQ ID NO: 226829 - DNA, 422 bp, Homo sapiens
atgagattgagaccatcctggccagcatggtgaaaccctgtctttactaaaaatacaaaaattagctgggtgtggtggcacacgcctgtagtcccagctactcaggaggctgaggtaggagaatcgcttgaacccaggaggcagaagttgcagtgagccgaatttttgcaatcagatcttggcgatgaccttgagcagtaggatataaataactcccacatgcttagtgttccaataatggaacactaggcataaatgttaaacacaaaacaaaacaaaaaaacaagaaacattaaaaattataaataaaatttaaagactaataaaaaactaggataaataatgttgcattaactggacaaagtatatccttaatagaaagaaagtttattaaaattgattagaaaggcaaccactactac

SEQ ID NO: 226830 - DNA, 741 bp, Homo sapiens
ttaggcttctgtgccattgtgctggcttatccagtgacacagggagccacagtcagattccacagcacagggcagaggctgctcgatgctgcagaagactcttcaaaagggccttcggttctagtcctagactgaccactaaccccggaaggggacaaacatgtcccctccctgggcctcagtttcctcttacttaccctaataggattggactggtgatcttaggtccttccactcctgcaacagtgattctagaattggttgactggtattttgaagaaagtaccagacaagctcattggcaggttatatctgttggtatctacctcttgacccattccatctgctatctgagatcagtcaggcaagtcagaaagcagttagcaccaccagaggctttggataaggcaccgtgggggttgaaagggggaatttgcttctagcccgattctgtagtgttagccccatgatggattccggctacatctgtacctaaacactctctctgctcttgttcagaattagtgttcctcttatctctcatatctcattgcctttggccaactcagggacttagctccagcagatgtctgccacctcctacgtcactggctccacgctctctcctgggtcatttcagcacatgcacacacacacacacacacacacacactcactcactcactcatacagacctacaccaccacaccctgtgtacattacctccccacggctctgctc

SEQ ID NO: 226831 - DNA, 596 bp, Homo sapiens
ttagtctctaatagtgagtctaataagtctcaccaattcacacacaaagattctaacacatgtacatatgcatttgtacagaatgtaattagatactatagtaacaaatcaaaggtaatggacaaaacttagtaatttcaattaaagctttctattcggggcttctcctgaatgtgtgttttaaatgactaggacattaaagggattgtttcagaagaactatcagcaccttttttatgtgtcatgttcatccagactatccatccagataattgctttatttctgatatgtcttccaaggttgttaccccgtgtgggataggcaatgaatttaactgtcttttgtccctaaaagttttataagtttttatctaacatattcatgtagtggaaaaaaactcacaaaagtgctttcaagcattcacagtggtgtctaagccactattaattgaaaaagctgctgtatttaaaaaaactgctagttcctgtgaaccaagatcatgccactgcactccagcctgggccaaaagtgcgagactccgtctccaaaaacaaacaaacaaacaaacaaacaaaaactgctagttcctttaaaa

SEQ ID NO: 226832 - DNA, 630 bp, Homo sapiens
gggtcagaatagatagcatgagtttggatgtatttgaaagtaaatggaaagtaatgatactgtagttaccaagaaggctaaatgagctgggaatttggtggttttgagctggattcgattcttcatttcctgccacttcgatgttaatctctgtgccattgtaggggagatacagtgactcatttgcacacagggtcatgtagtactttctgaattgtgataaacattcagagacagggtacgaccatcagaggcaaattttgccaattaaacaatattgtgtaaatcataaagtgtttttctaaattaaatcaaatcagtaagtatttatcaagcaggcacttatgtgagaggctaacacacaaaaacaaacaggatttgaaatgcaaagaaatgaaaaacaaggtggaaaatgggaattatagttgatcttttctgaattgtttccacagactcagagacaggaagtgaactaacttactaacagccagaaaggaaaattttttctgggaaatctctctttatagagccaaaacaaatattttgatctgggagaaaacaaaattttaagtgaatgtaaaactgaccttcccattcagatactagataagtcaaagaacttcaattaaa

SEQ ID NO: 226833 - DNA, 482 bp, Homo sapiens
actccaagaggggtacagcttcaagttgataggattaatcaacattgtcacacatagttctggggagttcatagtgagataaagactatggacttggatgtattttaatgaagcaggttgtagtggggattcttttgttagtttgtctgatgggaatacaagctccagagacagtcctactctttccttctaatctgggctccatcttacatgtcatcttttttgtcccaaagtttttcacctgtaaaaagaactaatgttagtaccaagctcagcaggtgctgcaatgattacatgtgtaagtatatacaaagcagttagaatagtgtctggtgcatataaagtgctcaataaaattattatttaaagtcagataaatcttctgtcatattcaggacttctgacaggtttatgtccatcacgcaattatctttcaatagtacagatataattatatgattctccccatcacctgccaaatg

SEQ ID NO: 226834 - DNA, 380 bp, Homo sapiens
ctgttagtagagatggggtttcaccatgttggccaggatggtctccatcttttgacctcgtgacccgcccacctcggcctcccaaagtgctaggattacaggcgtgagccaccagtttgacaacacattttcatagtgttcctcatgtaatgtcctctgtgtctactggaatgaaggatttgcacataccaaggaatagaataatgaaatactatgagttagcaaaccagcatgatttgtctgtgtgtgtgtaaaaggcatgagtaaaattatttacatgatcatctattattgcacatacatatttgagtgttaaaaagttaaacgttgtcttaataggaatttcacagccttgtgatctttctttttcttttctcctt

SEQ ID NO: 226835 - DNA, 654 bp, Homo sapiens
tttgttgaaatgattaaggttgcctgtcagttcagtgaaccatttgttatcttcaattaaactgaaagtctccatacatcagccctttgtaaatactgagtggttaatgctgcctcttaggtttccaaatgtcttaagaatgtgttgtaataaaaaaaaattagcatcattttaatattaatactccgacatagattttatcttgagagtgtttctgaaccaaagactctgttagccccatattcaggggcacagggaatctcagatatgtttgtatttgttttcccgaaagagttaagacaatattttctttttttagttaaggttagttacccacatgtcctgattttgactagtttaactcttgaattcttcctctttagcatattttccctgttctagttgatcctttcccctctccaatgtctaataaaaagcttgttttcttggaacaaggtagtttaaatagtaaaacagaaacacaaacacaaacagacacacgaaaaaagaaaaaaaaaaaacaaccaacaaagagggggcgggcgcgccaccaccaaaagatctcccccgcgggggggccacaatcttcgcgcccacacacgagcgtttgctgacaaagggggcccccaaatagcggagccgggcattaacgcc

SEQ ID NO: 226836 - DNA, 496 bp, Homo sapiens
cccttccttctctcctaaccctccattactgccccatccctgagttccaccgttagcctagcaaactattttctgagttatttatctctttccatcttgctccactttaatgtaaattagcattctcttttccctggccactgtgatagcttttccaacggtctgtcccatcagttatgacacccacaacaaactgttctctatactacagccagaaagatcttttctgcttacaaaccctttactggcttccaaaagtccttagatgaagaccacattccttaaattgacctcagcaattcagcatgactctagctcctctctttccagtcttcctccatcccctactcacagatacttacctatctctgtgtgcaacctcttctaccccaacctcacctgctctgtttctactcctcctttagattgcacctgaaggattaccttggggaaaactatccaaagcagtttagactgaaccctcagtctaagtcag

SEQ ID NO: 226837 - DNA, 415 bp, Homo sapiens
tgagccatctaaaataatctgtgtcactttcattcatatcattcagagtagtactgtttactgtaaattagtaaatattggaggatgttttagcaaaattattgcattggtgtggggtagtttctcataataattagatagcagtgctaattttactaaggccattcctattttataacaacattctgctgctaacataagattatatatttttgttttctttagccacaggaagtggggaggaggagggaagatgaatgtaatcattaagatacagaagacatttcaattttatcctccttggaaatcatttggtctgttttcaggctgttcttactaatcttgactctgtaaacgttagtaactggatgtcagtaggctcatacagtttatttcaaatacagctcttcacaaa

SEQ ID NO: 226838 - DNA, 351 bp, Homo sapiens
tactagtagtaaaaggagtgtgctttgagtcacagatcctggttgaactccagcatgttacaaacctcagccctgttctatgaaaggtcataactacgaggattattgtaaaacattaatttagaaatgtaaagtggtccccaatctctggatctggtcaggatttattggagctgccactgaggggattaaataagtggggtcaaagccccacagcctagtcaaccaagttgctcctcttttgtctatcctgtggttcccaagcaagactgcaattgaaaaaaaggctgctgttattaaagtcagaacaccaaataaagctttttttttttttttgagacagaatttctg

SEQ ID NO: 226839 - DNA, 491 bp, Homo sapiens
agtgataagtgtaacaaatacatacacacacacacacacacatatgtatacatacgtattttttgagacaggatctccctctgtcacccaggctggagtgcagcgtgaacacaggtgactgcagcctcaacctcctgggctcaagcgatcctcccacatttgcctctcaaagtgttgacattacaggtgtgagccactgcacccagcctatattttaaatataatatattgaaaacgcccccaaaagtgtaaatgcaactgaaaaagaggttagagaaattcatagataattagaaatattctcttcagttgctttagtgcttcaaaaagttgcaaatgttttatatgactcccataaaccctgtcatgtaatcagagcaggagttataatctaaagtgacagaagaggagtttccagagacttcaagacttgaacgggacttcacaaggtcacaccagccaatcagtgacagagctggggctagaaggca

SEQ ID NO: 226840 - DNA, 230 bp, Homo sapiens
accactttcaccactagaatataagctctgggagaacagggatctcacctgtttgtccgctgttatatcccccgcaccaagaacagtgtcagcatatagcacacactcaggaaatatttgtcatattttggccaggcgtggtggctcggctggccaagatgggcagatcacctgaggccaggagttcaagattatcccggccaacatggtaaaaccctgtctgtcgacgc

SEQ ID NO: 226841 - DNA, 547 bp, Homo sapiens
acagacactcattcactgtcactacctctgtgcactattataatattattatgtctttttgcagataaggaaatgggcttatagaggttaggtgacttccccatagtcgtgcaagtttttcatatttagattagaagtggagatgagtgaggagattttaaagaatcttaatctgaagactgaagcaggcacatggccatgggaatggagaaggtgaggaaaatgtgagacacacacataggatgtagacatagattgactatggaaacaggatatgttgagatatatggagtgaaagatactatcatgtttgtttctttcttgatcatctatctatatatagtatgtatacatgataaaagtccatgtcctcggagagtttgttataagactaattaataagttcagcaataatttattatgtaatactgtgcatccaacactacacagaacatataatggggaatttaaatgaagaagaactcatgacctgtatgaattcagagtttaaaatccatctaaagagacaagacctatatttgtaaaa

SEQ ID NO: 226842 - DNA, 516 bp, Homo sapiens
  misc_feature (29)..(29): n is a, c, g, or t
  misc_feature (34)..(34): n is a, c, g, or t
  misc_feature (498)..(498): n is a, c, g, or t
gtagaatcaagaagaatgtcacaatatcnaaaantctactataatactcctcccttttccaattgcatatctttgtgaggttgaattttctttccctatagaatttcagtgaaaatgacataccacaatagattgaagcagaagcaaatatgagcatacagctgacttctgtcaagacaatcatcaaagagatttgaaaaaatataaacgacatgatcttctctttatctactttttttggaaatataattatttttcatgaaaacattttcataaaaaatgagcttactattattcttgttaaaggaaattaatatttttcttaattttaatttctaatgcagtaaatatcaatatatagaacccaaataaaagcactttaaaagcacttggcatttctcaaaaatcttttttttttttttttttttcaacacagagtctcactcacccgggtggggttgcaggggtatgactcccggctcatggaaaccttggctncgggggtcaagcgatttt

SEQ ID NO: 226843 - DNA, 733 bp, Homo sapiens
taattaggagatgctgatatttatagattaggaattatttgtagactctgcatgcaaatattatgggtaaaaagaaccatttaagtattttgaaaataacattagaccagatgatgttgtaattataatgtgtatttgattatgaccttttacttcttacaacaaacaggatggatttgaagcactcttttctaatgataattccaaagatttaaataactttctagatttttgtaccttccacactgtataaaacacccctgtcttccctgtcaagaaaattttgggggaaaaaaaaagaaaacattgtgcacagagagttgataatgaatttaaatattactaatggaaatactttatagttatatcaactaggagggtttttttagtttgttaactcaggagttttaataaaaaattgtctctaagaatgctgtttccactgcatttacataagggatatataatttattagacatctttttcatgtaaatattcacatgagtatttcaaattgtgaaattacaagtgggtctctttccatgcatactagaagacagcagttattttggcagacagtgcttttcatacattcacccctttactcatttatggatacatgcaaatattcttattaattaaactcttttcctaatgtaaataaagatactatgtgctgatgatacagtgatgaaaaaagacctgacaactaacctaaagaaggtcacatctg

SEQ ID NO: 226844 - DNA, 330 bp, Homo sapiens
cttagtatgtcagcactgttgtgaatactttctcaatttctaatatatagaaagtcacagtgatagtactcaattctaataagcctgtcacatgtgatacttgcggtccatctgtatttcacttttgctgttatttgttacctcatttatttaagagtagcatttgcctttttaaaattttgagattttggccgggcgcggtggctcatgcctgtaatcccagctctcagggaggcaagaggcgggaggatagcttgagcccaggagttcgagacctgcctgggcaatatagcgagaccccgttctccagaaaaagaaaaaacaaaaaca

SEQ ID NO: 226845 - DNA, 561 bp, Homo sapiens
ggccaatgcactccagcctgggaaagagtgagactctgtctaaaaaaaataaaataaaataaaataaaatctttgcatgttctcagtgaaaaacaagaatctacgtaaagtacttggctggcacatagtagttttccaataaattgcaacttaatcagcagcactcattagcccctcctagtgcttacagctcatggaagaggagacttggttgtccacagatccagaaggatgagggtcctgcaaagagggtgctgagaaggaaaggtcacttctggctggggaataagacggcttcctggaggcaggagcatcttagttgagtcctgggagatgaggagggttagggtttgcggagggggagggcattatgggagaggaatgtgcactaaagctaggtgcgaggaggaaattttaccaatcaaagcagacagcgcctcagtgcagggaactggttgggtgcagtgatccctaaatcaccggctgagggggccctgccatgacctctgccagggtcctaccactgggccaccgtgaggggcgagttccaggcagccagta

SEQ ID NO: 226846 - DNA, 454 bp, Homo sapiens
ttaggtattaatagctgaactgaaaaatagagctaacatcaggctgcacactgtggaggaaataaccaaaatcccccaggaaaggaggatcaatatccaggattgctgtaagatactatctaaaatgtctaatttacaagaaaaaattacaagacatggaaagaaacaggaaagtgtgacccatacacggggaaaaagcaggtgataaaacactgccttagaagtggcccagatgacttttgtagcaggcaaaagatttgtcaacaaagagaatttgtgtgtgtgtgtgtgtgtgtgtgtgtgtgtgtgtgtgtctacaaatggaaattctggagttgaaaaggtacaataactgaaataaattcacaagagttcagtagtatatttgagctggcagaaaaaaatctgaacttgaaggaagatcagtggagattatgcagtctgaagaacagag

SEQ ID NO: 226847 - DNA, 390 bp, Homo sapiens
ttgttaccttgactagagtacctataagcaatgatttcttagagccagatagaaccggcttatgagaatcaattgctaaattgtcaggaatcttgccagatagttgtgaaaccactggtgacttgaaatcagtctacaggaacatgcacacaatggaaatcagaaaacatagttttatttgtccttacaatgtgtgtctggaaaatgttactgccagtgttctatgttctaaagttatttgaagtaatcatttcccctgtgtgattaggttttatattcaggtctgttcatttgtttctgtttgtgttcaattgtttctgtttgtgtttaatttgattttttcccatttgacttaattttggtttttgaatatatgagtaatttacatga

SEQ ID NO: 226848 - DNA, 414 bp, Homo sapiens
gaatatgagtcattaaattgtattatcaacttgatatctgttaatcagctctgctgaaaaatgggctgatacttttgggaataaaggctctaggatggggtgatgaggaggacagttctgcttaccatcagtcttgatgtcaggcttattcccaccacaagaggggcatggactcactctttggagtcctcttttcactaccactctgggtcgtaggattatgggtggagactagaatgtgtctttctttctcttcaaagctagttctagtcctaggtcaagaagaagagggagcgggccgggcgtggtggctcacgcctgtaatcccagcactttgggaggccgaggcgggtggatcacgaggtcaggagatcaagaccatcctggctaacacagtgaaaccccgtctctact

SEQ ID NO: 226849 - DNA, 438 bp, Homo sapiens
aatcttggataggggaggtgtcatcctttctgactttgtgactgcccttcccccaccctgtccccagccttccaccatttggtcacaaggatgcctgcctgaggtcgggacacaaggaatctccttgtctaggctgcagcgtgggggcgtggcagggaaagacagaagctctttggtcccggggccccatcctggaaaaggagagggagcaagggaaaggcctgtttacttcctcccttagagcaagccctgactcccggaaactgaggagagagcagagcctgggtctctgagcctgggtcccagagccctgccgaattacaaattatatcatagaaggaattcagggaagctgccaacctggggctcagaggggacggtcccagagatggggacaagagctgtggctggtgtcagagaatgaattcttagagatta

SEQ ID NO: 226850 - DNA, 473 bp, Homo sapiens
tctgtctagtttaattactttgaatttaacatacttgcgtaataaacacatatgtctgacaggttgtaaaaattggggcttttagacttcagctgcagacctaaaatatttgcatagctaattaggggctcttgtgtgatgtccatctttatgtcaagagagtagtacgttcaagagtagtatgtcaagagaggcacggtggctcatacctgtaatcccagcattttgggagactgaggtgggtggatccacgatgtcaggagatcgatatcatcctggctaacatggtgaaaccccatctctactgaaaatacaaaaaaattagccgggcgtggtggcgggtgcctgtagtcccagctactcgggaggctgaggcaggagaatggcgtgaacccgggagcttgccctgagccgagatcgcgccactgtactttagctggggcgacagagcgagactccatctcaaaaaaaaa

SEQ ID NO: 226851 - DNA, 412 bp, Homo sapiens
atttcaactttcaagtcttattatttacaaaatacattttgtaagggtataatagctaccacagatagtgagtcctctgatggatctgggcaaagtcaattaagaaccttcctgaaaggaacattattctagatgccatttagaacatttgtgatccatgtgaggaggtcaaaatatcaacattaacacgagtttggaagaagtgggttccagtcttcatggatgactttgaggagttcaagacttcagtggaagaagtccacttcagtaaatgaagtctagagatttcatctgtagaaatttgatctgagtcttttttttatatcttccatgtctccacttaacttttgaacatatataatgcagctataataaatgtgctaatgttcttgcctgccagtttttacatctg

SEQ ID NO: 226852 - DNA, 488 bp, Homo sapiens
ggcacaggcaaaagtgaagaaatatcaccttaggttctgagctgagtgatatgttacaatgcttcctgctagaagaatgcaaaaaagagtatctcaacacctggatgaagtgcccagtggaattttgatatatcactaaaaccagcatccagatgatatgattcttcttccagggtcctgcccacagatggattgtgacatctcactggaccagcacccacccaggtggtttggtgacatttgaacctcgattcagcaaacccgtggtgcttcgactctattaatggagcacaatcttcaagtgggattggggctgttatgcatgcatcttgcccattgttgagattgtgactgctgtactttgatccaactcataggagatgttgactctcacaccctaagccagtacttgtgtgtgactgtgaaatgtatttctgaacatttttgagtgtgtgattaaaaagtataactttgaccagcatctgaat

SEQ ID NO: 226853 - DNA, 310 bp, Homo sapiens
gttaatccatctgtgagggcagagccttcatgatgtaatcaccccttagaggtcctacctctcaacacctctgcattggggatcatgaactttggggacacagtcacaccatagcaggtagtattactgagtctaccctcagcactgtgattattccctgtagcttttaaaggaagacaaatggactaaaatggaatgtgataatacaagaaggaaagaaagaaagaaagaaagaaagaaagaaagaaagaaagaaagaaagaaagaaagaaagaaagaaagaaagaaagaaagaaagaaagaaagaaag

SEQ ID NO: 226854 - DNA, 404 bp, Homo sapiens
ccgagatcgcgccactgcactccagctggggcaacagagcgagactccgtctcaaacaaacaaacaaaaagtactgtcatttggttaacagctgccttttatggaggccaagctatgcaaaccaaactatgaaaaactttaagagtaaaagggaccctggatgccatttagcttggtcacttgccactacagaagctccttcagcaacaacccagcatgcttgctcagtgccttcatcctccagctgaggaaggctgcccactccagcctgatcaaccatgattgctagaaagtgtttccttggatttcaccaaaatcctctttctctcatttccatccagctgtcctaaactctgtctttcagggccatacagaacacaaacaacccctgctcaacatgacag

SEQ ID NO: 226855 - DNA, 571 bp, Homo sapiens
gaacaagccctccatggaaggagctcagaaggatcagctgcagacagtgaagcaatgagctttgagataaacatcagtgaagttttctgtggctccacgcactcctatcaggagaaaagctagctggctttgcagttgcgggggagtagggaagatgagtgtactatttcctcccaccaattttgttcagtactagaggaggtcttagagatcatctgagtcaattcctacagttcacagcctaggaaacggaagacaagacttgctccaggtcactgaactagtaggtggcaaaaatggagactagaatccagttgttcctaatatgacattctacttaaaaagcctgactaaatcttcctcaattagccacgggtgtcttcttttccagattattaacgagcaatgaattcttacttcatacaaatgcctatgaaatttgtatttatattatactaccttttcactcaatgtaagacatcagtaaagtgattcagttatcaaatatcatataaagaaccataatgggaaatgtttagttctagtctgttaaattgttcagttttagaaa

SEQ ID NO: 226856 - DNA, 856 bp, Homo sapiens
taatccaacatgaggcctgaaagaaacttgggccagaaaatctccagggtacctgcccgccgaagtcccttccgaggactctcctgagccagtggctgagacatgcacatccatggtggaagctccaggtctgggcagccctctccctgcagtcacagactatgcccactaggaacacccacctgggacaaagcctggccacagtcagagagcaggacggctctcaccaagcccctcaggtggctccccgccgctgaccctgtgctgcgtggcacaggcttccccaacgccctgccacatttggcttcctccaagcaggctatgtgcttaggatgagatgtggctacttttagcaaacaacactagagtggcttcagcccagccacggtgacttctcgctcccataagagctcaagagggagaggtgatctccctccccagccactggggaccccagttcctgttgcctattctgccactgtcatcttcctgcaccacctcatggtcctggatggctgcacaggctctagccgtcatgcccctattccagctaggagaaagggggaagcataagtggcaaggagaagcaccctccccttcttctttttttttaattgctctatacatttattattagctattattaatgcagaaccaggggacaaaaagctcacaaacactctacacaatttcacaagacacattgcaggggaaaaagtgactgagatggatcaacagtatgctagggtcttggtggactcattcctaggggaggtggacctctaattcctggtggagggggtctcattcctggagggggcatgcctactggtgtccctcgagcagagggaagccc

SEQ ID NO: 226857 - DNA, 370 bp, Homo sapiens
ttgttttattttcaatagggaaaattgagattttgtagtaaatttaatttcctagtagaaaaaaggtgcagtggttcatgcctgtaatcccagctctctgggatgccacagcacaaaggatcaccagaggccaggaatttgaaaccagcctgggcaacatagtgagacccccatctctacaaaaaatgtaaaactaatttaaaaagaaattagtaggactcagtggtatgcatctataatcccagttactcaggaggccaaggcaggaggttcacttgatcccaggagttccaggctctacagtaagctgtgatcacatcactgcactctagcatgtgcaacagagtgagaacttgtctcttttaagaaa

SEQ ID NO: 226858 - DNA, 350 bp, Homo sapiens
aaaacgggtgtttatattaattgcgagatttttggcattcattttgattttttaaaaatatgggactaggccaggctcggtggctcacgcctgtaatcccagcactttgggaggccgagatgggcggatcacgaggtcaggagattgagaccatcctggctaacacggtgaaaccccatctctactaaaaaatacaaaaaattagccaggcgtggtggtgggcacctgtagtcccagctacttgggaggctgaggcaggagaaaggtgtgaacccaggaggcggagcttgcagtgagctgagatcacgccactgcactccagcctgggtgacagagcgagactccatcta

SEQ ID NO: 226859 - DNA, 542 bp, Homo sapiens
atatattctcgtccgaaaatatcccttcacgaaacttgctttttaaaatgttgccctttgcccaccctatgctcctatagaatatttagttcagtgacgacatccatcctcttttggcgtcctagcacaaaagtatgcaatttttattctcttttaaataaactgtgcaaaattaattttaaaaatacggtttacaattcctcatgaatggcaaagagcaaaaaaaaagacgtttacatctttcgacaatgatcccgggcattaaggccaacaatgttagcaacgaagagactgggtaaaaagaggtgggctaatctttcataggactgcttccgtggtcgctaacaacaatccgcctgctcactggacaagcagcgacacaagctctggaagcttccagttcatttcgagattcacaatgcggaagaaaaaggccggcagccccgctccgcggtgcgcaaagatatgcgcgaagggaggaggacaagctggaggcggctcagccagctcagagaggccgggtggggatacgggggcggccg

SEQ ID NO: 226860 - DNA, 413 bp, Homo sapiens
tagacagaatctttgtgatggaggtggtctacgaactgggcctcgaaggacagataggatttgaaagaataaatttggttgggagaacattctaggcaggggaaatatcccagaagtacagttcctaccaacagaatgagtgctgtactgtaggtatatgtggtgatacccagctcggctgccttctagggacagcaggcacaggaatgagagttgcgcccattctgctcatgagctcccgggtttccaagcgggacctgtctgagccagggtgggcagccaacacccagctgttgtcctgcaggaacctgagccaggagtgaccagatgcttggttttctgaagaagccagaaatctgcatctttatttgagatgttcggattttaaaagtttatgtttaattcagttcttt

SEQ ID NO: 226861 - DNA, 578 bp, Homo sapiens
tagtccatctccattaactcagaattttctgggtttgcggtgacactaaatgtcacagtaacgagggttacaggaattcggaaaagataacgctgctttcaaagccgaggagccagtaaaacactacaaacgtcccctgccggcatgctccagcacacagcccgacgccctgctctcccggccggcgctcggccgcaggaccgcgctgtcccggctcctctcggcgctcaccatcctcccgaatgcccagggcccggccgtccggagcggcggcacgaggacgcggaaccgcagagcggctcacacggtccccacagccagatcactcggcccctggagcatgttaaaaacacagccacagaagagggattctccctgaagcggggagtggggatggaaaatgcaagcgcaggaggccacgtccggctcgcgcgggagggccgggggccgggttgggcagagggtaacgctggggcccgcaagggaacggccgggactggcctcgctcggggcgcaggggcgcactggcccctggctcgcacgggccctggggctttacttggcacgggagcggccgc

SEQ ID NO: 226862 - DNA, 355 bp, Homo sapiens
atgctgtattaaattggaaatgctgcattagcaaatgcactccgcggaggagacaactgtaattctaaccaggcagtgggaagttgagtcttctgcttaccgtttttcacaccggatgattggaagaaccttggggacacactgatggctccgtccatacaaaccttgcttctctgtttcccgccgacttccagcaccaagctccgttcggctaaggactcaacagcctcagccggccagcaaggatgtgcttccactgaatgaaaataatctcttgtggccgggcgcagtggctcacttctgtaatcccagcactttggaaggccgaggcggatggatcacgaggttgagagat

SEQ ID NO: 226863 - DNA, 413 bp, Homo sapiens
tcaatagcagaaagataactggaaacttggtgaatgttgaaaaataatataacatatatctaaattaaccatgggtctggaaatcaaatgaagagccgagtacattggcacgtgcctatggtcccagctccttgggaggctgttgcaggggggatccctcgagcccaggagtttgaggctggagcatactgtgttctactctccactgcactccagcctgagcaacatagcaagactctgtctctaaattaaaaaaaaaaaaatcagatgtgaatttacaaaatgttttgaagtgaatgcaaatgagaatattgtatatcaactttggtaatatgcagctgagagagtacttagaaatttatagcactgaaagtatcaactcagtgacttttcttccacttttagaagtttta

SEQ ID NO: 226864 - DNA, 493 bp, Homo sapiens
cgaccgccaggtgccccgaagcccggcctcccctcccacccccgcgcctgttcccggcgcagcccgagccgtggcagtcacgtctccccatccggccccaaagtaagagccagccgcagccgcgccgaccccgcgctgggtgggagggcgcggggagggcggggagggcgcggggagggcggggcaaggaggtgaggggagggcgggttgcccgggccccgcccgctgcgcccaggtcggccggggagaggcgcgggcgagtcgcagcgccgcaaccaccgcccctgccgggcgctcggcgagcgggggcagggcggggtgaggcgtggccggggatgccgcgaggccgcgcctccagggctgtgcgcgggcgggtgttgctggggagaaaagcgcggcacggccccgcccgagtcctgcgggcacagcgctctctgctggtgtgggttgagaactgcatgagactaattaaagaccaccatccacttaaaaa

SEQ ID NO: 226865 - DNA, 266 bp, Homo sapiens
ctgggctttcaatgacgaagatctgagctaggatggagggtgtgaggttggaggccaaggatttggaggtaaaattggaaggacttgggagtttacatgcaggaggccagagaggaagagggaggagtcaaaaacgatcattggaagaggcttttcactggagataaagagtgagggaggggacgctggggaaagaagtaagtttgagggaagaatttgtttttttttttttaatctgggcaattggagttagaccctgtctcgta

SEQ ID NO: 226866 - DNA, 593 bp, Homo sapiens
gtcatttcaaactttgtaactgtaatttttggcacttcaggaatcccaccattttgtggctgattgttctctgaaaggttatgatagcagccctggaaaaaaataagatctatgaaaggcttttggattacatatgaactgccctgattattaaaatacacttcgatgttgaagacttacaactgactttactcagggtgaattgttaaataaatgaacacttaggctgagtaatcagatgggtactgtgaaaagggtatttttgagatggagtgtcactgtgtacctgttggtagtggcaaccataattatagattcttatccattaaaatacttcagggttgctgtaagaggatatttgttctttagccttgttaggattctgtcacccccttctacccccattacctgtcttctcttatcctcagcatgtatttggccacatggactggtttttaactttatttttacccaaattgtttgaatttggtatcccttttgggggttggaatagcactactgccgtccataaatgctttcctcagggccatgcccattctctggctaccttccccttctgagaactcccctgc

SEQ ID NO: 226867 - DNA, 448 bp, Homo sapiens
gaattaaaacatagctcagagatgaaatctgaaagaaaacatggcccctctttgctaaacttcatagttttgatgctgttaattacactttgttttccatatgatgcctcatggtgaccaaagtaaggtaaattattttgaattaatattccctccaaaaattgttatccccaagcatgtaaaaagtaaaaagcaataaaagcccaagttgcaaagaaagatgtgcttctataagagcatttggaggctgccggaagatggtgcattccagagagcttaagactgagctttgataacagacagacccaaatttctgccacatttcacagtgtgactgtgcattggctgctcaaccttgctaagctttaatatttttgtgtaagaaaaatatatgtatttattgtacctaaaggttgttaagagaattaaatgagtgtgtgtacataac

SEQ ID NO: 226868 - DNA, 213 bp, Homo sapiens
agccagggtggtctgcatggaacttctttcccggagttccggcctcagctccgatgtccacccttgtccccaggtggacacagcaccgcccagcatttggtgcaactccacccttctgcagaacgggcccctccctgggaaggcatggcttgcaataacatccctctgtaccttttctggcttccccgccacaataaaacctctcagcctcag

SEQ ID NO: 226869 - DNA, 564 bp, Homo sapiens
gcaagctgcgtgtgttcgatttggaatgacttttcatgctggtactggaatggtcattcctttgttcatttgactatcctaaatgcatacatttctttagcccagtgggctttgtcttgagacagagtctccctctgtcgcccaggctagagttcactggcatgatctcggctcactgcaagctccacctcctgggttcatgccattctcctgcctcagcctcctgagtagctgggactacaggcgcccgccaccacacccggctaatttttttgtatttttagtagagacggggtttcaccatgttagccaggatggtctcaatctcctgacctcatgatctgcccgcctcggcctcccaaagtgctgggattacaggcgtgagccaccgtgcccggccactgtcttgacttttttaataaacagctctgtgaacttggagagatccattaaactttcctggtttttgttcctcaaatgagggaacataacaacacaatgtgccccaattcatgacttccatctaaggcctcgccacctctagaactgctgctgttccctgag

SEQ ID NO: 226870 - DNA, 317 bp, Homo sapiens
gaagaagtatggctcagtcttactcttggagtgtgctggttttgggtcacccccgcatcctcattctgggctgcgggctgttagcctgcatgcctgggctcctggctcgcctgcctcatagctgagcctttcagcagccccaggagtgtgtgcccaatggggcagtgagaggtgacctgctgacatccctcaagtgacagagtcaattcatgtctccaaagagagaaaagcatatccctcctccaagagaaaatacagagaaaaaaatggctctttaaaaaatatgtgcatgtttcataaaatcattgtcctctaat

SEQ ID NO: 226871 - DNA, 191 bp, Homo sapiens
accctgatcgggcatttgctttcacgtaagccatgggtcaagaactgctttcaaaatctagtgaattttggccaagcacggtggctcatgcctgcaatcccagcactttgggaagtcaaggcgggtggactgcttgatgtcaggagtttggcatcctggcctggccaacacaatggaaccccgtttccaca

SEQ ID NO: 226872 - DNA, 481 bp, Homo sapiens
atgtgtgtgtatgagcatgcgttttggtgtgcttatataaatatacacttatgcacagatgcacacatatgcacaagcagccgcacgcacgtttagtctcttaaaagactacagtgtcaaaaagtggatcagagcttagaatcaagctctgatttcaacaaaacccgcaagtaagaggcctgaagatggaaggaaatggaagagcatgaaccctctagtgttaccctcatggacccacgtgcaacgtcagacattacccagaagttgatcccacaatccttatgcctacttcagctgctggaggtggggagactcactctctgggtctcgggggtctgggtccctgtcaccttgtaaggtgctttgcctgcctgggcccacacccaggcccgggaactgcagggtaggatcccaaaccaagcctaccagcagcccctcctaggcatcaatcctctttaataaggaaatttgaaagtgtaat

SEQ ID NO: 226873 - DNA, 616 bp, Homo sapiens
tgatcaggaagcagcagaagcaggatagagcagaacaggtctgaagcagtgaagcaagagaataataaaaaaaaagaaaagaaaaagaaaatatgagtttggcgctaggaagaagagttatcaggactagagcaagagattagagatgttgtcacagagcctgggacaggaaatggaagagtcaggggagagaaggggagaaatcactgctatcaccaccaccagcagtagcagcaccagccccaggaaagagagtagaaatgccaggagatgggggcaggtggagaaggaagaagagggagacagtagtgagagtatagaggacatgcgtggagagtttccagaagaagacttgtctacttgtggaaagctgagaagttaagagagagaggcttaaaaccatgtcatgagatttggcagttggttgggagaagactggcgaagtttagagtataatttcattaaagtagtggggacaggagccagaattcaggagttaaagagtgattagctgttgaggatgcagaagtaagtacatgacactttccaaaatttggtgttgatagggaggccaagtgggtggacagtttggaagtgataggggtccgcctgtctt

SEQ ID NO: 226874 - DNA, 282 bp, Homo sapiens
  misc_feature (232)..(232): n is a, c, g, or t
  misc_feature (235)..(235): n is a, c, g, or t
  misc_feature (238)..(239): n is a, c, g, or t
  misc_feature (246)..(246): n is a, c, g, or t
tgatcaggaagcagcagaagcaggatagagcagaacaggtctgaagcagtgaagcaagagaataataaaaaaaaagaaaagaaaaagaaaatatgagtttggcgctaggaagaagagttatcaggactagagcaagagattagagatgttgtcacagagcctgggacagaagcaggaagcaagcaggaagcggcagaagcaggaagcagcagaagcaggaagcggcagaacnggnagnngcagaanacggcaccggcagaagcaggaagcgggtaccgagca

SEQ ID NO: 226875 - DNA, 424 bp, Homo sapiens
  misc_feature (374)..(374): n is a, c, g, or t
  misc_feature (377)..(377): n is a, c, g, or t
  misc_feature (380)..(381): n is a, c, g, or t
  misc_feature (388)..(388): n is a, c, g, or t
tgatcaggaagcagcagaagcaggatagagcagaacaggtctgaagcagtgaagcaagagaataataaaaaaaaagaaaagaaaaagaaaatatgagtttggcgctaggaagaagagttatcaggactagagcaagagattagagatgttgtcacagagcctgggacaggaaatggaagagtcaggggagagaaggggagaaatcactgctatcaccaccaccagcagtagcagcaccagccccaggaaagagagtagaaatgccaggagatgggggcagaaccacgaagcagcagaagggcagaagcaggaagcaggaagcaagcaggaagcggcagaagcaggaagcagcagaagcaggaagcggcagaacnggnagnngcagaanacggcaccggcagaagcaggaagcgggtaccgagca

SEQ ID NO: 226876 - DNA, 507 bp, Homo sapiens
ggtaaagcagcattctctcatgggaggatgaagacaatcctgtaatctaaagctgggtcatgtgcgtggaaagctttgaggcaactgaaacgaagttgatctaggcatggaggtatgtgtgcacaatccttattagtgtaaggctgctacatttttctcatggtgagatctgttttccagaaatcgtcttagaggaggtaggtcttaggaaatagaaaagagtcatctaataagacaagtctttgaaaagcaggagaaaaacaatgataccgtaaatgcatggtgacatatgggcatttgcctttttaattatttatgtaactacctttcctcaacttactcatttctcagtatttccttgtgatacgtgatacggcatttgtatatattttctacatttccatcaatcaaatatttacagtttttgctcatctaatagttcaaacaaaaaataatagagattactttgttcttttatttaaaataaagttgtgatgaaagttatat

SEQ ID NO: 226877 - DNA, 566 bp, Homo sapiens
taagtcacatggcatcacttctgcccctttccatcggtcaaggctactatgaaggtccactcagtttcaaggggagggaatataggatctcatctctctgtggaggcttgtcaatgtcacaaaaaaaaaaaaaaaaaaaagaaaagaaaagaagtggaatctgttcgccctttaaatctgggctggacttgtgatttgctgtgactgattggatgtgagggaagagatgttggcccacttctgaggctaggcctcaaggactctcgcagcttccacctttgccctcttgcaatcctgagaccaccatctgtaaagatgtccagccaagcctcctgacagatttgaggctgcgtggagaactgaggcccccagccaagagccagcatcagctccagatatgggatgacagaggccatcttagacactgtagccccacttgagccgcagatgacaggagcctcaggagtgacccaaggtgagaccagcagatgaactaccaagctgatcccagcccagactgctgtcctatagaatgaggggaaataaatccttgttttaatccacta

SEQ ID NO: 226878 - DNA, 552 bp, Homo sapiens
  misc_feature (320)..(320): n is a, c, g, or t
tccacttaatgtctacatttcttttcctattatctagttctagtcttaccaggctatgtccaggctcagcaagaaagaatgccatgatgaatttaatgatgtctgctatggatagatgataaaggaatcaagccatgaataacgtatttgctgatgtaatctttttcctcaaatccatcaatataaattaatctgccctctttatttgtatctactgaaatcctactcatcatccaagactaaacattctactactcaccctcactgcccaagaactatcaaactcctgagccaacaacttaatatgactagcttacacnatagcttttatagtaaagatacctctttacggactccacttatgactccctaaagcccatgttgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctac

SEQ ID NO: 226879 - DNA, 424 bp, Homo sapiens
tcaagcaattctcctgccttagcctcccaagtagctgggactacaggcacatgccaccatgcctggctaatttttgtatttttaataggacaagatttcaccatgttggccaggctggtctcaaatacctgacctcaagtgatccatccaccttggactcccaaagtgctgagattacaggcgtgagccaccgcacccagtctctctgcttgctttttgtttgtttgtttctgaggcagggtcttgctctgtcactcaggctgaagcatagtagtgcgatcatagcccactgcaacctcaaactccagggctcaagcaatcctctcgtttcagcctcccaagtagttaaaactacatgtgtgtgccactacactgggctaatttgttttattttttggtgagacagggcctcactatgttgccc

SEQ ID NO: 226880 - DNA, 441 bp, Homo sapiens
cccaccttggctgggattacaggattatgattttcaggttttagactttatggattttgaccttttgggacttcagcattatgacattcgggattatggcattaaaaattgtatctcctgggactatgatcggctcccaatgtcaatagtgccacttttgagaaacctgatctaagctcaaacttgttgggacatatctcagccttgaagaatcaccttgacatgaatgttgagtataactcctggccagctataaaatttgcaagacctagtgcaaaatggtaatgcgggactcttgttcgaaaagcaggaaacaagtaccctgaaaggtacctacaatgcttttccctttcttccaaggtttctctctctctctttctctgcttattgtgatgttatttgctatttaatattctaagtaaagaaaaattaaaaatttaa

SEQ ID NO: 226881 - DNA, 495 bp, Homo sapiens
cgccgaagatagagactgatggctatgtggagatcaattatgtgattattgacattgtccaggagagagttaatgatgaacaggattgagatggtggttcagaatatggaaaaaaggtctttaagtttcaggtgcaaaataactcatagaggaaactgagcagtacatgctcaagtgcatgcaacttattttaaaccagtggatttgtttgtaaagccatgattttaaaaagacagtgacaatgtatatttttagaatttcccaagtaggattcttctgcatgttttagagggaatatgaggtatttcttggttgaccaaataatactgtggttaaagttgaatatttggcaccgcagatggctagaattctaaaagtgatgaaactaattggtctaacaagttaacactgcattattagcaaaaagaagcagatattgtaacactcagaatgaataatcttgagatctgtctcaggaatgaaagctgacatatt

SEQ ID NO: 226882 - DNA, 386 bp, Homo sapiens
acccattgaatcacgttcccctggttctgggttcaagtactgagaatcctatctatgaataattgccaaagaggccacagaactcctaaaaagacgagttttcggccaggcgcgttggcttacaactgtaatcccagcatttgcaaggccgaggcaggcagatcacctgaggtcaggagttcgagaccagcttgaccaacatggagaaacccgtctctactaaaaatacaaaattagctgggtgtgctggcacacatgcctgtaatcccagctactcgggaggctgaggcagcagaattgcctgaacctgggaggcagaggttgcggtgagccaagatcgcgccattgcactccagcctgggcaacaagaatgaaactccgtctca

SEQ ID NO: 226883 - DNA, 458 bp, Homo sapiens
tggatgtacttgagctgtgggatacagagcataaaggggagcacaccactaagataaatctaggttcttgtctcataaccaggaaaaattagacatgccgacaaattgaaagaagctttaggagtcagatcctgatagagaccagacactgctggaattctcactccaacaaaagattacttcaaggtcggaacccaaacctgggtgaagaataactcacttataacctggcaggatccatgatggtgccagccccttcaccaaatgtgaccataattcaaaaggatcacacagcaagtcataccacctggcacctctgagccccccttgcctcttctgcattccagaccctgctttaaaaacccctgtgttcccaccacagattgaaggtggaattgtttactgctcttcctctgctagcatagagaataaaggaaaatgtcgctccctcttatcac

SEQ ID NO: 226884 - DNA, 616 bp, Homo sapiens
agccagccaacaatctgccaggaagtgtttgtatgatttaaggtaggattgagcaagttcataactgaaaaaagaggtgtggaagagtgaaggtccagaaaggaggggacacgcagctcaaagtgggaagatctggaacacaggtggaggctgcagggatcactttcaacaggaggaaggaaacttttcccctgggagagatgtgacgccacaaatgatgggtacagaagacattcgtgggtggcaacggaggaagttcctgtgaacttttaactgtttgaaccttcagcatccagtcttccagtctctcttggctaggtgacctctcaagtttaatattttaccagttttgagtcattgcatccatcctaggcttcaaaacccttcatttttccctttctctcttgtcctgtgcctgccttttgagcgtttattttgctgctgtcattatcatttccatctattttctacccatttcttttgtctgcctcctttcttcccctctagctctctctcttgagatcatgtggggaacaagaaaaaaaatatctgaagaggaaggaggagaccctgtagaagagagagattattaaaaatctaagttcctgaggatcca

SEQ ID NO: 226885 - DNA, 337 bp, Homo sapiens
gtagagtacagagagagagagagataatgtgcatgtgcttggattttacactgaaatcattctagaaatttctaaatgcttcctctcaaattttgtactaattgtatgacaggctagtagcagtttgttgattgattgaaattgtgtaatattagaaataatgccagagaatattgtattaaaaactatttgctctaaagcttttccctccaatagctctatgacaccttggaattctctagtgaaggcctgagtcttattcgttgtatccataacttaaactgaaaactgcctgagacatagtaagttactaaaaactattagtagcttgaatata

SEQ ID NO: 226886 - DNA, 321 bp, Homo sapiens
agaattgctttcctgtagaggagaaggattgagacatgacctttggtgaaactgaagctataacttgaataatattcgttaatctggggagaataaaattttgaaaggagaaatttaattttgatgctcttctttaaaaccaagggctccacattgtctgtaagataaataattaaagctttatttactatggcattcaagggacttctcaattgggccccaatctacttttctgatatcatttctgatactacttttcacttatagtccagcaaggcctgtccactcactctcgttagacccttcatgctgtcctacctc

SEQ ID NO: 226887 - DNA, 527 bp, Homo sapiens
ggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattg

SEQ ID NO: 226888 - DNA, 571 bp, Homo sapiens
caaattggtaattatttcagaagcaaattaagataacatcttagaaaatcaatttatggacttgagccgagtgcttcatacaacgaatgggttttttctaggtgtttgtcaccgggaattttcctgagaggcttgtatatattaatagaaaaggagtgtagcttttttttctcttcgttataatttaggtaaagtcttacaatgtgtgaacaaggctgtcatttttagcttgcgtttgaacgaaaacatgctatactttttggagaccctgattgagtaatcagtacttggggtagtgataaaccacaggtgagctaacttgcggcattctttagattaaaatttgatcgtcattgtttgttcccaacaatgatttgccaggaatggtatgcatacttctcttctgccccattcttccttgttctaatctcttcttaaatagttctgtttttcttttgctgaacaggaattcccaagtaaataattctttcttgtgaccgagggtgcagttggtgaggtcttcttgccttctgaatggccagtagctgcttccggactccggaaaatatgt

SEQ ID NO: 226889 - DNA, 495 bp, Homo sapiens
acaaaaagaatctaagattctgtgagaccaagaagctgtctttggccagacatagtggctcaagcctgtaatctcagcaatttgggaggccaaggcaaacggatcacttgaggtcaggagtttgagaccagcccagtcaatatgggtgaaaccccatctctactaaaaatacaaaaattagccaggcatggtagcacacgcctgtaatcccagctactctgaggctgaggcctgagaatcgcttgagcccgggaggtggaggttgcggtgagccgagcaagatggcaccactgcactccagcctgggctacagagagagactccatctcaaaaaaaaaaaaaaacaaaaaaaaaaacctgtctttgaaacataacttcatgtcacttaacacctcaacaatgtaataatttccttcactttcccaaaacttaaagaaacaaatgaacaaaatggcttctggtgattctattagctatattttctaagggggaggg

SEQ ID NO: 226890 - DNA, 311 bp, Homo sapiens
aatcaccttgctgtttaggaaagctggatatgcagaccagtgaatgcagagagaaagcaaagaggtttgtgtgtgctgggggatgagtgcgaggatggaagggagtgggaattcatttattgatatatacatacagagcactgcacccactttgtgccaggtactgtgttctgggtgctgttgtagcagtgaatcaagtagacaaacgttcggcccccatggaactcatgtgtagtgcaggagatcggaagcaaacatacatgtaatttcttagggggcgattcatgttatggagaacaataaaccacgat

SEQ ID NO: 226891 - DNA, 503 bp, Homo sapiens
catttagcaaacaccctctgatggaaggagagaaacgagtcacatattggtgttgcccaagggccaaaacacacatctgacttatttaattccagcaacatcactgaggttctactattatctcctcttgacacacaaggaaacccaggtgttgaataacttctccaaatacatccagctattaagagacagagctggatttccaaatgaagtatctttggcaccaaagcttgtgccctttccctctctgggcacctgctatgtgctagttgtgctatcagaaacagggcttacacagccaacaagggcatagcccctgacttgaagaagttcacaatatcccttgaaagacatgctgaaaaacttccctgattaggacacagatttttttttgtccccagttcttttacttctggacatgccttcctagattactgtttttcaaaccttgataattcatctttttgtttttgatagccactatgttatctattggtgagtac

SEQ ID NO: 226892 - DNA, 531 bp, Homo sapiens
tgaatcagaatctgtattttaacaagatcctcaggtggtttgcatgcatgttaaagtttgaggagcattggtagagggaactgtggctatttattttattggtcatgtgcatactaatttcccgacctctcttgattattaaaatgactgtgaacttactagaactacaacatattgatgtgagggaggtgtttatatgtgaaggtgattggcttccatgcagaaaccatgtaacacccagcctgaacagtttctgatgaggttgcccttaacctaggaaactgaaagataatgttgtcgtgtttttgatatatgactgctgtcctgctcaactttataaacatgtccaggaggtggggagcagtttgctactcttcatttgcaaatcaattatctttatataagtagcaaatagtctattttaaaagctcaaaagataatttttaaatgagaatttgctttgcatgaagtgtgtagatgttggaaaaaggtgactttgtctaattattctaatatatgaagtttaaagga

SEQ ID NO: 226893 - DNA, 1013 bp, Homo sapiens
atctaaaaatttttagaaaaatttttattctattgtcatgcctagttgatagtttggcagactacagaactttatgttagatgccatttttcttcagaattttgaaggcatggttctattattttggcaataatagagaaataggaaccttcatacattagtgttgggatttcaaaataatacactcactttgagaaacagtctgtcagttgttcaaaaagttaaatatagaattaccatatgatctagcaattccattctcagatatgtatatacgcaaaggaaatggagatatacatgcacatatgacttgttcgagcatattcttagtaatgttactcataataactaaaaaattaaaatttccctaacgtctatcaacagatgaatgtataaataaaatgtgtacttctatacaatgaaataatatttggccataaaaaggaattacaacacaaatgaaccttgaaagtattatgctaagtgaaagaaactagtcacaaaagactacgtattgtatgattccatttatatggggtctccaaaatagccaagtctacagagacagcaagtagattagtggtctcctagggctgagaatttggtagaaatgaggagtactgctaatatgtatgaggtttcttttgtggtgatgaaaatatactaaaattgattgtaatgatggttgcataattcaactaaaagtcattgaattgtacactttgaatggattaattgaatggtatgtgaattataggcatatgttgttttattgtgctttgctgatactgtgttttctacaaattgaaggttgtgacaactctgccttgagcaaatctattgatactgttttcccagattgtgcccatttcatgtctgtttgtcgcattttgataattcttacaatatttcagactttttctttattattataattgttatggtgatttgtgatcggtgatctgtgatcagtgattgttttctggtgccacaaatgtaagacactgaactta

SEQ ID NO: 226894 - DNA, 440 bp, Homo sapiens
atacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacag

SEQ ID NO: 226895 - DNA, 460 bp, Homo sapiens
tattttataacttgactgatactaccaaattgtcctagaaatgttgggtcaatttagtcccaacgctgaaaaaggtgtttgtacatgcacgtttatagtagcacaatttgcaattgcaaaaatgtggaaccaacccaaatgcccatcaatcaatgagtacataaagaaactgtgtggccggccgcagtggctcacgcctgtaatcccagcactttgggaggccgaggtgggtgaaccacgaggtcaggagttcaagaccagcctgaccaacatggtgaaacaccgtctctactaaaaacacaaaaaattagctgggtatgttggcaggtgcctataatcccagctactcgggaggctgaggcaggagaattgcttgaacctgggaggcggaggttgcagtgagccaggatcgcgccattgcactccagcctgggcaacagtgcaagactccgtctcaaaa

SEQ ID NO: 226896 - DNA, 639 bp, Homo sapiens
tgtatttgtatttgtagtagagacggcgtttcaccgtgttatccaggatggtctcgatctcctgacctcgtgatccatccacctcggcctcccaaagtgctgggattacaggcatgagccaccgcgcccggccaacatccaaggattttggtgtccaaagggaggcctggaaccaatcccacacggatactgagggacaagtatatcatcccatttcatccctacagcagcaacttcatgaggcaggagttattagtcccattttacagaagaggaaactgagacttagggagatcaagtaatttgcccaggtcgcacaattagtgatagagccagggcttgaagcgacgtctgtcttaagccaatgacccctgcagattattagagcaactgttctccacaacagtgtaagcctcttgctagaagctcaggtccacaagggcagagatttttgtctgttttgctcattgctccttccccattgcttagagcagggtctgccacgaagcaggttctcaatgcatagttattaaatgtatataagagcaaacatatgttacagagaactttctgtatgcttgtcacttacatgaatcacctgtgagatgggtatgcttgttccccagtgttgcagatgaa

SEQ ID NO: 226897 - DNA, 483 bp, Homo sapiens
ttaatatatagttatctacaaagtagataaaatgaaatcattaaaaataatccagaggaagcagaaaagggaaaaaggaacaaagaacagataggacaataagaaaaagaatagcaaaatagtagatttaaactcaactatatcgataatcacactagatataaatgtcctaaatacactaattaaaatgcaaagaatgtcagattggctaaaaatgcaagagccgactattactgtcaacaagaaaccctttttaaatctaaagacataagtaggttaaaggtaaaaggatggaaaagcgctaatactaatcaaaagaaaattgaattggtatatcaatatcaaagtagaactagagcaaagagtagtaccaaggatataaaagaggcttgtttcattatgacaaaggggccgtttcacgaacaggacatagcagttctaagtgtttaagcatataataacagagcatcaacataaatgaag

SEQ ID NO: 226898 - DNA, 601 bp, Homo sapiens
ttacaggattttcttggtaggtttttttaccaacttccctctccagcaaagagcctaaaatgactgataataccatgttgctgtctttctccagggctcagccttctttaaatgggcctgcttcttcatctggtatttaatctgagatggaaagtgagatgcgaaacccaattttccctttcacttggtcacatgcccagaagcagcagcgttcagtgggccgagtactggcgtggaaccttcctctgttcccatgtctgtggcgtggcacgaacctgtgatgtggggctctcccgcccttgccctggaggggccttcagggacatgtggctcacccatctgttattgtcacatatcccccagaggaaggagggacaggctgtgaggttagcttgtttattttatgaggaaacaggcacagaaaaattaatttacagagtcttggacaaaatcccaaaggaaggaggagtgggaagagcagagagcggataaacagcacaacgccatccctggacacgcctagttcttgcttttatttaaattttggtaggttctgtggccacacccactttaggctaggtactgggagacaacctctggg

SEQ ID NO: 226899 - DNA, 372 bp, Homo sapiens
tttcagttatgttaggacaacctatgtgggttcacatttggcttaatactaccctacttctccaataagtatttaagcatttattaaaatcaaacttttcaagttaaccacttctactaccctagtctctctgagaaagacatgacacaccttacttcaacgaaaaaaaaggtcttttttcctcacaaatattttctcataaactttattttttaaaggcttttaaaaccagattctaatttaattaatctagatttgcaaaattataaaggaaaagtcttgccggttgttgctttggttatgttaatttcacaatttagtaaattgtgactatgtacaaagcagccttttgcgggggccgggggtgtttca

SEQ ID NO: 226900 - DNA, 398 bp, Homo sapiens
gatgctgggttgatagccttacttccttcccacatgagccttttccacatggcagtttacttcatcaaaacaggcaagccaagaagaccagagagaacatctggtaagacatgccacagtcttttgtaactcagtcatagaagtgacatcctgtctgcattaccatactcttggttagaagcagatcactaggttagaagcctgcttaatgggaggggtgacatggacatgaaggacatgaacaataggaagctgggatcattggaggccatcttggaagctgtcttccaaaatagttgcctaccatgccttggttttctctgtttgcattaacctttttttcccctctatatttactgtgattatcttgagtaatttaaataaaatttttcatttga

SEQ ID NO: 226901 - DNA, 563 bp, Homo sapiens
gaggggagactaatggaaactatggggaggctatcccccaagcctccgctgaggccaccgctgtctgtgtcccgagggccctggagtaggaggtgtcaatgacggactcaatgaatgaatgaattgatcccaccaccaccagcggcaggcccgcctcttccttccacagcccaccttggcctccccgcctcgccaggtggcaaggccttcgctcctggtccctgagcgccgctcgcttccctcccgcgtgggcagggggcagccgcgacgccggcccagcgcctccgagccgggaaccgcacagcacccggcgatggccccgagccccgcgcgcccgaagccacggcgccgctcgctgggggcctcgggacggcagggacggctgggggtggcgcggaccgcgtccccgaggcgcgtagcgcgcgatcgaaccacgcgccccgcccgctgcggtcctctaacagcccctcgcgccgccccacgtggggccgcacgggctggcggccccctcacccgattggccgccgcacagccaatcagagagcggaggcgatagcggccgc

SEQ ID NO: 226902 - DNA, 507 bp, Homo sapiens
agttttatatgtttattgaactaatacatgatcctgtataacatttgtaaaatacagaaaaatacaaagatgacaacaaaataatttaaaaacattaaaaaatactgattttagagataatcaatgttaattttttcactattgaaaacatttgatgaagatcttgtcattcttttttcattatctttttatataaatggattatttcacataatatattaatttgtacttttttgtaaatttagtaatgtagtgtaagcattttcttcattttattaaatatgcaactgcaacatcacttttagttattgaatatgtcctttgtagaaatgtgataagttatttaatcaaattcctagtattggacattttctttgttttgtgtaacacaatttgttgttgtgtgtaaaatatgtgcttgtaattatgttgttgcataaactgtggttatttccattgctatatttgtgtatacggaatgcatattcttaatacttttaaacttta

SEQ ID NO: 226903 - DNA, 459 bp, Homo sapiens
caggactggcaactcagtatgtggtttgcttataaacctgtgaacacagaaatttctgctcctagtagatggaccttcctgtacaggaatacactggaacctcaaaatcagaatttcaggacagttttgtcttacgtgggaacagggagcaaaagaaggacatgacttagggtggcggcattgggtcatgcaatatcaggttgaactgcagaggggatagagactgaggtcaaccttcaataaaaattatggacaccaagactccggtgaatttccttggctgtcaatatttaatgcctattgtaacatagtgttaatgttatacatgactttactggaaaaggacaactgaaaattctgtatttggagctttcctggactctgctttgtgggtctcttcccttagctgatttcagtgcatgccctttcactgtaataaatgataactatgagtattga

SEQ ID NO: 226904 - DNA, 1133 bp, Homo sapiens
cactttgctaagagggaaacagaaaaacattactccagccacacaaatatgatactgtgcaagtatcccactcttactcattcaaatcctacccattttttcccatcgtggaacagagtcttgccaacttatacctctctccaataacccataaagatggtgatttgaatttgggccaagatttaacattttatgaaatacaagaggagagttttctgcaaaacacaggatttgcagacaaggagacttaggttcaaattccagttctgccatttattacctcagagaggtcatacaactttcctgaagttgtatgacctctctgagccttagtctcctcgtttgtaaaatgagagttaaaatctacctcatggaatcattgctaagattaagcaagatatataagtagagcttgtgcacatggtaggtacttggagaatgttatttctccttccctcttactcatctggacaagtttaactagaattctaaacagttaaatatgtatcaatcctttgtattaaatatcttgatggtaaaatgttaaaatattgatgtgaataacagctggtattgaatattcaaattaggggaactctttcattgttttaagataacatctgtacatttaatctgtgccatgcaataaaacagcttttcctgaaacagctttttaaaaactatttttaagaaattcataagttacttttaagaacattagcttagaacatcttcccctttcacaacaaattagacattagagccaaaattgcccaaattggtatagtttctatctccctacactttaatcaagatgtttgtctttatatcagcaaaaaccgctacttaagtgagattcctgcatcccaataaatgtatctgggcatttggtacttgagagaggattgggtttgacaacacccagaagctaatgaggatgtgccttctctcagacctttgcattcaggagcaagaaagcagaaatactttgtggactccttttcagacactttacaaaatacaaaattttaaccttgtgaaacacaaaataaatgcaggataaatgtccaaacattttagcccctactgtttttgaaactgaataaagccatgatagtgaaaaatattttcca

SEQ ID NO: 226905 - DNA, 683 bp, Homo sapiens
ttggcagggaggccatggctccttaactatccaggaaggccctctgccctcttactcagcgcttcagcagaacagggctgggctcttgatcctgagacagctgggagtctgcaaggtgtgccccatgctttccttcaatgtagagatgccttttacctcccattagagtgcttcagaggctacttagggtgccttaggaaaaggtatcgttattgttattccattagtctgtaaccttctagattttagctgaatgaaactctaaaccacttaaaacacactgggctcagtagcatacaaaatcgctctgtgcttagaggcgtctgcaaagtggtgggcgtgctgccccagtggctgtcactctggctgctgcccttatgtctccttcaagggtacatggaagagagatgagggacacatgcctaaggtcggcttctaccacattcctatcccactttctcagccggcttcctactttttcactgcctctgaaatagacacagacctgccagtcctggaaggcctcaagcctctggaaaagcgaagatcacttttccccaaagatgttaattccaaacttgtttatgttcctccttggaatgacagcttataaaaatatgtgcagtattaagagatgaagcctgagggtgaaggacaacatagtacttgacaggcaccagaat

SEQ ID NO: 226906 - DNA, 385 bp, Homo sapiens
gagaaattgtcagaggccaggttttatagggcatgctgaaattggatgttatcagtgaccagaagacccggatgcctgggaggtgaacaagccttcagctgcctttgctatgggaatacagtttccaggtactgccttgcctaacatccctttcaagtagactgccctttctattaaataaatcccttccttacttacaaggaaattctggagctgtctctgtacctgtctgtccatgaacaaatagtggaggcaaaactaataaattccagctagtgtcatggattgtggggtaacgactcactaatgggtgttagctggggagaattttgtgttagaaggggaatctcagcttggatgtgatatgctcagatttcctgtttgg

SEQ ID NO: 226907 - DNA, 415 bp, Homo sapiens
atttctcgtacttcagggacaaaaataatttggctactaacgaattagggctacctgccagtgccaacacatagtgtaggtaagaggaacactataaagaaaagctgctggcagcaaatccgttgaaactttcatatgtaacagcgtttctatttctgctcttcacatctttgaaagaaagtgtgttttagaaaagaaaatgttaaaaaacagaagatatgatctttcttaaaaatgtatgtgtagctccactttaatatttctcattgtggagatgcatggggtttcattatgtcctatgcactcttggttcccctacctttcccaatcaattctgtcacattgaccaacctaaggatcagatgcattgagagtaagtgtaatagagaagaaatgaaattcactgcatagagcc

SEQ ID NO: 226908 - DNA, 4154 bp, Homo sapiens
gccccgggtctcactctccccagcctgcccctcaacgagcctcagcctctgggcttaactgcagcctctgcgtgactgcctaggccctgaataactcactgcgaactagcgatggcaggaagtgctgggcagggaggggaaggggcagcggctggtgctggcctctgctgcctctttgccccggggacatgtgctaagagtgccaggcccctgcggagtagtgaggtactccctctgcgtgctgcagtgttcacgagtaccggctgtccagctggctggggcagcaggaggacacccacaggatcgtgctctaccaggcagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtgaggcggggagaggaggctgcctgcccgtggctccgtggttcatttcctcgaacgttcgaagcattcttcacattccccacctgattccctgacacctgcgctcctgggcccttcctgtgcttgtgaacgtgaccctgcctcacgtctccttcatcttgccctttgggcctctggtggccacggctaggaagcagccggtgcagtgggggcaggcacagggcggccatcgggctgggggctcagcgaaccccggggatgggcctgaatcagggggctcagcaaaccctggggatgggcctgacgtcaggggggctcagtgaaccctgggggatgggcctcatgtcagggctgctcagggctgaggctgaggcccccacatccagctgatgagggtgtcctcaggccagcgctgctccctcctttgggcagaaggccctgagacttttaattccggtgtcctcaggcagcccaggggcctgagagtgaggggtgtggggagtctgctcatgctcacggcccccagcccacagctctgtccagaaacccacgccctgaaggcaccatctgctgcaggatagagggaccccagtgggaacagctctgaggatgccttctggccccccacccgggcccactctctggccccccacccgggcccactctcttgcccacgtaccctctgccagtgtcctccccccagtagctgagctgtctctggggcccggtccgggcactgaggtgctgaccagtcgtatcaggcagggcctgctgcatgctggagaggatttggggtcagtttgggtcagaagtggaggaaactccccccagtcaagccaggatgcgaggtctcggccgagggtggggccctgcaccagccctgcctgacggctcctcccccaggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggtgcacccccaccctcaggagcccatgcagcccccagtgcctgtcccctcctggccccccacctcttggccctgggtcagcctccccagacacaggacaggagcgtgatgggagagggcccatctgagccccgtccgcccgcaggacctgtggattccttatttcgccatcaccaccgacatcacagcctcggccatgcgggtccacaccgacggctccctgtggcggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatggtgagtggaggcgcaagacgaagccgtggagacgtgcgtgacctcctgatgctgtgttgggcttgaacccccccaccccagaggcccacggcctcccctcccgcccacgtccacgcccaggctccagcagctggggtgcttggtggcactcctccgtcccgggcaccacgtgttcccacagcagtgggactgtgaccaccccgggtcacccagcccctgcccttcattcacctcaactcccagccacacctcaggcctgaagtagaaccacgttttgcctcccaccccacccagtgggaaatgggaatgaaggctgcttgttggaggggccgcaggacaagaagggcgggtccactaccctccatgctccatccagggccctgcgcttgggccttcagccagtggcctcctcacagcagaactggacattctcctgggagacgtcttcatggctgccgcaggccgagagggccctgggcaaggcagcccctatccacagttgccaggtctggggtgctggagccctcagggtgcttggctgacaaggggaggagtgtctgcccgctccttgtccttgtggaagacccacgaagtgatgtgctggggcaaagctggagccagacagaaccaggggtggtgtgcagggctgccctgggaccaggtggctgcgtgtagggccccgggccaccttggaggcgggggtgggcatctgtggccggttctgcctctgagtgtggctatgctgggtacggtcccttccttgggaggggactgacgcagccctaccctcggtgccagacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgttaaaa

SEQ ID NO: 226909 - DNA, 2434 bp, Homo sapiens
ggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggcagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggcggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgttaaaa

SEQ ID NO: 226910 - DNA, 1223 bp, Homo sapiens
attcggcacgcaggggctcggagagcaggctctgccccgtcccctggctctgcatgcctgtccagggggtaaccagggctggcttctccctagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgttaaaa

SEQ ID NO: 226911 - DNA, 1492 bp, Homo sapiens
ggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggcagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggcggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcacgcgacatcgccaggggatcctct

SEQ ID NO: 226912 - DNA, 921 bp, Homo sapiens
cgggtcacccagcccctgcccttcattcacctcaactcccagccacacctcaggcctgaagtagaaccacgttttgcctcccaccccacccagtgggaaatgggaatgaaggctgcttgttggaggggccgcaggacaagaagggcgggtccactaccctccatgctccatccagggccctgcgcttgggccttcagccagtggcctcctcacagcagaactggacattctcctgggagacgtcttcatggctgccgcaggccgagagggccctgggcaaggcagcccctatccacagttgccaggtctggggtgctggagccctcagggtgcttggctgacaaggggaggagtgtctgcccgctccttgtccttgtggaagacccacgaagtgatgtgctggggcaaagctggagccagacagaaccaggggtggtgtgcagggctgccctgggaccaggtggctgcgtgtagggccccgggccaccttggaggcgggggtgggcatctgtggccggttctgcctctgagtgtggctatgctgggtacggtcccttccttgggaggggactgacgcagccctaccctcggtgccagacgaatctgactaccagacggagtacgaggaggagctgctggacgtccccagggatgcatacgcagacttccagagcacctcagcccagcagggctcagacttggtgaggagctgggcatggtcccacctggtgcccacagctgagccttggtgcctggccctgtgccggccactccctccctgtggtcccaccgggttaccagcgctgcagagcccctgccctgcctggtcctcacctggaacatgcggtctgcttgcaggaggacgagtcctcactgcggcatcgacaccccagtctggctttcccaaaactgtctgagggc

SEQ ID NO: 226913 - DNA, 477 bp, Homo sapiens
ggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacagggcatgtcctggccaacgtttgtggagtgtggtttgaacgtgaactgaccctggtctgcctactaggtgctgcccaggcccagtgtgaaggctgcattctgcgccatcttcagctctcagacccgaacacctgaccctggcacaggctgcgtcttcattacagattcgaggctttcttgatctcctacctctagttggcaggaggtggggcctcctctgctttctctgcaggggtgcacagttggggggatgtctgctggtcagggggtgcacagttgggagggatgtctgctggtcagcgggtgcacagttgggggga

SEQ ID NO: 226914 - DNA, 1129 bp, Homo sapiens
ggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggcagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcgtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgttaaaa

SEQ ID NO: 226915 - DNA, 370 bp, Homo sapiens
gagtctcagggtatatatcgccaggggactactctgatgaggctttctaataatactcaggactcacggaagacttgtctgagctatcaaaattctcacattactattactatcatcatcatcatcatcatcatcatcatcatcatcatcatcattactctgagatagggtcttgctttgggacccaggctagagtgcagtggagtaatcagagctcactgcagcctccatctcctgggctcaagtgatcctcccacttcagcctccccagtagctgggactacaggcacacaccaccacacctggttaatttttttttttttttttggtagagatgggctctctcaggatctggaagaatttgctaaaa

SEQ ID NO: 226916 - DNA, 462 bp, Homo sapiens
gcaggcaggctttctcatggattcattacaaccactttgtagcccattacaaccactttgggtgtggcgtgtccatctaagaacctaaggatgatgtccaaggttagcctctagggattggagattgtctaaaaatatttgccaacaagcttcttaaaatttcaaaaaactgtatggttctctcagtgagagaccctgtactgtctgccccatccttaacacacactgtgtttctgatggtttgtttctttcaaaggctattcttactcagaagatgcttccctgtagccttggtttcctgccagagattagcagggtgtaaaagaatatttttttcttatatccacgtggaatgttcaaggcaaataaaccatttgagcatatttagagtattaatgtttttgagggttgtttactgtgatgtttgggattatgtattcctaagtggaagccacaaaagtt

SEQ ID NO: 226917 - DNA, 194 bp, Homo sapiens
caaataataattactgagcacccaccatgtgccacactctaagtcctggggtgtagcaggaaccaagcatatgcagaactgcccttcaagggcttgcactttagtgagaaggaaataaaattttataatattaattactgagcacccaccatgtgccacactctaagtcctggggtgtagcaggaaccaagcta

SEQ ID NO: 226918 - DNA, 546 bp, Homo sapiens
agcctcatcttgaaatgaaattttagctcatcctcttatatcctgaagtgttatcattagttgttgattcgttatttacatacaacaacagcaacaaaaaattttgatgtgtcctatttctctagtaagcccagtaaaattataagggcttaaagagcagacaaaatagaagatagagaaatagacagaagaaaaatgaaaggaagaaaggagaaaatacaggtattatgggagataggctgggacagagaaggaaagccaggaagaagagacagcatgagcaaaagcatgaagatcagaattcaaagaggatgctgctaagaaactacagacagagtcttgctatgttgcccagtctggtctcaaactcctggcctgaagcaatcctaccttgacctcccaaagtgctgggattacaggacacagcaagaaggcagccatctgcaggccaggaagagagcttgcccatgctggcaccctgatctgggacttttcctgtcactggaactgaaaaataaatacatgttgcataagccacccagcctg

SEQ ID NO: 226919 - DNA, 504 bp, Homo sapiens
tggaggatagggagcaccccagcaattcactggacttctattcttgtatttcagccaaaagaatgaaaaaataattaagctttattgatattagtgtatagctggaactcacttggaaatatactacaattcctaagtaaatgtacgttagcgtatatgcaagaatgttttactgatgtgccgtactatctaaatttcaagactactaattagagaaaagagttcctctattctctgacctctgtcccgctcctcactaacctttcctgtggagagattgtagttctcgaactccccatatgtgttttgtgtctgtgtatattcttaatggctacagtcctataaaacatactgtttatatttcaggactaaaattattatgctctcaaggaaggggtaacaaaaatggagcaagctttcttcttttgtgatcacccttcatcttgtgtatatgtccagcattgctctttaaagatgtacatttctatttttgtcaccctgtca

SEQ ID NO: 226920 - DNA, 233 bp, Homo sapiens
aggaagaagttcaagagatctattgtacaacatggtgattacagctaataaaaatatattgtatacttgaaaattgctaagagattagattttaaacattctcatcacaaacaaataatacttatgccaggtaaagcatatgttacatggcttgatttagccattccacaatgtatgtatctgttagaacatgttgtacaccatatatacaatttttactttcaattaaaaat

SEQ ID NO: 226921 - DNA, 458 bp, Homo sapiens
cagtttaatattttacctcttctaacctttttatgtagaacctttagaactttaaggtatatcacaaacactactctaacacattgtattgtttgggtccgtggtgtgtgtgtgtgtttgtgtgtgtatgtatgtgcgtgtgtacgcgcacatgctagtaaaactctaaggaagcagcatggagttagcagttttcttcctaagaaggaatgtaaggatttgagaatatttgatgttagacctgtgtggtgacatataatggcaggaaaatagactgttgaagtgacaaagttctgctataaaatagtcttgtttataacagaaatattaatggagttgatctcaaggattattttagttatgtgctaattaaataatttgtactatttagcaatttccatttttaaaattgttacaatcttttgactgtgtaaatcagaaaattgtaatacattgtt

SEQ ID NO: 226922 - DNA, 525 bp, Homo sapiens
tcggccaccgagcgagaccctgtctctacaaaaaataaaaatgaactgggcgtggtggtgtgcacctatcatatctagtctttggactagaaaaatctaaaatggtttggtaagactttgctgttgctttaaagcaatggtccccaacctttttggcaccagggaccagactggttttgtggaagacagtttttccactgataaagttgggggtatggtttcaagataaaactgttccacctcagatcatcaggcattcgattctcatacgcagcatgcaaccgagatcaccacgtgcacagttcaccgtaggttcactctcctacaagactccaacgctgccactgacctaacaggaggtggagctcaggcggtgatgttcgctcacctgctgctcacctcctgctgcgtggcccagttcctaacagaccacagacggatctgctggggactcctgcatataaagtaagtgtgtttggagggaaagtaactaatttaaagagattcccaccagccaattagaac

SEQ ID NO: 226923 - DNA, 276 bp, Homo sapiens
tcggctttctaatcaaattgatctgcctgctgtccctccacaccataatgactagcccttatatagtgtttgctgtgtgccagactctgttctaagggcttcacatagtacctcacttagtagttactacaaatactagtaagattttcatttccattttacaagtaaggtcagcacggagaggttaagtaacttgcccaaggttatacaactaggaaggggcgcaaagaagtactaagcagctattttgaaaaacaagttcttcacatgtagctg

SEQ ID NO: 226924 - DNA, 418 bp, Homo sapiens
actctcgtgttattcctagaggcaaagctgcgcagtcccaaaagcgatcaggttctcctcttctctcagttttacaatgaccttctctaacccaatgatagtaacagctaggacagcagaggttttgaggtacattcttggctttttttttatttgggggagtgatagaaaaaaaaaccccaaaggtactggtttctttaagcctctggaagcctccctggcctgagtccctgacccaccaagctcaaagttacatggggtctgaccctgtaggtctctaaccagagtgtagagatctcaggacagactttttgcagccacatgctcaggcacccctaacaggtctctttggggttccaggctggcttgagccccaagtctaggtctgacttggatgttttattttcttgatactact

SEQ ID NO: 226925 - DNA, 404 bp, Homo sapiens
acctacaaaagcctgccactgacattgaagaaccaatatatacaatggacaaacaatccagtgccggcggggtgaagaggagcgtcccctgtgattccaacgaggccaacgagatgatgccggagaccccaactggggactcagacccgcaacctgctcctaaaaaaatgaaaacatctgagtcctcgaccatactagtggttcgctacaggaggaactttaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctgatggctgtgtata

SEQ ID NO: 226926 - DNA, 378 bp, Homo sapiens
tggagcgtccccagtgggctgagggcagaacagcagtggacactcccacccccttaagagaggcgggaagtggagcaagcaccatgagcccctgcaggatcctgcctgggtcccaggagtccagctgctcgggcagggcctgctccgacctcctcacatccctctgcggtggccgtgaggaataccttggggcccatgaagcacaggggcccctgttacagaaagaaccttgagcaagtggtgccatggctttgggaagggggctgttgtatgctgtcactgggattattttttctcttctctcccactgtgaaatgaactaaaaaatagttctggggggaaaaaaatgtcttggtttgcacagcttttaaaaaggca

SEQ ID NO: 226927 - DNA, 470 bp, Homo sapiens
atgaaaaactcaaaaagaacagtatactgagtgttttcaccctaagatcaagaacaagacaaggaagggcactcttgttacttctctgcaacactgtactgggatttgtagccaggacaattagacaagaaaaagaaataaaaggcaagatttcaatgggaaagaatagacttttcaacaaatgatgctgggacaactggatatccacaggagaaacaatgaagttgagcccccacctcccaccatatacaaaaattaactcaaatgaatcaattaaatgtaagagctagaatcatagacgtcttagaagaaagcataggcatagatcttcattgccttgaattaggttatgatctcttacttataacaccaaaagcacaagcaataaaagaaaaaatgaattagacttcatcaaaactcaaaacttttgtacttcttaagataccattcaagaaagtgaaaagataacc

SEQ ID NO: 226928 - DNA, 408 bp, Homo sapiens
agtaatgactgggatatttactactgggccacaggtactgggtatgataagcagcactttgggaggctgaggtgggcgggtcacccgagatcgggagtttgagaccagcctgaccaacatggcgaaaccccgtctctactaaaaatacaaaattagctaggtgtggtggcacatgcctgtaatcccagctactcaggagtctgaggcaggagaatcacttgaaccggggaggcagaggttgtggtgagctgagatcctgccattgtactcctgcctgggcaacaagagcgaaactctgtctcaaaaaaaaaaagaagcactctaaaatgttactattggatatgcaaaacagtacaaagtttgttgaagaatcattcagtaatcaataaagattaaagtgccatctca

SEQ ID NO: 226929 - DNA, 897 bp, Homo sapiens
acttaaactcattcaaagacacactgaattacatcaccacaatctaattttagaacattttcaatgccccccaaagaaactctctgcaggcctgggcaacatagtgagaccctgcctctagaaaaatttttttgattagctgggtgtggtggcactcacctgggaggctgaggtgggaggatcccaggagttagaggctgcagtgagccatgatcatgccactacacttcagcctgggcaacagagcaagaccctgtctctattgaaaaaagtggtgggaagtgggggagaaaccctgtgctacagcagtcttcctgattcctgcttacccatctcctactccatccccagacaatctctctatggattggcctattctgacatttcacatcagtcatctgttgcttaatgacagacacacatttggagaaatgtgtcattaggcaattttcttcatgtgtacacatcaaagagtgtccttacacaaacctaaatgggacaacctactgcagacctaggctgtatgacagaacctattgctcctcggctacaaacctgtacagcatgcaactctactcaacactgtaagaaactgtaacacagtggtgattgtcttaatgtgggtttccccagaagtggccctgaggaaggacttgagtgcaagtagcttcctgagaagtggcgagtggaaaaatgcagcagggaagtggagaagagagaagcggaagggaagacagttgctaaagctgcattatcacaaaagccacccctgtggaaaactggagctcggttccactggggaactcatggagccagggtgattctgatgaacagcagccttggaaacgactgccttaggggacttgctgctataaataaagaagacagatttgtaat

SEQ ID NO: 226930 - DNA, 450 bp, Homo sapiens
ataacggccactctaatagagtttattcttctccctcagattctaccttagcacccagctgactacattccagatggttgtttaaccttctgtctctcctctagactgagttatccaagggcagggaatggtacttatttatctgtgtggctccaacatctactgcaataggcatcaggaagtgacaagtaccaaatgattttcaaggagtgtgccacatagcccccaggtcctggggcggtcccgagggactctgcagtgtgagaaggggctgagctgatgagggggaggcccttggccccttcttcagtgagagaactgccttctgtgtctcattcacgtgctgaagtgggggttctgtgccatatttcatctattatctacccccataaaaaaaaaaaggattatttctaccatgttccctttccatgcatacatagagaaaaaaga

SEQ ID NO: 226931 - DNA, 607 bp, Homo sapiens
caaacaccaaagatactttgaaaactggatacagaagtgatgtattctgatggttctagcttagtatttattataatatttatttatagtatttaaatagtaattttttttatcataataaagtgagaatcacatctgaccttccttttaacttgggatgccttgagtagccgtaagaaagttgtgaagtatatcacgtggaggaaggatcacatgtctagagtaagggctgagaagcctggccgagtggctaagcttgctgcctgccgtcctctacccagattgcagatgtccggatccattcctcttcacaagtgtaaagaaaaagcaagcatgcctccactctggagctagccacccagatcttctctctggaggtctaaaattcagatgtcttccagtggcatccgtggaccaaaggtgtatttttggatgatgcagtttgtgttttcttaactttaaaaaaacaagtagacaagttaaacataagtgactacaaggggtgaagttttaccctaacaatgagttttcatttcagaggttttgtttttctttatgatttattcctgacaaacacctaccacttactagtttaccaaacagctgg

SEQ ID NO: 226932 - DNA, 365 bp, Homo sapiens
aagaagttatttcacgcattatctcatctgccttcacaaaacaactctaaaataggtatcacctccattttatagatgaaaaaactgaggctcacttgcccaaagtgtcacagctaacaaattggactgaaccaagatttaagcagcctgactccaaaacccatgtttcgcctactaaacctcttccatattaattcctcctccatattaattgcgtcgttagggtggcttgtcgacgctctcagctccccatcagtactcaagcttcctgagggcagggattctattttgttaactgctgtattctcaaagccttgaacaatgcctcatatgtaaagatactaataaatatgtgctggatgcat

SEQ ID NO: 226933 - DNA, 580 bp, Homo sapiens
agaaagaatgatgaaaagctaactgccttctggaaaaatagtattttatttaaaagggaattgacacccatggagaagttgcttggaagtaaaggcagtggctgaactatataatgtttacattttaaaagttatgagagaaataaaaacactcatacttaatttgaaaaacattaactttaaaattgccacaattgtccatcaaaaaaatttgtagaagaaagtagattagtatgaaggaaattttttatatttagaattttatctcaagaatttgagccttggccgggcgtggtggctcatgcctgtaatcccagcactttgggaggcggaggcaggcagatcgcgaggtcaggaggtcgagaccatcctagctaacacagtgaaatcccgtctctactaaaaatacaaaaaaaaaaaaaaaaattagccgggcatggtggcgggcgcctgtagtcccagctacttgggaggctgagacaggagaatggcgtgaacccaggaggcgaagcttgcagtgagctgagatcacgccactgcactccagcctgggcgacaaagtgagactccatctcaaaaa

SEQ ID NO: 226934 - DNA, 417 bp, Homo sapiens
ggcttccaatatcctgtttaacaccctctatttcaaagaacgaccagcatttactacctccttcctttcacaaagagccaaaaaacatatgttttatctaaagcccaatatttccgtctaattgcaaactcaacaaaagtgccataagcactattcaacacattcagggatttttagttaactcagaaagatcaaaccgttttcatgccaacctctttagatatttcctatttaaggaagaaagggtcacaaagaggtttttaatgacctgatgagccttctagaacagccaatatttatagaaatatttcacaaagtcctaacaaagcagtccattttcaaacgctcttagagtatgactgccaaactgattgtattccaaactgattgtattctatatcttaggtaaacagaata

SEQ ID NO: 226935 - DNA, 323 bp, Homo sapiens
aaaagacaacatatgaaactttgtgggatgcaattaaagcaggctgagggggaaattgacagtatgaaatgctgcgttagaaaagacaaaacatctcaaaccagtaatctaagctcataaccttatatgactagaaagagaagagcaaaataaatccaaagcaactagaaagaaggaaatggtatagatcagaaatcaatgaaattaaaaatagaaaaacatttgaggaaattaatgaaatgaaaggctagatctggccaggcgaggtggctcacgcctataatcccaacactttgggaggccgaggtgggcagatcacttgc

SEQ ID NO: 226936 - DNA, 418 bp, Homo sapiens
tctttttaaattgatgcacaattcatttgggtgctttctatgacacgcagtcagacttgcctccttcctgtgtgggctctgactatctaataaaagagataatgtaatgacttacatatctagaacacaaggtaatgattccattaccaggcatatccctgttctgatttgcagacagtttaatttttacatctgatctttaactagtgcttcagatgaagcagaactgggtatttgaaaggaatttaatttgttttgcccattttaatggtagttttttctgagtgtatttaaagagctttttataactaccatcttccaatttttaaaatggaaatatattttctattgcttatttttttttactgcaaagccttatttgtttattttagaaaaattagaaaatactgcaaagaaa

SEQ ID NO: 226937 - DNA, 451 bp, Homo sapiens
cgaaagtggaagcaagtgaaacggggggaggttccaagctgtttttcagaatcagctctcacagaaactaacagagctacagctctgtcgttaccatgacaccaagccattcatgaggagcctaccccatgacccaaataccttccattaggtaccatcttcaacattgcaaatcagatttcgacagcaggtttgaggggacaaacacccaagctataacaacttggaaactagaaataaacttctaggtaatccataagccaataaagaagtcctaagataatttttaaaaattacattgaactaaataataaaaatacacatagcaagatgtctgagacccaactacaaattttgagaaggaaatatataattactaaatgctcactcactagaaaagataaaaaattcaaataaataatcaaagctatcatctcatgtctcttccaaa

SEQ ID NO: 226938 - DNA, 602 bp, Homo sapiens
agctcacacttaacccagcaggaggctgcgtacagattgagtaattctccacaacatacctactgctatgtaaactaaagtcaccgtttattcttcattaaattgccaggatgctttctgttggctagtccgtgtggatgctttgttctctgtgtccccacccaatgcccctgtgccttccttactcaccttgcttttctcttagagtaaaactgggtactgtaactctattaagatgttattgtgtttaagagaataatttaaaagcatcactttggttaaaaatgtaatgtttcctaaaaacaagtggaacaaggatttgattagtcaatttaccgaatatcatgaaacaaataccagaatacttaagggtagatgataattatgcagttttctggaaaacaaaagaaaattgtaaagcagataaaagtactaacaaaccaaccatactgagatcttagagaagttgccattctaacatcttgtggttggtattcaatgcataggtatttttctcatcatctcatcagcttcaaagcaaaacatggaccccagctttctttaggaagccgatatgaaaactatacttcataatattgctt

SEQ ID NO: 226939 - DNA, 286 bp, Homo sapiens
tctgtatgtgcagggcccgagtctagagaaggccgcttggtctgccttctgcatgctcagaatcactgtcaactctagttactgcatcttgagctgccctgagttctccagatgcacccagagccgctgcctttagccatggctcgatggtctcaccccagggtttggctttggggactggggcaggtgctgtgcagagcagctttgattccaggtcagaacttgctaattggactttttgttttcttggcacttggtcatttttccccaagcatgagaagttaaa

SEQ ID NO: 226940 - DNA, 202 bp, Homo sapiens
gggttgcaccgtgttgcccaggctggtctcgaactcctgagctcaagcaatcctcctgtctcagcctccgaaagtgctagattacaggcgtgagccactacgcccagccgtaagccttccttaagttagccattatcattgggtgtcctggttcaaaaacccgacgtggccaagtttgttggtgggggtggttgttttttct

SEQ ID NO: 226941 - DNA, 307 bp, Homo sapiens
tccctttttttttttttaaaaaaaaggtcaaattccttagcccttgtagcagaagaggtttgaggaagagaattccagcagaatcctgtaataacacgcctcggcatgacatggatcaggatagaccccctgagtaagctcatgccacagtgggaggaacctccccttcaggggagtctgggctgggctctgggcccaggcactgccctgggggtcagaggccattccagcatctagctcagtgtgaggcactgttctaagtgcagggaaccacagtatggggtcaggttcatgtcctgtttctgcc

SEQ ID NO: 226942 - DNA, 409 bp, Homo sapiens
caactctgccttttagcaagacacagagatacgacataactaagacttcagttaccttgacccatccacagccctaactcatcttatgtttctttccatttccagcctccgactcatctctttgccttctgaattctcactcattccttgctctggtggtaatctcccttcctcatgatgttattcctgtagcaaacacaagaccctccctggcattgacccattcaagaccctggtttcccatggttctaggtccagccagcatgagtccacatggccagcatttctattgggtttatccaaacttacaaaaaggaactgactgttaggaaagccaccgacattgttgtaatggtggaatcattctacatctctaaataaaatgctacagaacctttagggctagcag

SEQ ID NO: 226943 - DNA, 799 bp, Homo sapiens
ggctaattttaattttttttgtagggatggggtctcactagtattgcccaggctggtctcgaactcctgggctccaacagtcctcctacctcggcctccaaatatgctgggattataggtgtgaaccaccacacctggcctctaatcagttttctagtctcccactcaagccttagttgagcagacaaatgaagatttccaaaaatctgaggaaaacctccagtatagaacatgtagactacaaagagaaaaaggcagcctggatgaaaaccgagactaaaaagggagaagaaacaaaattcagggcaaaacaaaaaacataatcctaatatcttcaggaaaaaagagaaattacaatcatgaaaaaaggaaagattgctaaaaaataaaatctcagcgaacaaaaaaagaattcttataaaacatggtaatggaaattaaaaactcagtggaaggattaggagatgaagttgaggaaatctctcagaaactaggacagaaacataaatagatgggactgaagacagaaaagtagagaaaattggaagacaaatccaggatattctgtatgcataaaaggaattacaaaaaggaaaaagaaaatagagaggaggaaataagaaaatagtttagaaaatttccccaaactcaaaacatgagtttgcaggttgaaaaggtcccctgagtgcttagcatgctggctgaaaatagacctgcaccaaggcctagcatcatgaaatactgagactctgagagaaaatcaaagagtttacaggtttctgcaataataataataata

SEQ ID NO: 226944 - DNA, 672 bp, Homo sapiens
atgactgggttagggactcagaaagaataagagaaacatcatataattgacttatatttggctagttttagtagaaaatatcactgtccctctcctaatagatagccaaaaaaaacccttcttcaagagtaatgtgtatggttgcaagtccagtaatgaaaaaagaaaaggaggaaagaaataaaatcttacaatgtgggttccaggaaaatgtcatgatgaatgactccatgagtggcaatcaaacagaaagactgtgacattaatatttataatattgtaattagcaagataatgcctaagcagcattattagtgtaactaatcatattatcataaactgactctgcagtatttagacagtgagtgttcttgcctttatcaatgactatcaatatcctaaggttgcttataactaaaaaaaattcacaaatgactttacaatcattcgatgtaaatatctcaaggaaattgtctctgacatgatagtttatgaccatctataaaatcattgtctcaaatttgggtggttgccatgtgagcggaaatggaagtagctgcattgcactgtcatgttttgtctttaaaggattttcacactcgtttcaaaacttacatattcaaataaaagatgggtaatgatgaagacaacttgtgtcaatgacataaatgg

SEQ ID NO: 226945 - DNA, 427 bp, Homo sapiens
acagtggggcagctgcaagccctggaccaggttagcatctaaaggcaaagcagcaataaggattaaacaaaatgaacttaaaggtttcattgtccatcatgccatgtgagactatctgggtcatctttaggggtagccccatgtgctgaaaacctgataacgcactgaatgcgtgtgtttcagcttcacttgtcatgaaggagagtgggcagctgctttttggggaagaactcctcagctgtacagcccaaaggcagcaatgagaaacaggaaggatgcactggcccttgctgtctaacacgtgtcactgatggtaagttacgtgtgactgatgataagttacgtgtgactcatggtaagttattcttcattgggaacttttattatttatttatttatttatttatttattttgagatggagcctc

SEQ ID NO: 226946 - DNA, 419 bp, Homo sapiens
cagtattttctgctttttgaaaactgagtgataattcctgtacttttgtgtctactgaatgatttggtgacacaaatttcgattacttttacctagtggcttgcagtaacaatgctacaataattatgtgaaagttaatgtaatatatttgctgcattctgttttattagtctactttttcacctttatactcataccaaattattttaattctgtagctttttgatgtgttttgaaatcagaaatggtattgcctgtaacattgttcctgtttttgaagattgctgggtactttattgtctgtttggattccatatacttttaaatttgttgtttttatttctttgaaaatgcagtgagtcatttgaaagacattgcattaaatctgtagattaaattgagcagtaaagacatcttca

SEQ ID NO: 226947 - DNA, 520 bp, Homo sapiens
ctcatagatgtggttgcacctggcaaggagcccagctgcagaaataagcaggcaaacgcgagtttctgagccagttccagcccggcccagatgttggcccctgacaactagctgtggctggtgcggagggaggagcgagggaagaggggcagatcgaggctgccaggtgagcatcctccatacagctcctgcttttctgctacaaccccagtcccgtccagcccggatgaccggggaggctcactattgggttataacaaccattccctcgccccgactcattcctgcggaccacggccggaatcctgaactgcccctctttgcctgtaactgtttgcaacacagtccccatctccgaataaccaaattttctcctttaatgaagggttgctaaagtcaaggtcaatcacaatgatgaatcatttccttgggggcttctctgattccccacccggccgccccttcgttccacactttccctttcaagcatactcaaactccaggtttccacctgcggccg

SEQ ID NO: 226948 - DNA, 547 bp, Homo sapiens
ctcatagatgtggttgcacctggcaaggagcccagctgcagaaataagcaggcaaacgcgagtttctgagccagttccagcccggcccagatgttggcccctgacaactagctgtggctggtgcggagggaggagcgagggaagaggggcagatcgaggctgccagaaacatatgaagctcatttctgccacccttcctagaaaactggttcctgacagagacatgtggaaaggtatctgcacaagaaaaagtgaaaacatatgtccaagcaaggattgtttacaaatgtgcatagcagttttgttaataatagccccaaactggaaacaatccaaatattcatcaacagacggatacagtgtagtatagtgaaacaatggactagcattcaactaaaaggagcaagctactaatacatgtagcaatgtgcataaatcgcaaaaactatgttgtgtacaaggcaaacacaaatgagtacatactatatgatcccatgtatataaaattctggaaaatgcaaactaatataaagtgacacaacctaaa

SEQ ID NO: 226949 - DNA, 629 bp, Homo sapiens
ttcttttgttttcagatggaatctcttattggccaggctggagtacagtggcacaatcacggctcactgaagccttgagttcccaggcctctaacctcggcctcccaaggaactggaccacctgggaccgcaggtgtgcaccaccatgcctggctaatttttatcgtttctagagacaggatctcactatgttacccaggctggtcttgaattcctgggctcaagctattctcccatcatggcctcccaaagtgttgggattacaggcgtgagccactgcacctagccttaggttttaaatcccatctcagctacttactatcatctgtgtttccatgggaacaatttgtcacctcccagagctcagttgtcacacttttgaaatgggtttcaaaacaaacactcattagtaataatggaccaagcaatataccctcataggaccctaaatcaagggtatcaaatcaaatccatcagaaggacagccccaccccaaccccaaccctacacaaacaagtagcagatcacacttctttgtaacaaatgattgtcatttggtagcagaatcacctttaccttattccctcttgagagtcctttctcttaagggaacccgagatcagctactg

SEQ ID NO: 226950 - DNA, 336 bp, Homo sapiens
caggactttatcatcttcagaattttctgtaaaaacgtgactattaaagaatgacttcttatttcttgtgaattcatttattttgcaataactaattccaggtagggtaggaatggaataggaggacttctaattctcaaatgtcaggagaggatataattttcagaacatgagtcatattctggagaggttaggccttggtaggtgcttgcctatggagtaggggttgggtgcaccagccagccaggtggtaccatgagggtactctgaccctatagcctggggttgggattcaagtgaaacaacagaaagtagggggagtgtcagaaaggaaag

SEQ ID NO: 226951 - DNA, 881 bp, Homo sapiens
catgatttgatggacagtgggaagctacggaaagtcttggagcaatagcgagttgatgagcactgaagtgaagaatgctggtcacagttttggagaggcttggttggaggagtggagaccttaagagatgtctcgatttttactcatgggattttaattgatacaggcgatgcatgacagcatggagacattgcttcttcctggtgtcatcgcaagaagctttactacttgtaattcccaagagaagggagcacaccaggccacagggccatagggatgcaccagtgttggtcaggaggcagaagggagccaggggcacgctcagcgcagaggcttcgtcgtgtttctgggggaaagggaaggcagggcaaggcaaacaggctagtcctgggaacagcagtctctcctcagtcagcaagcccacaaagccagagcatcaagaatacagaagataagaagcagttaccacaataagaaagagttaatacaattggccctgtgatgaagggatgctcaacagacaaatgcagaatctaagaaagcccagaacaggaggcggtgcagaactggctgtgtgattctgaggggcctcggtgtggctttcttcgtatttctgtttggggctcattgtttcttggatctgtgggtttgtatagtttcatctaatttggacaaattttagccattgtttctttgaaaactttttcctcattatttccctccaattatatagctcatttatattttattcatttttttattgtctcctgttttattttggatagtttctattgctgttttcctctgtagtatctgtctaatctatagtaattccattcagtgcgtcctttttttaaaaaaaaaacaaaacaaaacagagt

SEQ ID NO: 226952 - DNA, 473 bp, Homo sapiens
attgttcatttaatttcagccttattccttcataaggggttttaccacatgaagtcatccgatgaccctagctcttattgtgaagttgaagatgactggagtatacttacaaatgttacaacttaaaaatgttacaaaacatttattaaagctcatatttaaagtagagcatccagtttgagaagtagacatcaattattaaagatgtcttttttctccccatttaactagttaaaaccatgatgtgtaaatgtagaagtagaataatcatatggaattccctaaaatatttctgtttactaacatatattgaccaagtacatcaagcaggagagctcttccttcattctgttatagtccacatcattctaattttgctcagttgttattaaaagcatattcctaaaccatacacttttgtttcaataaagttttattttgttgggatgaataaaatatcaaagttataagct

SEQ ID NO: 226953 - DNA, 250 bp, Homo sapiens
tgcgcccggctgcctttccaggtgcttttataccattatcgtttttatcatgtcaacaatgtcttggaataaacagactaccaacccgagctggaatacttgggctgtatttttatgatgatggtcatttctatgaagggatttgactgatttagtttcttcactcataaatgtatattgggcccctaccgtatgttgtcactgccaggtgccagggatgtaaaagtggacaggatggcctggacgtcta

SEQ ID NO: 226954 - DNA, 448 bp, Homo sapiens
ccggtggtgacggggccgcgctgctgagcgcaagggctctgaagttccagcttagccctgaggtttggtgatagcagccattgtgttctttctacctgtggagccagcatgcaccttcggaaacaattgatgtactctgccccagaatatgcagccacagtggagtcaccagagtgagacgaaggggacctcttgtatcttgaagaaatcctgtagaatagaacaaatcttaaatgtcttcttcaagcaaagaagccagtcccagagcaataaataaagtttatttattgctatatatatatatatagcaatatatatttatattatttatttgttatatatatatgtaagaatgtaggtatacatacatgtgtctgtgtgtacatgaatgaaaatgtatgtaaatcatgtaaatctcctaataaaggctggaaaatacaaaaaaaat

SEQ ID NO: 226955 - DNA, 241 bp, Homo sapiens
cctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccata

SEQ ID NO: 226956 - DNA, 386 bp, Homo sapiens
tgtgtgctttttatgaagctaaacagatgatgatcatgatctaagcactagctttggaaggcaattgtagtggatggaaagggtcagggtggattctacgccagatgtcagcctgcagaggctgtgattccaggcttcacttggttgaagtgaccagtctggccagctttgctaggcctcctctttctgactcactgttcccatggatctctggaagctgctggttcttacgtgtctacgaagagaagcagcttatttcctggggtgaggcatgcccagagaagatttacttctcaaaaggcctacttgaatgtagttcacaagcctggctgtgcctcagcatcacccgtacagcttaaaaagaaattacacacacggaaccacat

SEQ ID NO: 226957 - DNA, 609 bp, Homo sapiens
tataccctgtacattgctcagcctcttgttctcctccccacttcctcctgtctcttctcttttgacagctctccagagaggcctctcaccccaccttccatagctttgtctccactgagtcaaaagctgttagatcatctgtttgtcccctgagtggtccttagaatgaacagccaaatggatggcttggtggtggtgtgtgccatgcctgcaggaagctcccaaggaagcaatttccagcactttcccctctgcagcttcccaccaagctatgcgaaaacatatcaatgatttgactgcaacgtccctgacagctgttaacttggaaaatacaaacaatgacgacgaccgtgaatgtgagttatttctgtgatttctcttttcattaaagtccatccagtcaccagtttgagcctgtcacaaatctgcttctctcccacacgaccttctctggccactgactgcattttcaaaagtagcccaaggccagagaacagctgtttgctgattccctcgagaacaaattgcaaattgtgcatcatcggcatgtgctcttggcttctttgaaggatgcgttgaaatgtgccaaatggcaaatgagaatcacag

SEQ ID NO: 226958 - DNA, 365 bp, Homo sapiens
cgtcgacgttttattagcatttgagtattttatttctttttgaatgtttcattgcttttcctgaagtggcattgtcttagtctgtttggctcatcatgtagtaatttgtgcctctcccagattacccattttgctgatgtcaccaaatcttgaatccctccagttcagtgtcagcagggaacaaaatttccagtctcttaacctgggtgtgtgtgtgtgtgtgtgtgtgtgtctgtgtgtgtactgctcaggcaggcttctgaatgttgatattttgcatatgtgataagagggtttcgagtcttttgattaaagacttccaaatgaccccttgctttttgccctgctcccctcaactgcttctc

SEQ ID NO: 226959 - DNA, 1118 bp, Homo sapiens
caaatgagatcatctctgtcatgtgcctcacgcctcacagggactccatgtgtgaagattcccccttcactcaccagatcatctccatggcaacagcttgcagcctgctcttggagtgctttgttttggcagcttctctgctagtttgtgtatggagtgaatggaggaggtaaatccacagattaagaatatgctgtcaggagtcaggcagccaaggtcagaagccagctctgcttctcagtggtaaggtgcttgacttctacatctcaattttcacccactttgtacttttttcctaaattaaatgagtataatagtagtacctacttgataggacttttgtgaaaattaaatgatataatgcacctaaaaacagtactgttacaactaataggaaaggctttgattattaatggatgagagtagaaagcttggtgcatttattgtctcatctactataacagagttggtgtgagaattagtattatcatcctccctttattgaccaggaaaccagctcattgagattgagtcatctgctggtaaatggtctcattaagaggtggacccatatttctctagctttctctttacaacacaggactttgcaaggaacatataattctgtgactagcgccatttggaaaatgttgaaactgaagtagagatgagagatcttacgtctgcctacccagtgagatacgaggaaggtcaagggaaaaaaaattccaagctcttctttatctgctataggaaatgaacattcaattttttgcatgcaacgacaagaggtcaaggaccccagaagccagcccgctacttccaagttgagagcccctggtcataccctccagttgagctcagatttgtcacaaatttacccctctcctttccttccattccccatgacctgcagagagagatgtcagataccttcctcttggcctcccatgggcatccataagaaacttacttgaagcaagaagcccagtataggtgtctgggcagttggacatttcctctagccagatctgtccgaatagagccatctgggtacatgacgcagagggcatttgataaataactggaaaagtcaataaatctttgctacccttcac

SEQ ID NO: 226960 - DNA, 302 bp, Homo sapiens
ccagggcctccccttcagtttcattatctcctttgactctgcccacaacctttgaaaaggtctcgctgttcttcccacggagagagaggtgcaaggcttgctcagcctcacacagccaatccgtggcaaaggatggcgggaattcaggtggccccaatctcaacccatcctcttcccaccctgtatcctttttagtttatttacaggaaaacatgttcaaaggtataattactaaagtgctcctggttacacaataatacgtctttactgaaaaacaataaattaatgagaaaagagatgca

SEQ ID NO: 226961 - DNA, 385 bp, Homo sapiens
aaagtaaggtttttttctcagtcaccctttaaaacacatttgtttttggctgggtgcggtggctcctgcctgtaatcccagcactctgggaggctgaggcccgtggatcacttgcggtcaggagttcaagactatcctggtcaacatgctgaaaccttgtctctactaaaaatacaaaaaaattagccagtcgcagtggcaggtgcctgtagtcccagctacgcgggaggctgagggaggagaattacttgaaccgtggaggtagaggttgtagtgagccgagattgtgccactgtactccatcctgggtgacagagcaagactccatctcaaaacaaaataaaacgtatatcgttttcattattgctttgaagaccactttcaa

SEQ ID NO: 226962 - DNA, 418 bp, Homo sapiens
agtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaa

SEQ ID NO: 226963 - DNA, 335 bp, Homo sapiens
  misc_feature (211)..(211): n is a, c, g, or t
ctcctcaaacctcctatcctgccactcctcccctttcttattaaataccaagtcttctacttcatagaaaagagaaaccattagattagaattttctcaattcacagctccccacccctacttacccgcattggtactcatctgcctccttggcccgtcactggagaagagtcgcgccccccactaggacctcactgtgcccagacacccnaacccctgtgctctgcacctcatcaccctccttgctctctcaattctccttcctgcccaaatccaagccactcccaaaatgttatcttcctctcatcagcactgaatctcacccacactaaaaa

SEQ ID NO: 226964 - DNA, 544 bp, Homo sapiens
ccatgcagccacgaaacagagaagctctttattactgacatggaacatcaccaaaaaatacactgagaagtagaaaatataagtatttgcatttgatgcacagaatacttctggaagaatacataaggtcatattgacagtaacataatagcagctgccagggatgaggtctgagcctctgggaaacaggggaggaggaagatattttgttatcacttatatctttttctgtcttttaaattttatactgtatacatatattatctcttcaaaattaaataactgtttaacaaaggagaaaaagaaaagctagtaatcaaatggagatgaggtaggccacacgctccaagaggaggaaaaataccttgaatttttttccaggagcgccagggtccatggtaaagctctaccctgggccagctgcccccgcacttgcacctgggcacaggaagttgatgttcgcagaattaagaactttttttgtctcaatgcgtgaatggttaaagaaactgtgttaaactatggtgcctccatgctactcagc

SEQ ID NO: 226965 - DNA, 596 bp, Homo sapiens
aatagcctcatagttctttctgggaactggtccactgcaagaatgagtgcagctttaataattcactccacaagttctgaggttgcatcttacatgatttctggattacgtatttaaccatgcatttgcggcagtccttgtaactttcaagacttttgcttttttagtatttataaaagatgctttgagacctttaaagcgtgaatctaaacgaatgtcacaaaaagtctttgctctcttggcttttgctttcataagcaggaaaggctcaaataaggatgttagcctcgtggagtattctcaatggccaggagaaaggtgagaagtagctgattcacttggagggatcctaaggtggaaatggaccattggcagtctttccccatcttctgaaaaggcacagcttttcctctgaatgggtacatcatggagcagagtatataacaaactctcagaagacatgagttcaagcgttggttctgccaagaaaggaacttgatctctaagtcttagtttgtttaactgaaactgaaattaatagtacctttcccacctgtctcacagggtcataagaggatcagggagaaattgcagga

SEQ ID NO: 226966 - DNA, 501 bp, Homo sapiens
tcttcccaactagagctgcaactgcggaagttccactgcagcttctgcctccccacttgaggatgactttgatgggtaagtctgtaaggaccagtccttttcaactgcacatttctctttgagatctgcccacaggcagaaaacacttgggtgctttgccctccagcatggcctgggactggatggttaaatctaattctggggttcagtgttactaagctctttatgctgttctcttaaatcaccttctctccaatagttctatggatggaaagggctgctattttgatctccatgtgcttggctcctttgtctgtttctcaattggttgagaaataaggcaggaaaaagacccctcaaactccaacaatactcaagaataaaaagagttttgttataaagaactactaagaaaaataaagggtaataaaaactgtatgaattaactctaatcagaccacttgtctaacacatttgaggggattaagttcaaaaaaaaaa

SEQ ID NO: 226967 - DNA, 303 bp, Homo sapiens
cttcggaaaatctcaaattggtttctgtggccctctggtttgaatctgagatctgaactgttctgtggttagggagtgaaataagaaatgcttagtttgaaatctaggctcccgatgcaatttcataccccctgtttaaaacacacactctctaaaaatgcttttaagtaagttttcaaaccaaagatatatttttagatttcagtctttatttttgaaacaccctttgtagagaataccacagggacaaaatcaatttataatcctgaatagctcaaatatcactctttggttttatactaa

SEQ ID NO: 226968 - DNA, 3287 bp, Homo sapiens
agtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccagttgtctttccagaagttcatcccagcggtaatatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaattaaacagggacttcagaaagccgcacagaaagatcaccttctgatggtgtgatgtgctcctgacattcggccgaggtctgtattctgaaaaagatttaatggcctgtgaaacacgtggattctgttgcactggatttgtaataaatgacgctgaacttcctgcttccaagcagctcaaccctgatgctgaactgacaccaggcgaatgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaatatttattaatctgtatgtgttttaaaataaaataacttatttctagctgaaaaaaaaaaga

SEQ ID NO: 226969 - DNA, 1132 bp, Homo sapiens
agtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccaagaagaccagaatttcatcggggatcctctag

SEQ ID NO: 226970 - DNA, 3861 bp, Homo sapiens
agtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccagttgtctttccagaagttcatcccagcggtaatatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaattaaacagggacttcagaaagccgcacagaaagatcaccttctgatggtgtgatgtgctcctgacattcggccgaggtctgtattctgaaaaagatttaatggcctgtgaaacacgtggattctgttgcactggatttgtaataaatgacgctgaacttcctgcttccaagcagctcaaccctgatgctgaactgacaccaggcgaatgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaaaaaaaaaaaaaaaaaaaaaaaaaaaaaaaaaaaaaaaaaaaaaaaaaaaaaaaaaaaaaaaagggggggccccccaaaaaaaccccccgggggggcccatcccccccacgtttttctggcgaacaaagggggcccccaaataggggcggcgtgctattaaaaaccacagacgcaggggccggcgtgataacacacggcgcgtcggggaaaacaccggctccgccgggcgacaccctgggagaaagacccccacctccgcgggggccgcgcaacttggcgacccacccacgacgaggatttacgcgcgggcggaacaaccctggcgcagcaaaccggtgacaccacccgcgaaaatgtcgtcgccgcggagaaaaacctcgccccacgcggagtatgatctgagacattttccaggcggggctctctatacacaccggcaccccaccgacacacacgcccacccagcccccgaccacgacgcgcacgccccacccgcccacgccgcccacccacacagcccgttacccaccccaccccacgccaccccccccgcagccccccacaccccctcgccaccaacgcccgacccccaccggcggcagcaagaccccaccaaaccccaccacgcgccacccc

SEQ ID NO: 226971 - DNA, 630 bp, Homo sapiens
aaaaatcttcatatcttcatctccatctactctttagggctttaaattcagttaatccattacttgcataaagttagtaaaaacaaagaatatttaattttgaagagtattagctagcattgttgagtaggaaagaacaggaaaaccaagtaaatctctctggatggttttgcttgtggatatgcgtgtagtaatagaaaatgcaactgaactctaaataataaaatacttcctgtagggcaaatacagccagaaaaattggaaagcagatcaataagattactacatatctttaagccactgaaaacaagagctagacgttggaatgtattagcaaagtagctatgtctagacacttcatgttaactatattatataacttttactcttggatactttactggtagggaaatggataaaatgatcctcactgatgccttctaatactggtgccttacagagcagaggtgggtaatgtccttatttcatcaaaggatactttctctctggagagtgtaaaccatgattgattcaagtacatgcaaacagtgacttacttagtgcttctgaaaaatttctgagtcagaaggacaaaaaataaacataacaaaaaataaacatttacatcac

SEQ ID NO: 226972 - DNA, 1072 bp, Homo sapiens
gaggatcccacaatctagtttgaacagggaccctaccagccagggccatcgagacaaaaagaaacccaaatcaaaccacaagcctcggtagtggccagagatggggggggggcctgcctgcggtgggatactccaaggcttgggggttccaacagccaggacccttgaggcagggtcctcacaacagagatccagtggcccctcagacccaggtggaggggcccggcttggctgcctgaggctgcagctctcccgattgaaacccaaaccggaggagctgcctgtcacggtgcctgtgatcctgtgatccgaggcatgattgagagggggcgcggcaggagggggctgcaggcccccaggcagcccctgtgtggagcagcaggagtctgaggaggagaagggggggggggattttctctttcttcccggcctgcttatctgatcacagaggagggaagggctcccgttcaaaggcagtctccttatcagctgggggtttgtttggaacgataactgcacctggcagggaagccttcctgcaggtgggggtgcggccgcatgggcggggctggctccagggtgtgtgtgtccacacgggaacgtggctaccgctaatgctacgtgaatgtgcatcccatggtcttcgtgtgtgcaggtctgtcctccgtgtgtacacatctccaggccagtttgtgctcccacctgtgcgtgactgtgtgtgtgtgtggatgggcacagagtacatctgccctcggcacaggaaaaagaagggactcagatctgggcctggactggactgggcactgcttggcgtccacatgatgggggtccctgccaatcccacccatgtcctgtctccagagtgaagtacctggagcctgtgggaacaaggggatgggtcaggagcagaggttgtgacatcacagttcacttgtgggcacagcagggacaatggggaagaggctccatggatgctgaggtgtagccccagcgggtgttgatggagaagaaaagagcctgtggagaggccaaggcacgggccagatcaggggagcaggatgggccagctgag

SEQ ID NO: 226973 - DNA, 571 bp, Homo sapiens
gaaagacagttcaggcacctgagtggttacattatcccaagccaaagaaggagaagacaagcttgtgagtttcccacgctccctatgaaagtgatgccatattgatgtttcagctctgggcaggctgtggcaggccgaagggaccaccacggatgggctttcagccagggtctgccccactgccttcatttcatctgtcgaaaagcagcttttttctgtttcttcctttcttgttcattaatttttgcagtgttgtctcaagtcattccatttgtcattttcatttgctcccatgaccggtgttaacagaagagggtcgtgctgaacagaagtaagtgccacctgctgtgctgctgcgtgaccccgtgtgtgccactctcgcgctcccgctgcccaccgaggtgtttgcagagcctcctcttcgcttcctaaccacacacacagctgcctgcagagcctttccttacaaaaaccaaaatcaatcccaactacctgggaacagctgggtattttcccagtgagggcagcactggggcaaccctctgggccagagatacccgtggggtagaat

SEQ ID NO: 226974 - DNA, 178 bp, Homo sapiens
agtgtacattttagatacagagatacgttttagataaagatattttagatatctgtatatttttgatacagatattttaattattttttgaaaaatcattggatggacttaaataaattttcctttcttctttccttcttctttctttccttccttccttccttccttccatctttcc

SEQ ID NO: 226975 - DNA, 707 bp, Homo sapiens
attggacacctctgatgtagaaccttcattatcattataaagggtttcattctggacatttatttttgcccacccctcactccccttaccattttcatccagtcctgtgactttacgtatgatcctagtgctgatgactttaaactaatatcactagccttcatatctcctctgagatatatctgacatctctactaaaaatctagtaggcacctcagactccacatgtctaaaacgaaattcttgaatccctgcctaaaatcctgttcctcttccatttagcctctcctatcttggtgaataacactagtgtcctattaggctaaatcctttgtgtttttcagtttctctatcctctcaccctgacctccattgaaaccatcagcaaggatcatctatttcatctccaaaatatagcctgataacccccatgttggttcctgtccacctggaagtctatgatatagtttctctactttgattcttactcccttcaagatggccagtgtgaactgttaaaaatgcctatcaacgtgtgttactccactccttaaacttagttgcttctcagtgcatttcaaatacaactataccgccttaagatgcctctttctctcattttcccattttcctgttgtttttttctcttttaaatcttttaatcaagcagacataaaattatcatgtttatcaattcattatattag

SEQ ID NO: 226976 - DNA, 310 bp, Homo sapiens
tggccttgttttgtttttgatcttagggaaaaagctttcagtctttcgcaactgagtattttgttagctgtgtgttcttcatatatgacctttattgtgttaaggaagtttttcttttatttctgtttattaaatgtttttatcatgaaatggtgttgagttggggtgctcttcctgcatcagttgaaatggtcatgtgtttttttcctttcatcctattaatgtggtatattatattgattgtttttttgttttttgttttttgttttttttttgagacagagtctcactgtcacccaggctggaattc

SEQ ID NO: 226977 - DNA, 375 bp, Homo sapiens
tgtaaagaagaagggcaaataagcaaagtatctctgtttcctctttcccctaacaccctggcaaccactactttactttctgttattaaagacttgcctattctggatattccacataaattgtctcataccgtgcctggcaatctgtatcttgtctagtttcttacacagcataatgtttcaaatatttattcatgttgtagcatgcgtcagcacttcattatttctttttgagatatgatgtaactattctggaattagtagtgatgattgcacaacattgtgaatacactataaaccactcaactgtataattttaaaaggtggaattttatcatatgcaatttatatctcaatataaaaatgaaagaacac

SEQ ID NO: 226978 - DNA, 154 bp, Homo sapiens
tggtatttacatgaaatgttttaaatttctcttatttctaaatatttcatcatcaaaaatatggatttagatttctggagtagattttaaatatgagaataatgacatggtatatcttaaattttacagttgtattactcaaggggaaaggctg

SEQ ID NO: 226979 - DNA, 130 bp, Homo sapiens
gaggaagactgggctgggactgagttcccaaaaggaacaaaggaagccagggacagaatctgagggtcctgtatcacctccagaggagttatttgttgggtggctggagcccacatcctccaccacccag

SEQ ID NO: 226980 - DNA, 140 bp, Homo sapiens
cctctcctctctggagctacccatctgctagctctcctgggactcaaaaaactgctggtcccatggaaatacccactcaccctcacacagccctggcctcagtcctagctgttccttttttttttttttttttttttttt

SEQ ID NO: 226981 - DNA, 549 bp, Homo sapiens
catgaagggggttataatgttatattagcttttattatcaacatcaacaatagcaactgatacttttgtacaaactcatattacaagtactatgttcagtccttggtttaaattgacttctgtaagtttcacaactggcccatgaggtgggtgctgttatgaataatattctcagatgggagttgaataatttgcccaaggtcttccagcaagtaagggctggggagcagggttcagacccaggcaggcaggttcgagggccccggttctttactgctggatgtgttaacacacctgtttattagaccattgacagcaatctgtaaaatatgcaagaagcctggtgctaatgaaagtaattacaggcgtgagccaccacgctcagcctagaaacacttttaaagcttttctgtcatctctctgctgatcctgctaattagcgcataattcaccactgcgttgatgcaccttatttaatgtcaccattgctcaattgttgaacatttagatttttgttgatattctaaataaataatgttgtaaatatca

SEQ ID NO: 226982 - DNA, 418 bp, Homo sapiens
aggctaaggcaggggtttggcggggattacttgagcccagtggtttgaggccacagtgagctatggttgtgccattgcactccaacctgcgtgacagagtgagaccttacctcaaaaaataaatatttttggttttccttagcatcaatgtctacaagaaaatgctaggtttcttttaaaaaatgccttattccttgttttaaaagtaagagattaaatcaagaataacaggattcagtaatcccccacttctctcagagatagattgaggggagttgataaaggaacaagggaactccagagatgaggaaataatagtgggtatagtcattatggtaatagcaaatgagataccccttcacccaattccataatatcagtagggtctttttgacttctgagaataagtccctagtta

SEQ ID NO: 226983 - DNA, 483 bp, Homo sapiens
actgaatgctgatcttggctaaacttatgaagacaaaggtgatcttgttgaagaattgggcttttcccacttggtagggtgtaactaggtttagttgtggtccggcctctcgtacaaaagtgactggtgaggggagtggaggtgggtggagcccccagtcccatcaggactgctttacaaatctatgattcttcagtgtatttttgtctcccctggggatttcagagcactcatggttgatgtagtatctatctaacactctctgcagccatatgcattaagattaccacgtttatatatctgacagtttttctagacaaaagaaggtgaaatgttaacttgcctgaccaaggaccacatacccttgtagtggccataagctttaaatctctgatctctgaggtttgttttctgtttttttaatgtttaagttttaggttaagctctcagcttcacagtctgctgagtttctgtgtagtacct

SEQ ID NO: 226984 - DNA, 326 bp, Homo sapiens
gtggggagcagggggttgcctcagcttcctccccgttatctcaacggtcccgcccaccagccctgagccaagcctgtttcgtcactgagaagagggtacagttggcttcacagtgatgcgacaaagcccacaaacagcaggtgctcaatacatgcttgagtggaggcccctaaggcagggcttgggctgctcctgcctcctagctcccttggtttcatccctaagaccagacccactgcctctaaccctgcaggactagggtgtcactaggtgaggcctcttgggtgacccggatgtttgatgaatgaataaatgattggagccaa

SEQ ID NO: 226985 - DNA, 364 bp, Homo sapiens
attaagcacacatcatatacctgtcttcaatttccttagaactgaagagtgtgactattctgagattgtttatcctgttttctaaattcaaataccgccaaacattgttaagttacaacttatgaaaaacatgtatcgatgaaaagtcagattgattgcttccttcagagacattctttgatgttttatttccttagtaaaatttatctcaaaaagagatttgcatgcacaattccatgtcttctccctaatttccacaaattcttcagaagaaccagaatcagctttcagtgatttgttgcctcctattaagccatagagtgttccaatttctgtctcttcctgtgttttggtgccagctctt

SEQ ID NO: 226986 - DNA, 424 bp, Homo sapiens
agatagctaaagctggaagaaaataaactccgaagttcaaactgtgttcctgtatttgttagctctcaagggaattgagggtgaagaaggagctaaaggcaggagctttggcaagatatcatcaagccaaatatcagataatctcatatgtttaactaagctgagttaattaaataatgattgcccaagatttttccacctcgaacatccaaataacgacagatgtctgacaccaaaaacacaaccctagaagttggagtcaacagttcagttccaagtcctatcacaaaagtattaagcacggaaattatctgcaatatagcaaaacaaatttaaaatgattttgtaaaagaatgtagaaggaaggagaccttgaagcatgagaatggtaataaaaatattattgcaaattcaagatatataa

SEQ ID NO: 226987 - DNA, 575 bp, Homo sapiens
catgaaaatggtgatagccttcctcctcctttttattattaactttatttccactttaataggagattggatcttccttgaggtagagaattatcaggtcatgatgtttattatgatgattttacttgcctttccctcaggccactcatttattataattttgggaaacaacaagctaagacagagctccttgagactactgtggcatcttaaattctctctgaaaaaagcaaaacctttaacttcatagacaaaatttaactttctgcatctatgaaagaaataatagaagacctcataagttaattttatatttaacaatttcttttttggagtccttttaagtgttgttaaataattctgaaattttccttaaaatattcactaaccatattttctcaaagttgccggacataatgtctgattcaaggaaatgtctctactataataatgcctgctagtaacaatagagtatgtgagacttggagaaaaagataaacatttataatggaatataaataaatgcacatatgatatacaaggcaatatgaataaatatatataaaatcacagaa

SEQ ID NO: 226988 - DNA, 456 bp, Homo sapiens
caatcaataaattgataaattggatttaataaaaattaagaacttttgtgtatcaaggacattgtcaagaatgtgaaaagacagcatatagaatggaagaagatatttgcaaatcctatatctgataaaggtttaatatccagaatatgtaaggaactcctgcagctcaacaacagaaagccagttaaatcaattttgaaatgagcaaacgcctgtaaacccagctgcttggcagattgagacaggaggattgcttgaggctaggagttcaagaccaacctggacaacatttttttaattagctgggtgtggtggcatattcctgtagtcccagctacatgggagaccgaggcaggaggatcacttggggccaggcagtcaaggctgccgtgagctgtgattatgccactgcatcccagcctgggcgacagagtgagaccctgtctgagaaaaaaa

SEQ ID NO: 226989 - DNA, 516 bp, Homo sapiens
aaggaagtatgctcgtgtttgattatagagggcttccttagatcctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtctcagcctcctgatagctgggattacagatctcctggatgttgtgggtggacctcacccaatcagttgaaggccttgagagcaaaacctgatgtttcccggagaagaatttcttcatcaagcctgcagcatcaactccttgcttgaggttacagcgtgccagcctgttctatacattttagatttgccaatccccacgataatgtgagccaattcattcaaataaatatctccttctctctctttc

SEQ ID NO: 226990 - DNA, 561 bp, Homo sapiens
agttctggtaatcactactctttctaataaaaataatacaaaaacatgatccagttttacatttagcaaattgttcataaaaaaggtggtggtactcttagtaccagcctctcttggggaaaataaacaccttatgaatcattaccttgccctttcaatgcaacctagatacacagcagctctcctttcctcttattagcatgagacattgtctccttataccaagtaaggcttcccttcaaaacctcaatctgtgaactccttgcagatttggggtggttaataaatgggctgactcctcttctcgggcacctctttatctagaggccatttccaacccagtgatgtactggtgtacaatggaaggacccacttctgtatatagcttcctttgcttctctatctccggagagagacacaagctggtggccaagggcaggcatgggagggagacttctcacaactcacccttttgaaccttttgaatttttgaaacattatgaatgtattacctagtcaaaaacaaacatttaaaagaaaaaataaagaatccattctcta

SEQ ID NO: 226991 - DNA, 563 bp, Homo sapiens
atcccaacaatgttaataagcatcctgggtgagtttttaaattgaaagctagtttgatagtctccagagccaggatgttttgccatgaacttatatagagttatgcagttctctccttaaatgaagttatggaccctcctgatactgctcagcctgcagagctctggtttccagcatgtgagagtttctgcagctaaaaaaaaacacacacaaaaaaagggaaatcatgttctttgtagcaacaaggaggcagctggaggccattatactcagtgaattaacccaggaaaagaaaaccaaatactgcatgttctcacttacaggtggaagctaaacactggatagtcatggacataaagatggggcctactagaatggggagggaggggagcaaggtttgaaaaactgttgggtagtatactcactacctgggtgatagggatcattcatattccaaacctcagtatcatgcagtatacccatgtaacaaacctgtgcatataccccctgatctaaaataaaagttgaaattaaaaaaaaaaggcgccgtggatcctctagaa

SEQ ID NO: 226992 - DNA, 923 bp, Homo sapiens
aatgtcttttctctccattgaactgtcttggtactctgttttaagtatctgagtgggtctatttctggattctctattctttattcctggtctgttaacgtggtaagttacaactgattttcaaatgttgcagcttcgcagtcctgagataaatctttgtcatcatatacaatccttcttctgaagtgctggcttctacatctaataaacattactacgtttatgttcatgggggacaatgatctataattttcttgtaacgatccagtcacagttggtatttcagttatttggccttggttatagggtcagcaaatatttcctcttcctgtattctctgaattttctttttttctttttgagatggagtcttgctctgtcgtcaggctggagtgcagtggcgtgctcttggttcattgcaacctctacctctcaggctcaagcaatccccccacctcagcctctggagcagctgggattacaggagtgtgccaccatgcttgcctaatttttttttttttgtagagccagggtttagctatgttgcccaggctggtctccaactcctgagctcaagcaatcctcctgccatggcctcccaaagtgctaacgtctttgtactccaggctgggcagcagagcaggactcagtctcaaaaacaaaacaaaacaaaacaaaacaaaaaccaaaccaaccaaccaaatggaaaaaaaaaaaaaaaaaaaacttactaaaaagcaataataagggtgggcatggtggttcccaacactttgggaggcggaggcaggcagactgaacccaggagttcgagatcagcctggataacatgctgagatgctgtgtttaccaaaaatacaaaaattagctgggcatgatggcacatgcctgtagtcccagctactagggaggttgagatggga

SEQ ID NO: 226993 - DNA, 594 bp, Homo sapiens
ctcccattgcttgtcctctggattacgcattcaatggttagagcaaatctcttccgtgagttcctgatcgtgccacacccccctcgctctactccaattctactaccaatttatgtctataatctattccaaattatttttaatttatagtttaagccaggggtcaagttttattttttccacagataaacagctgctgcaacacctctttatctgagtgggtctatttctggattctctattctttattcctggtctgttaacgtggtaagttacaactgattttcaaatgttgcagcttcgcagtcctgagataaatctttgtcatcatatacaatccttcttctgaagtgctggcttctacatctaataaacattactacgtttatgttcatgggggacaatgatctataattttcttgtaacgatccagtcacagttggtatttcagttatttggccttggttatagggtcagcaaatatttcctcttcctgtattctctgaattttctttttttctttttgagatggagtcttgctctgtcgtcaggctggaggcagtggcgcgatctcagctaactgtaacctccgcc

SEQ ID NO: 226994 - DNA, 517 bp, Homo sapiens
ggcactgaaatgtctctctcactgcagcttgaagctggtattcccggtgagttggagcagatgcaggaagaccagtgggtctccagggaattcacctggtttcctctctattcgaatctggcagctggcttagttcttgggatagcgttagtgctgaataaatatttgtttcagtgaatgaatgatctaaactgatgattgtggagatggggagacttagacggattttaggcatacttaggagagaaggttgacatttgttgctgcctggtctggggaggtcaccatccaggcacccttgctgattgtggttgggactccatgtctgggttcaacttcacagtgacctcagccgggacgactggagcccgttggctctgcccatggtttccatatagaagattaaattttctctcatatttccctcctggccttttatttctgcctcccgcattccccagtgttccccagttgtatcctagtcaatttagaattaacacccactaatgaaaaaaac

SEQ ID NO: 226995 - DNA, 497 bp, Homo sapiens
tgctgtagctgaccatccttgccctggagctttctttagtgtctccaccccttcatttgctgtatgaaaatgaggcaagtcaagaacacagctctggattaggtgtggatgagctgggttcctgtcctgggggatcttgaccttggagcctcagtttcctcatctgtaaagtctgggttacagtctctgtgccaccagtctcacagggctgctgtgaagctgggcctgaaagcatttttcttttaattttttaatttttaaattaactattttgtcttatggtaggacattcaaaaggtacaaaggagtatatggtgaaaagcagggccaccccctcaaacaagcaggacccctgactgaaggttcacctagtggtgaggttcctgactgtgcccccagagggagtctgtccatatgcaactatacaggaggatggactttattttcccagcaaagagagtaattgttttactctctattttgagatgactgtcgat

SEQ ID NO: 226996 - DNA, 483 bp, Homo sapiens
gattataaattacttgaaaacgaaggatcatttactttcaattccactgcaagtacatttctgtctcctttactggattataaattacttgaaaacaaaggatcatttactttcaattccactgcataagtaagtactcaaaaaagatttgacaaacataaaactttcctctcttttgtttgtttagctcagatcacagctgctgttcccactgacatggaaggccacaaaaaagcagtataagcttaacatgaaattctctggcagcagcaaagcattgttcagtattacctcaatgcttagcctgtctccctcttaacgaaatttccaggccatattactgtatggcaaaagaacacatgtggccaggtgcagaggctcacacctgtaatctcagaactttgggaagatcactttagcccaggagttaaagaccagcctgggcaacacagtgagatcccatttctacaaaaaataaaaatt

SEQ ID NO: 226997 - DNA, 438 bp, Homo sapiens
catgcttgatttttctttggcaaagtctttagatctgattctgctaaacttgggttctcaccagatgactggcttttaaaagaagatgatgttgaaactgactcttgtaaaaaaggacatttagtagaagctaatggtacggtgaagttttagagagttgaggagaaaatctgtcttagaacttaatctgtgccttttccttaatagctttcttctaagcccataaatatattggttcagggggatgagtgaaggcaaatggagggtgtggaagggagacagagaacagctcttgggcgttggagaagtgctgggacttgtgtcagtgctgcccgtgttggttttccagcgctgctgtaactaaccaccataaccttagatttattgttttatagttctgttgattagaagcctaacatgatctgcctgggctaaaat

SEQ ID NO: 226998 - DNA, 600 bp, Homo sapiens
tgaatactgtaggcagttgtgatacaatagtaaatatttgtatgtttaaacatagaaaaggtacagtaaaaattcagtataaaagattttaaaaatggtacaccagtgttgggcactaatatgaatggagcttgcaggactggaagcagctgtgagtgagtcagtgagtgggcagtgagtgaatgtgaaggcctgggacattactatacactactgtaaaccagtgattggctttagcatgggcatgtggtagagacctgactgatcaaagatacgtaaagagaggcttgagggaaatatttttctccctggataaaaagagagacatgaagatgaaccttccatccaaacaagatttctgaggaggaaaaaaaataaaaattgtattttaaaaaagataaatcttccagttttgaatatgattatgcaaggttatcttgggactctgagggtaaatttgagcgtgcttggatttttggtactgtcctagaatcacccatttctcctgacttctttttatgtgaaagttttcctctgttttacccactttggttgagtgttctgttattgcaatagttcacattagaaaaacatttacaa

SEQ ID NO: 226999 - DNA, 475 bp, Homo sapiens
cctcgtttcttttcacaaacccacccataaattttataacaggtagttaaaaattacgacaaggaagcgctggcccagcttttcacaatgggcagcggggagaatgggacggcgctgcgggcagctcaccggaaattttacttctagactgtggcacaacctgtcctgaattctccctaattgggcggggtaactttcccagccagcaggcagtcattagggcatcttatctggggaagataagactggggagaccaaaccactcgcctatccaagggtccctcaaggagcccttcaggacgctcactacctctctcacccacccccagatctcttgcaggtccgcaccttccttggctgatgcaatgagggagtggggaggaaaaaaaatttaatccagagaaacgaatttgccccccaacttaatagctgcattattccagctctacggttgagattagaataataaattcaa

SEQ ID NO: 227000 - DNA, 774 bp, Homo sapiens
cggacccctgcaacaacttaacagctttctgggccactcccaatatagctttgatgctattagaagaaaacaactctgggaaatgttcaacttactctattcagaaattagatctaaatctctcagatcgtgattgattttttgccatttgttaaatgtgttattacacatcaatgaagtattttggtaaaatgctgacagcctcatgttgaagacctaatttcaaattcaagagcaggctgcaggtcagcagaaactagctgcgtacattgcactgtcttccccagtgctatccgagggacatcaagggagaacaggagaggagagaaaagggaaggaaggaagagaatgccttgcattaaggactcgcataggaaattacccaaaatcatttcaatcatcaaagtaggtcgttgaggacaatttacaaattggctcgactctggagaaaacttttgaagaaaactctgtaacgtatagaagcctttaaaattgaactttatttggatttgtggcatttggaaaagtggtctataaaaaaatctggaattaggccctatcatatccataatctttggggaaaactaaggacattattataaattaacatttctttctatgaatttactggaattatgagcagtttttattctcttagaaaaattcgacacacagctattcattaaactaaaatagaaaaatcaagattgttgcattcgatcaagcagtaattttattttaaaaacctaataaaaaacaatttgctctgaagaa

SEQ ID NO: 227001 - DNA, 838 bp, Homo sapiens
ttgcatcactgtaccccagcctgggcgacagagtgggactctgactcaaaaaaaagaggaaatcaggcaaggccacagcagcatccaatgccagaagacaatgaagtggcgcatacagagtacactggggtacaaagtgcgactccagtgcgtggggccggtccagacaccagccaggcaccaaggcaacaagcagcttcctcccagacacacaagcccttctcaagaaatgaaacccagctcataaagaaacccaggactcaggaacgaaggacatgtaggcaaaggcctgagtgtttcttacagaatactaaatgcccacaagaattagagccacagaacaaatatgaatgtcagaaagcaatacgttgcaaaaacaatcatatatccgaaattgggaggagcttcggagtgtcatgcctttatctttcaaaacactgtaccatgtgctcttaaaaaaaaaaatcaatctaatcttttactatttttcaaaaatttgtttaaattttagtgaactctcaggaaataatgaagaaccatttatttagagctcaaaaattcctttaggcagggcgcagtggctcacacctgtaatcccagcactttgggaggccaaggtgggcagatcacgaggtcaagagattgagatcaacctggcaaacatggtgaaactctgtctctactaaaaatacaaaaattagctgtgcatggtggtgtgcacctgtaatcccagctacttggcaggctgaggcaggagaatcgcttgaacccaggaggcagaggttgcagtgagccaagatcatgccactgcactccagcttggcaacagagtgagact

SEQ ID NO: 227002 - DNA, 537 bp, Homo sapiens
gttttcccccaactcctccagccctgggcaacaaccaatcgactttccttagacaacgttttgagcccttattgggaggaattatagtcgaatggaaaatccagtttgggacgtggtgtaaactggaattgctttcgtggtttttccttgtgccttgggtggggcactgccgtaagagcattgcatccatcctttcgtcggtactctgctgcacacggatggcatttctgcccttgttacagatgaggaaactgaggctcagagacattaagcaaggggcagagtggggcttgtccatgagaccccagagtctgtgctcttgcacatacattatcaggccaacatgatctatccatccgaattccaaataaataaataaaaatgcttataagaagtccccccatgctgcggggaggcagcggctcatgcctgtaatcccaacacttagggaggcacaggtgggaggattgcttgaacccaggagtttgagaccagcccaggcaacatgacaatacctgcatctctgcaaaaacgaaa

SEQ ID NO: 227003 - DNA, 770 bp, Homo sapiens
atccatggcccaggtctgtgtttccctagacaactccctcatgcattctctgaggaaacttaacagcctttgtctcttcaggcgtccagcaccttccctgccagcttagctaaggcactcccttctgttcccacaaccaccccacattagctgccttccttaccctacctgaggacatgcctcgggtgtgtgggagatacagtgctctcaagggtctttcttctccccttctccctccatcgtgagttttcctacacgggctccttcacgccagcctccacatgtgccccacgtgtcatgggacgacacagagcaaaagcccagcaccctcagctgctcctgtcctctgccccattttatcacagctatcacagctccccggaaagctgtcttctctgtccatggcctcacctcacccagggcactggccttggtccacatcaaggggacctgaagcttccctgaagcctctagcctgtggtgtgcacgtacaagcctcaggccccatttgtccagcctgtcagcagctgggaaatactaagtcaccctcttctggttatgtttaattttccaatttttctcaacattactgaaatgtctaaatgtggaaaagttgacatcattttacagtgaacaccacatacccaccacctagattttaccattaccaatttcctgttccgtacttgtatattcacatatatccaactattcatccctgcttcaatccatcctatttttattgcatttcaaaataaactgtgaaatca

SEQ ID NO: 227004 - DNA, 341 bp, Homo sapiens
cttctttggaaataatgtggaatacatagaaatgcataggcaaacatgtcattgtgggttcatagtaccaaccaaactttcttcctcagatggcctgtgcccactttgaggataatcataaagtagccagttgactggaccacatttaatcagagtaaagtttaattcacttgtcctgagataataacttatcaagagattctgagaaaaaaagagacacaaggccaggtgatgtggctcatgcctgtgatcccacacctcaaaaggctgaggcaggaggattgcttgagcccaggagttcgagaccagcttcagcaacataatgagacccccgtctctca

SEQ ID NO: 227005 - DNA, 368 bp, Homo sapiens
agggagagggtgagaggagaaaaaaggagtacaagcagctacttaaacagagaagtgtttaccagtaaggtcaaaagcaggaagaactgaaaagtgcccttgagattgggtaacagtgacaaccttactgagaacagttctgcacagtggtgagctctgaaatccaaatgtagcatgctcactgggctgtgaatgggaatggatgactgttttacaggtaaagttaatcttcaggtttttttttatattaatgaggtcacttttttcccattgtaagtatctttaagaagagtatttctgaatctacttcttgcctctttttattatctctacattaccattgtcaccttttccataaaattagtgtt

SEQ ID NO: 227006 - DNA, 509 bp, Homo sapiens
ggctaatttttttttgtatttttagtagagacggggtttcaccgtgttagccaggatggtctcaatctcctgacctcgtgctccgccctcctcggcctcccaaagtgctgggattacaggtgtgagacactgcacccaaccacccagctaatttttatttatttttatttttagtagagacagggtctcagctagttgcccaggctagtcttggacccttgggctcaaatgattctcccacctctgcctcccagagtattaggattacaggcataagccactgcccctggcctccccaagtgattgtgatgggcctctctggttaagaaacctcaaaattagagagggagtggggttcaatactacagcacaggactcagggcaaacaggcctgggttcagatcctggctgtgccacttatgaactgtgtgatgttaggcaagttacttaacttatctgagccttggttgcctcttctgtaaaaagggagctaatagatatccactttt

SEQ ID NO: 227007 - DNA, 148 bp, Homo sapiens
ctttccaacttttatttattttattcagggggttcaggtttgttaacatgggtacattgtgtgtcacaggtatttggcgtacagataattttgtcatccaggtaattggcattgtacctgataggtagtttttcagttctcaccctcc

SEQ ID NO: 227008 - DNA, 429 bp, Homo sapiens
tctaagttaggtcccttatctgaggtgtggtctttgcttataggttgtggtgcttttggggtctgaacgaaatgcccacggttttcagagatgcttgtcaactgactgttccagaaatctgtcttctaactttacatggcttctaatatttcatggtctgctctcagccctgaagcaatcactttcttttaggactcatggaattttttcctctgaatgcacggtatatcccttggccatgaatccacaaaacacacacacacagattcttatggtcccagctctcctcagaaccctccttttcagtaccctgccctgagagttccagatgcttctgtcatcttgaagtctgatcttagccttctcagctcagcaaaagcactgtgcactgcttgggctctatctccctgcactgcagttcaaaacatg

SEQ ID NO: 227009 - DNA, 487 bp, Homo sapiens
aattttagccattctagttggtgtatagtagtatctcattattgtgtcaatttgcacatggtaggttaagcatatcttcacacgtttattttttatctatacatcttctttgctgaggtgtctattcagattttttgcttatttttatttttatattcctgttgttgagctttaacaattctttgtattttctagatgcaagtcttttatcagatatgtatttgcaaatattttctcccagtttgtcttttcattgtcttagtggtgtctctcacaaagcagaagttccacattttactaaagtctaacttacagattttttctttcatggattgtgcttttggaattatatctaaaaactcattgtcaggccagtcatggtggctcacgcctgtaatcccggcactttgggaggccgaggcgggcggatcatgaggtcaggagattgagaccatctggctaagatggtgaaaccccgtctccacta

SEQ ID NO: 227010 - DNA, 466 bp, Homo sapiens
gttataaaagaaatcatatacaagtataaataaaatacatacacttctgagtcctgagtagatatcttaaaattttatacatatatatatatttgaacatgtgtcctgtctgcatggaaacacataccgacttaatttgggttaaatatacattactctaaaagataaactttaggcgtaaggaaattataaagtaagtgagtttgtgtgagtagaagtttgtacttattttcagaagaaatattggggaaaaattattttaacaaggtgactagtataaaactaaaagcctcaaaaatgctgaaagcaaatgtatactctgctttgtattgaatttattactagagttattgtatatgaaagtgtttcttaattttcattttgagatagttgttaaggcataggaatgctactgactttgatgttgcttttgtattttgaaagtttaataaatttgtttagtaaa

SEQ ID NO: 227011 - DNA, 582 bp, Homo sapiens
agctggaactgtcctgctctgcatctgtctcttcttattccagatacctccagagcagctcagaatcccttgggttggggacaagtcgaggcagaacatagaaagaagcactttgtgccaggcagagattctccacccttcctgttgtgtgattctgagcacgtcactcctcattctcagccttggcttcctcttctggaaaatgggaagaggatggttcactcagatgccttgggaattgagactcctagcagagtgcctggcatacaatagatatgccgtagcccctgttcttaatcaacagcttgactgaagcacggccagggagaagcatgacttcgtgcgtggacttgggtgcccttggatggttgcttggtcagctaagtgctccttgttgagcatccctttgatcaagccacttcccttctcaaaagggttcattggtttcctggctcccctgaatgcaatccagattcttgaacctggccatcgaggccttcatttcccaaaatgtcttttcagccaacttttccactatccaaagagccacttaataaatatttcaagaaagagaaaatacaa

SEQ ID NO: 227012 - DNA, 658 bp, Homo sapiens
tttatccagtgcctctctccctcttccctctcatattcctttccctctgctttttacatttattattattatttaaagagacagggtcttgttctgttgcacaggcgggagtgcagtggtaaaatcaaacccattgtagcctcaaactactgggctcaggtgatcttcctgcctcagcttctcaaagttctaaaattacaggtgtgagccaccgtacctggcctcctctgcttttttattattttattattattattatttgctttttcccctgatttgatgtatattgttgtcattttttattattatttttcatttctattttgggtttggggcacctgtgcaagtttgttatataggtaaactcatgccatgagggtttgttatatagagtatttcatcacctggttactaagcctagtacccaatagttattttttctgctcctttctttcctcccaccctccatcctgaagtagtccccagtgtacatcgttccctttgtgtctacgagttctcatcataacagatactgttttattatcacagtaaataccctgttggctgatcaatatgtaatagtagttggtctgttaattgaaaagattcattaaggatgaagaatcatgacatattactttaagcattttttatattt

SEQ ID NO: 227013 - DNA, 512 bp, Homo sapiens
caagagtgaaactccatctcaaaaaaaaaagaatatgacacagaattttatgtatagagttccaggtaccctgctcactacggactgaaattctgtgcagtctaacaaatgaatcagagcctttccatcttgtctgggtagtccctagattccctttttagagggttttgtttttagagtgattataaattcgtccaacagtgcactttcagtgccttctacctccctctaccaagtatgaactgcatgcatggctgatttatgatttcggctattatcgcttcatgtgcgttgttcactattttgtaactgttattaaagtaaaatactgacttggaacatgaattttaaaatggtgttttatccttctagtattgattcccagttttagaaaaattggtgtcatccagtgagttttatacagaaggattttttcccttagaaatatatacatacatacaaaaaaaatttgtcattttccctgtagttgtttattatgctgtagaatttga

SEQ ID NO: 227014 - DNA, 492 bp, Homo sapiens
gagcgaggtcgtcaggaaatgagtgccaagctgaggcctcctgcagagccgccctgtgtccctgccaggatctcaccttgaagacccagctagaggcagtaaatggaaagacgatgcccgccctggaggtgttcgcccatgccctgcgcttcttcagggagcacgcccttcaggtgcgctgcggccccacctctgccgactgtggcagggaccccctattttcccctcatccgaaaccgctcccccatcccgtccccgacattggatgggtagccaccgccggagctcagaggtcatcttctccagtaccctcctccctttttgtctggtagagcctgcaccaagccatactgatgggaggggggccgattcttccagctctgctgggaagtccttcctgtgatttgattagtacctccagttccgcagagggctgaagaccaccctccctccaagccagcctgggcaacaagagagactccatctcacaaa

SEQ ID NO: 227015 - DNA, 312 bp, Homo sapiens
ccctcccccataccattcttaaagctctagatgcttttctggtagatggcctagtttcctctctttccctctcaatgtggtcttttttcctcattttgctgactgtcacactcagaattctgggtttgagactcagtctttcagatctgcttccctttcagcctcagaccacaagataatacttgtttggaacttcctgaaaaatttagggtatgtgtctgactcctcccagccttcctgactttcctaagtttgaagacagcaagcttgtagatcaaatctgtgatcaaacccattatcttgaaaaaaatg

SEQ ID NO: 227016 - DNA, 1706 bp, Homo sapiens
ccctcgcctacagaggcggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227017 - DNA, 1583 bp, Homo sapiens
ccctcgcctacagaggcggcgctgtccctgatcgagcggcgggagcgagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227018 - DNA, 1614 bp, Homo sapiens
ccctcgcctacagaggcggcgctgtccctgatcgagcggcgggagcgagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227019 - DNA, 438 bp, Homo sapiens
  misc_feature (68)..(68): n is a, c, g, or t
  misc_feature (75)..(75): n is a, c, g, or t
  misc_feature (97)..(97): n is a, c, g, or t
agtacttatgagatgggtgtcactgtctaaggtctcaaatgtcccctttggtgggggttttggggtgnaaaaaanaaaaccccccctttctgggggncccccttttttttaaaaggaggggtttaaaaaaggagggggaaaaggggttgggcgcccaaccctttggggcccaaagtttttttttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgattcatgttacatcctcatacatatgtgatgttggctgtttaaatctttgttaccttccctgtgaatccaaattgtacatatttagtaaatcaaacaaacaaa

SEQ ID NO: 227020 - DNA, 1884 bp, Homo sapiens
ccctcgcctacagaggcggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227021 - DNA, 1761 bp, Homo sapiens
ccctcgcctacagaggcggcgctgtccctgatcgagcggcgggagcgagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227022 - DNA, 1989 bp, Homo sapiens
ccctcgcctacagaggcggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagtctggattgtcattgcttagtggtttcaagaagagtgacattattcaaatggcacaaatatcatctggtggtggtggacaaagccggtgccttctttttgctctgggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227023 - DNA, 1848 bp, Homo sapiens
gccaaagctgggccttgtcacctaggaaagcctcaagatttagaggttttgttttgttcattttgaaagcaggcatataggtagatacttgtaaggaaggtttttcaaaaaggattaaacataaaaagagttacagttaacttacagttaggcagaaaaattgaacttatcccaaaatgaaagctcttttacttgcccatgaattatagtctggattgtcattgcttagtggtttcaagaagagtgacattattcaaatggcacaaatatcatctggtggtggtggacaaagccggtgccttctttttgctctgggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227024 - DNA, 1996 bp, Homo sapiens
ccctcgcctacagaggcggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagtggtttcaagaagagtgacattattcaaatggcacaaatatcatctggtggtggtggacaaagccggtgccttctttttgctctggtgttggccatttgtgttcattctcagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaa

SEQ ID NO: 227025 - DNA, 1697 bp, Homo sapiens
ccctcgcctacagaggcggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaccccgcagtggatgtctccagagtttataaaggtagttccctttgataa

SEQ ID NO: 227026 - DNA, 1104 bp, Homo sapiens
ccctcgcctacagaggcggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggtccgcacccacacaggtgagagaccttatgagagcaccaccaatacagagagcaccaccaataca

SEQ ID NO: 227027 - DNA, 502 bp, Homo sapiens
tgaataatttgcagagagcgataaagatagtatgtgtcacagttgtaatccaaccctaaatgtagtcagtacccctttctttattctgtgtttcttttttccagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagaggtacttttccccccaactctttccctgtccttggctgtaggaacccaaaggagtctgtgcagcttagcacacattagtgatgtttgcacaaatcaggacctgtactgggcactcttatgtgtttagttttggggtggggtgtggggagtgtggtttgtgtgtctgtgtctgtgtttatctttgtgtgtacttggtatgtgagtgtgtgtctgtgtgtggt

SEQ ID NO: 227028 - DNA, 1761 bp, Homo sapiens
atggaaccagctgctgccctgcacttctcccggccagcctccctcctcctcctcctcagcctgtgtgcactggtctcagcccaggtcactgtcgtggggcccactgatcccatcctggccatggtgggagaaaacactacgttacgatgctgtctgtcacccgaggaaaatgctgaggacatggaggtgcggtggttccagtctcagttctcccctgcagtgtttgtgtataagggtggaagagagagaacagaggagcagaaggaggagtaccgagggagaaccacctttgtgagcaaagacagcaggggcagcgtggccctgatcatacacaatgtcacagccgaggataacggcatctaccagtgttacttccaagaaggcaggtcctgcaatgaggccatcctgcaccttgtggtggcaggactggactctgagcccgtcattgaaatgagagaccacgaggacgggggcatccagctggagtgcatatctggagggtggtacccaaagcccctcacagtgtggagggacccctacggtgaggtcgtgcctgccctgaaggaggtctccacccctgacgcagacagcctcttcatggtcaccacagctgtgatcatcagagacaagtctgtgaggaacgtgtcctgctctatcaatgacaccctgctcggccagaagaaagaaagtgtcatttttattccagaatcctttatgcccagcaggtctccatgtgtggtgatcctgcctgttatcatgattattctgatgatacccattgccatatgcatctactggatcaacaatctccaaaaggaaaaaaaagattctcatctcatgacattcaacctctgtctgtcccttgcaggatggagaagaacattcttacatgctgccaatgttgtcctggaccaagacactggtcatccctatctcttcgtgtcagaggacaaaagaagtgtgacattggacccctccagggagagcattccgggcaacccagagagattcgacagtcagctttgtgtcctgggccaggagagcttcgcctcagggaaacattacttggaggtagatgtggaaaatgtgattgagtggactgtggggatctgtagagacaatgttgagaggaaatgggaggtcccactacttcctcagaatggcttctggaccttggagatgcataaaaggaaatactgggccctgacctcccttaagtggattctctctctggaggagcccctttgccaggtgggcatcttcctggactatgaagctggagacgtctccttctacaacatgagggacagatcacacatctacacatttccccattcagccttttctgtgcctgtgaggcccttcttcagcttagggtcttatgacagccaaatcttaatctgctctgcattcacaggagccagtggggtcacggtgcctgaagagggctggacacttcacagagcagggacccaccacagcccacagaatcagttccccagtctcacagccatggaaacaagccctggccatctcagcagccactgcacaatgcctctggtggaagacacgccctcctcccctctggtcacacaagagaacatcttccagctgcctctttcacacccactccagacctcagcccctgttcacctcctcattaggtgtggctttagtagttcctttggttgtaactatgggatggaatccaggcatagggaactagttgttccacagctcccagccaggaagaaagtgtga

SEQ ID NO: 227029 - DNA, 340 bp, Homo sapiens
atggaaccagctgctgccctgcacttctcccggccagcctccctcctcctcctcctcagcctgtgtgcactggtctcaggtagggatgtgtgccacttgctgctgtcacctatcagaaaggatcatcaaccctgtagtctgcaaaggcaaagaaagaaggactgtggagttgttgacttatcctttcattctgaacatgttcactgaatttataccagcactgtccaaaagaaacacagtgaggcacaaaggccaagtgcatgtacaattgcaaattttccaaaaaaattaaattttactttttatttaagaaagtaaaaagaaacatgaaataaaaaag

SEQ ID NO: 227030 - DNA, 1848 bp, Homo sapiens
gtggcctgaaatatttccagaatacaagcaacactgacaaaaatattcttgtagggccccacaaatctcactgagaaagaacccctacaggtggagaggagtgtggggtatgcagactggaaggtgggaccctgattcattccagaactggaaggaaatcagacatttccaaacaggagagagatgggaagccggaggaaggagcaggaggagggaagagaatgaatcttatgtgaatgaatggtaattttctctcagttactgggaagaaaaaaaaataacaaaatcagaccttggtctggtccactaaaaagaattctctgagtcagacttctttcatggaagttgtgaactttatcctctggcagccatttatctaatattaaaccccttaaccttcctaattgttctctttcagtatcagctggtttcatattaacctttcagtctttcccataatgcagttacctccaactcccgccagacccaattcagagctgccatcaggtcagacctttgcctgctcttggcaacacgtccccctgtcctgctcctctgcaacctgcccctctttttcttcatgtgctgtgaaggcaccatgtggatgggtgttcaacttctggattggggatgcacagagcctgagggacacactttgcaaacctgcaccttgcacttttgggttctggcctgcaaggtctcctttattcttttggaccaaggctgtccctgggagagggcagccgccggcctgtcagagcaaatcagcctcaggcggtttctgcggctctggtatttgagctttgttttccctctctcccgggaagaactcattgaaatagtttctctgggaaagacaaagcgtctcgcccagatgctgaaggatcacttggtaactgcctgtcttggtttcccgttgtgcccatgaaggcgccatcagctctaaagctgacctgtggttccgtctccaaacagctaacccagacgtcacccccttgcagccagccgtcacagcctgagttggagttctggcctctcctagcagtgagtgacagtgttggaggggccttggacaccttgggtaattgctaactaaatatgagcagtaggggaaggtcttctggtccacggcagagccaacggggcacttcctcttctcttttctagtcagggtagaaagctagaaagaatcctaaaaatcactatccaagtccccattgtgtggggacagaggcctggcctgaagcctaggctggagggttcagtcggaagcagaagccgggagactgcatgagagggttccttccagcttcaccaagcccgtgctgcgcgggatgaagaaagtcaagcctgtcttccagtggggccctgaggtgggggagctggaggatagggtggcagcttttttatcagctgtccccaaaagaggcccttctcccagttgccacggaccaaagctcctcctgggagctccagcctgtctgttcaatgtttgccttgcgccttttcctggtgaggccacccccggcaccatctcaggcctcagaaggacgacctcactgaaacagcccttaggttgggaaagaagcaagccctccgcgccccgtccaagtctctcaactgggcacgagcacacacagacgcccaggccctgtccctgcgccagaatggccgctcgcgtttccaggcacgatgcccctttccatgagtgcacagagccctgggctgagctgggggccgagctccacgctctctgagcagctctgagcggcacgccaaagaaggtctttcagatgggctctgggatgtggaaccatggcgtccagccctagcgtcgactccacacta

SEQ ID NO: 227031 - DNA, 260 bp, Homo sapiens
caatccagaatgcagcacagagagaccaaaaagaaaaaaaaataggtaagggacatacatttcattgatagatctttaattgaagtcctagaagaaatgagaatgaagcagaggcaacatgtgccggcctcatggctgagttttttttttagaactggtgattgacaatcaatattcaaaaagctcacagaaacccatgtgggatgcataaaaagaaatctacatctaggaacattattgtgaggcttcagaatcaccac

SEQ ID NO: 227032 - DNA, 717 bp, Homo sapiens
aaaaaagattttatgaaggagagatctaaagaaataagacttgttattggtatggacttagaggtaggatttctctcagagcaaggaggtttttcaagcaaattctgataccaacctctttcctttggaagtaggaaacagagtccctagagacaatttacttcaacttttgggaactttgaagatcagtctttgagaacttagttgttgtctagtggccaactagatgttgtgtttctgaataatagaaattaacaggtgaacttggatgtcatggattaaaaattaagtgtcagtgtagctactgtaggagcactttcatgtactttgttgtttctgcttccagggacctaatacctatcattgctgctctggaatataatcagtggttcacaaaactgtcctctaaggatctaaaactgtccactgatgtctgtgaacagatcttgagggtggtgagtaggtccaatcgactggaagaattggtgttggaaaatgctggacttagaacagattttgcacaaaaactggccagtgctctagcacataatcccaactcaggactccacacaattaaccttgctggcaacccactggaggatagaggtactgcagagttctcattatcattgatgccagaattgtaagaggattagagaattttaatttagccatgcctgaagagctgtatcaagctaagttgtaattataagtgct

SEQ ID NO: 227033 - DNA, 768 bp, Homo sapiens
aaaaaagattttatgaaggagagatctaaagaaataagacttgttattggtatggacttagaggtaggatttctctcagagcaaggaggtttttcaagcaaattctgataccaacctctttcctttggaagtaggaaacagagtccctagagacaatttacttcaacttttgggaactttgaagatcagtctttgagaacttagttgttgtctagtggccaactagatgttgtgtttctgaataatagaaattaacaggtgaacttggatgtcatggattaaaaattaagtgtcagtgtagctactgtaggagcactttcatgtactttgttgtttctgcttccagggacctaatacctatcattgctgctctggaatataatcagtggttcacaaaactgtcctctaaggatctaaaactggtaagtaatcaaacatgcagcaaatgttgcttggctttgctgaatttcaaaaacccaataattgtgggaaaaaaacaatttttttactgtactagtaagctgtatacattttatttcttgaggaggtattttcctttaaatgatttgcgtaacatttagtcaaatttgtaatgtgagatgcttccaagtatttcctcatgtattcagctgtttcgggcaatttaagaagatgaacaaaaagatacatttagtgtagcctttagtataaagtcattcagttggcaaaaactgttaaagttacatttgcacagctgcaaatagcagattttatattcctatcttacac

SEQ ID NO: 227034 - DNA, 445 bp, Homo sapiens
ctcagtttccctatctgtatattgggagcagttgtgaagctcagaagagaaatgtctgtgaaaaggttatgaacaggagggagagtggaaaccaacctgctggatcgtgtccacagaccctggaatggggccacatgcttggtttgtcaaattgcagacgccggccgggtgcgatggctcatgcctgtaatcccagcactttgggaggccgaggcggacagatcacttgaggtcgggagttcgagaccagcctgaccaacatggagaaaccccgtctctactgaaaatacaaaattagccaggcatggtggcacatgcctataatcccagctacttgggaaggctgaggcaggagaatcacttgaacctgggagacggaggttgtggtgagcctagatcgtgccattgtactccagcctgggcaacaagagtgaaactccgtctc

SEQ ID NO: 227035 - DNA, 451 bp, Homo sapiens
agataacataagatttgtcattttaatgatttgtaagtgtataattaagtggcattaattacattcattatagtgtgcagccattaccgctatctgtttctaaagctttttcagcacgtaaactgaaactctgtaaccactgaccaataactcttcatttcccctgctcccagcctgtgctaacctctaatctactttctgtcttgatgcatttgcctgttctagacatttcatatactgtaagtgcaccatttgttcttttgtctctggcttattcagcatgatgttgtcaaggttcacccatgttcattcctttttatgtctgagtaatattccatggtatggacagagcatgttttggaaaacatggctgttaacggttccataaccctcctgtgtgtggaaggaccctgttttcttagcccttcccctcttttcgccccgactcagg

SEQ ID NO: 227036 - DNA, 276 bp, Homo sapiens
ctagccctcaaataatatttgatttaacaaaattttaaggtagcaaaacttgagctgtcacttggaattgataggaatccaacaagatttacctttattagtcagaattcagagaccaaaaccccagagggtatacagttcaagcctttcccttcacagatgagaaaattgagatttaggaacattaagtcaattaaccatgattacactgctaatcaaaaacagacctgggtctgccaataagtctcccatatctgagtcatctttagtttgaaa

SEQ ID NO: 227037 - DNA, 462 bp, Homo sapiens
taagagcagtgcctcggcttctgcacctgaaaccgcactaggcatataggacttaccagtgccccaggcttactcggccgacagcaactctctgcttccctcaatgcgttgtgcagaatgaggaggaatgtagagaatcagactttccaaacctcagcctgggtactgactttcagcctcgagattaagagcttgagtccaggagccaggctgctcaggttacacttcccctcagtgttaacctactcctgcgtttaacttgggggtaagttaccagacttttcggtgcctcagtttcttcgtctgtaaagcagggtgaataataatgcaccttcctcagaaagctatcgtggagattgagttaataaacatgaagtgtttggaactacggctggcaagtggtatgaattatatcagtgtcagctacagttattattattatttatgaatttgacctgaagc

SEQ ID NO: 227038 - DNA, 765 bp, Homo sapiens
gcgcatggaacattttccaggatggagaatattagatcataatacaggtcttaacaaatttaagatcaaaatcataccaagtatcttttccagccacaaggcgatacacttagaaatcacaaacagcaagaaaattcacaaagtatgagaactaaacacactgtccgggcatggtggctcccacctgtcatcctggcactgtgggaggccgaggcaagtggatcacctgaattctggagttcgagaccagcctggccaacatggcaaaactctgtctctactaaaaatacaaaaatttagctgggtgtggttgcgtgcgcctgtaatcgcagctacttgggaggctgaggcaggagagaatcgcttgaaccagggaggtggaggttgcggtgagcagagattgtgccgctgtactccagcctgggcgacagagtgagactctgtcacaaaaaaaaaaaaaaaaaaaaaaaccacacacacacactgaaaagcttttttttactaagatcaggaacaaggcaaggatatcactgtcaccacttccatgctatataacactggaagccctagctagagctatttggcaggaaaaagcaaaagcatctatatccgtgcaagttcacagataacatgatcttatacatagaaaaatctgcaatttccacaaaaaaacttgttagaattaatatattcagtaaaggtgcaggatacaaaattagcacataaaaatcagttgcgttcctgtacactaacaaacactccaaa

SEQ ID NO: 227039 - DNA, 324 bp, Homo sapiens
gcagtcacgctgccgagaaggacccacagatattatcaacaacacagagaaagctgctgtcggaaggccccttcccagcccaggattcggtctgcccagcagaggagaaagagaagaggctgggagtctaacctagagttgaagcctttcccttcctagctgggcaacctgcagctagttacttgaactttctgaaactcggtcccctcaccagcaaagcagggataataataactacttcttaggggtgctgtgagatttaaataacatttgtcaatgagctgaagtaaataaaagaaaaagaggcatggtgcccaaaaaact

SEQ ID NO: 227040 - DNA, 123 bp, Homo sapiens
acatgctagaaaaagctaagattgccattaagagagcataggtagaaatatgaacattaaaggcaacactggtgaaagctcacaaagaaaagaggagagctggagagaaggctttcatcttct

SEQ ID NO: 227041 - DNA, 683 bp, Homo sapiens
ttaaaagaaaattagaaatgtacacaaatacttattggaagctagctatatacattacactgtttttttacattgactgaatattggaagcattccaaatactttgatatattcacataataaaagaccattgaagttaaaatgatgttgtaaaataatacataaaatggtattaaatatatggaaatgcattcatggtatattaaggtagggcatggatagggaagcaaatgagatgatagtatgtaaagtaggaatctatatttttaaagtaaaaattttcaaagcatgcatacaagcttatatgtacatatagagaaagaactggaaggatattcacctattaatgatagtgcttttctcagggtagggggatgatgggtatgtttcctattatctttattctttaaagttcttcaaataaatactttatgaaacaaaaaccaaaattcctccgcttattaaaggcttagaatgggctatttattatattaagcattttgagcatagtcccttaaatttcttaaaatcacacaaggtaggtcttatgaaccattttacagatggaaaatctgaggctcagagagattgagtaacttactcaacactgcacaactagtgtaagatgcaaaactcaaacgctggtctgtctgtctccaatgctatttctctatcaccctact

SEQ ID NO: 227042 - DNA, 630 bp, Homo sapiens
ttaaaagaaaattagaaatgtacacaaatacttattggaagctagctatatacattacactgtttttttacattgactgaatattggaagcattccaaatactttgatatattcacataataaaagaccattgaagttaaaatgatgttgtaaaataatacataaaatggtattaaatatatggaaatgcattcatggtatattaaggtagggcatggatagggaagcaaatgagatgatagtatgtaaagtaggaatctatatttttaaagtaaaaattttcaaagcatgcatacaagcttatatgtacatatagagaaagaactggaaggatattcacctattaatgatagtgcttttctcagggtagggggatgatgggtatgtttcctattatctttattctttaaagttcttcaaataaatactttatgaaacaaaaaccaaaattcctccgcttattaaaggcttagaatgggctatttattatattaagcattttgagcatagtcccttaaatttcttaaaatcacacaaggtaggtcttatgaaccattttacagatgtgtaagatgcaaaactcaaacgctggtctgtctgtctccaatgctatttctctatcaccctact

SEQ ID NO: 227043 - DNA, 508 bp, Homo sapiens
ataactgtgccaacactagtcttgttgcttttccctctaatctgacaatttaaaacatggatatgccatcattgtccccaccctgctttgttcatatcccttgaatctttgactatttcattgctccaaatcaaaagatggggtggtggttttgctcgctgcctctagttcttgactggctgctgggggtttggtggaggaaaagtggagaaactacttgatccatgctatagcttcaaaagtagctgggctatgtcagtggaatgctgagttgtaaattattttcctagattatttgcaaggctgagctaacacacaaaacatccagactgcaaaaatctcactagaggaagtatctgtttctggcttctggccaaaggctatacttcccagaaaaaaaaccaaaccaaaacaaaactcacttgttattgactgtcaagagtggcatgtattttcaaacatctgatattacagaattagacattcatacatgtatttttaccttttc

SEQ ID NO: 227044 - DNA, 364 bp, Homo sapiens
gcggaggttgcagtgagccgagatcgcaccactgcactccagcctgggtgacagagtgactctgtctcaaaaaaacaaaaaacaggagagaatggattttcctgtccacatagaataaaaagcagttggtttagccaggcatggtggcatgtgcctgtagtcccagctacttggggagctgagatgggaggattgcttgagtcctagaggttgagtctacagtgagctgtgatcatgcgactgcactccagcctgggcgacagagttgagaccccatttcaaaaaacaaaacaaaacaaaaaaacagattggaaaacagcaatgaaagattgagttctataagttgacaataaagaaaattgac

SEQ ID NO: 227045 - DNA, 246 bp, Homo sapiens
gaaaataatttgcttgggactccaagagtatacgttcagggtctgtcacaatacaaataatttctataaaagtctagtaggtattatgagatttaccttcattctttctgatttagatgacactatcaccaatttgttgggaaatgttttccatttgggtaagatttatttttattatttaatctgtggttttctgagtaaaacctcagaaagttgtttttttaagaaacagcaggctgacataca

SEQ ID NO: 227046 - DNA, 426 bp, Homo sapiens
aaggtagagccctgactcctttttggacaacattcactaagagtgtgcattctgatttgcttgccaatgtcacaatctgaacactacagttgttttatcttttttctctttcccattgcttaacaccagcattgttagagaaagggatcagactaaggcttatctaaatggcccttattaaagatggtagagaaatacgatatgggtagaaaacattggttcctgtgaagtctggttttagctccaacttcacttagtggttttctctgtggttctcttccattagcacgatgaactgaagccaaggtaaaaatgccttcgataattgtacaaagaacagactaatgattgtgttatatccaggcgcaaagactatgattgccccagagtcttaatctgaaataaaagcagtagcaatgtttgaaa

SEQ ID NO: 227047 - DNA, 548 bp, Homo sapiens
ggtcatagaagccagcttgaaggagctccaattgaccaaattctagaaaaatttaaacattatattaaatgatagtgacaaattataagccaaagagtgaaataagaactcatgagaccatactgatataaataaataaatatatatataaataaataaatagtattaccatggaatgacagctagtaaatgtagaaggaacaatgaaattaggaaatcaccctttattaaacactgtagtgttaaatcaccctttattaaacactattcaggcaatagttcgcaacagatgctaaaactagtgtgaaaaggtttgttaagaaagtatatttacatagtctcaaagtaaatccccagaaaatcttctttaattaccagggaaaagcagtaactttacagtggagaaaccttgcagataccaccttaaccaagtgatcagaattactattaccagaaatggaatagacatcatacagttcctaatgtgaagggcacgatgccacttttgtagtgtttttgtcaaatgaatattcagagtctactcttgg

SEQ ID NO: 227048 - DNA, 486 bp, Homo sapiens
agagtaccagggtgatgattagctagagtcataaaatggggagatctagcatggccttggggaacatctagtgggcgtcacacatccaaatgcctgcagaggggccaggcaggtcagacaataggggatgatggggcctgtggggatgcgcctttaggcattacattcaaagacttaagtctactgtgcagaggtggtaagaatgatacaagtggttgttgttggggggctgattgactataaaggggcatgaagaaactttctgcaggtgatggaaatgttctgtctgttgctttgggtggggttacatcttatataccttcatcaaagaaataacttagatgtgtgcattttaccatgaagtatacctcaatttaaaaacttggggcaaattcataaagcaatgtggatctggctctcgggctaaccatttgtaaacttctgttgcaatccgacttccagaggcgtccttggctcctcatcttg

SEQ ID NO: 227049 - DNA, 509 bp, Homo sapiens
caggtttatcaggtcaaacccagaacacatcctcagggcaagcaatctgaggaatctcagtatgcaggaccagttcagcaagaggtttaggttcaaatcaggagtgagggcaaagtctggctcatggtggaaccttagaaaagtccccaggcaccatgtgaggccatgtgccatgaagcccaattgcaggacagaaaaggatgcccttctacccacacagttggccagacccaaccctgccaagaacacgccttctggttccaagataacaaaaacaagtcctaggtcacaccacccacagtggtgagagcccaagggctgaagtaggcaaaggccaggctcccataactgagcccatagccattttccccactgggcagagtaaaagctaaagaagccttggggcgaaggtcaggaagctgtagaggggtataggaacaacaaagacccaaacagctcatctgtactacatatgtactattgcatctactttaataaatgcctaccat

SEQ ID NO: 227050 - DNA, 426 bp, Homo sapiens
cacctaaagggaggccttttcatcagacttgctcagccaggagctcagagccttccatgtcacatcctgtgctgggacccctgtgccagaggctcagcagctgttcacttgttcagctcactgcacttactgagtgctgcctatgagtcaggaactggccaagttcttaggatgcaacagggaaacaaacagtaactggcatgtcaagaattaaaacaaggtgatgagataagagaatgacaaggtaaccacagaagatctctgaggaggttgcacttaagatgtgatccgagtcccacaaaggagcatgctgtcctaagatccggtggaagaactttccagacagaaggagcagctgatgaaggtggcggtgatgatgaagctggtagcaccaaataaatgtgctagaccaggggttggccagct

SEQ ID NO: 227051 - DNA, 442 bp, Homo sapiens
cagtacatatacttcataataaacgattatgttactggtttatgtatatactatatttttatcattagagtgttctcctaccatgtcttttaaagttaactgtaaaatagcctcaggtaggtccttcaggaggtattccagaagaaggcattgttaccacaggagatgacagctccatgtgtgttacacaacctttgaagaccttccggtgggacaggaagtgtaggtggaaaacagtgatattgatgatcctcatcctatgtaggccttaggctaatgtgtgtgtttgtgtcttagattttaacaaaaagattaaacagtaaaaattaattaaaataataggcaaagcctcatagaataaggaaataaagaaaaaatatttttgtacagttgtacagtgtttgtgtccttaatgctgttatttcaaaaggatcaaaaagtt

SEQ ID NO: 227052 - DNA, 517 bp, Homo sapiens
ctctgcagctagtgcatgacctgttctagccaaaaagatttaagcagaagtctgataggggatgtcagggcaatgctgattgacataaagctggtgtagcccattgttcttccttcccagcatacaaatgccatggctgattaccagcttttcctgatcagtgggtgggactggcaacacagggcctccacactcaactggcaattatctgcagtaacaacgtcataactgctcccctttaaacaccagctaggggtgctctgaggggccacctctctgggccatttctctaattttatgtcacctcctccctctttgataaggaggccaggagctgatggtattactgagagctaaaggaggcagcccctgacagagggccaggggctctggttggctctgcccttcccctcaactaggggaatcttgcagcatgaagtctggcatttcatggcagggaaagtttggatctcttaagatgattaatggaagaaaaataaagactggaaaatccacc

SEQ ID NO: 227053 - DNA, 315 bp, Homo sapiens
ggtggcagtcttctaggtaaatttaactattattaacctgattaatgaaagctcagtaaggaaagggaagttttcgatttaatattttaacgtcttttttatgttttagctcgtgtgttttaagattggggctttttatcatgagaagtttaacttcagcaaacaaattcattttggggtcaaggggaatgttttgttcactttgaatactaactgaatgtactaaattcatgaaagaaaataggaatgaatttcatgatgtattttaactgacagtttggagtttaatttagaattctaagtgttttaaaatgg

SEQ ID NO: 227054 - DNA, 184 bp, Homo sapiens
ttggggatccagcaaccaattctgaaaaatttgatgaaaatctgatttaaacaactttttttttttctaagtgtctagacctttctgtatcagaaatgaaagtttatcacagtgtctttttcgagccccagtcatttcaaggacacgatgagaaaaagctaatgcatctctcctgctcttctca

SEQ ID NO: 227055 - DNA, 391 bp, Homo sapiens
cacgcacacacacgcaatcgataaatccagagcccctggcattgacttctcagcactcacttataaaacttaaaaaaagaagcaaaggccactatcaaaaaaatcaaaactatcatcagacgcagtggcttaggcctgtaatcccagcacgttggaaggccgaggcaggcagatcatgaggtcaggactttgagaccagcctggccaatatggtgaaaccccatttctactaaaaatacaaaaaccagcagggcgtggtggtgcgggccgtagtcccagctactcaggaggctagggtaggagaatcattggaacccaggaggtggagcttgcagtgagccaagatcgtgccagtgctctccagcctgggcgacagagcgagactccatct

SEQ ID NO: 227056 - DNA, 488 bp, Homo sapiens
cagacagattcattatgtaaacaagacacaaaaatattttcataagatgtcagaatggatttcctctccttccccagcaacaatgtgattcttgtttgtgggactgtggggcttcttgtctctcatctgttcagctgaattggccggagcagaatgtctagagcccagagccggagcctgcagagatgattacaggctccgccgtgagctggacaaatgaggttggggcagcatgtgaaagcccaagttgtaaatctctcattataagagccattagccacacgctgcacatcgggggtctggagagacactgaaactggacatggtccgagagcctagcatcaaaggaaaaacccaggctcaagatgttcacaccactgccattatcctgtgtccccacttagaaactcaaagtggcctctctacagaactctccaacggcttatcagcaaagccagacaattagaacaaggttgttcttctccctg

SEQ ID NO: 227057 - DNA, 148 bp, Homo sapiens
cacagttaagctttgttagaaggcctcctgccccctgctctctctcacaaggttaactacaaagcacgaagttaggaggtggataagagagcccccaaatggcagcaagcccacctctgaactccattccctcccagtgggaatgttg

SEQ ID NO: 227058 - DNA, 371 bp, Homo sapiens
aacttaaagtgtacaggaggatgtgcataggttatatgcaaatattaacatcattttatatccaggacttaagcatttgtggatcttggtatccaaaggaggccctggaatgagttccccatggatactgagggaagactatatactcatgttgcatagtatatgaatacaaaatgttgcttaagcttgcagaagtacttttttttttttttgagatggagtttcgctcctgtcacctaggctggagtgcagtggaacgatctcagctcactgcaacctccacctcctgggttcaagcgattctcctgcttcagcctcccaagtagctgggattacaagcatgcaccaccacgcccggctaatttttgtat

SEQ ID NO: 227059 - DNA, 477 bp, Homo sapiens
ataaagcacaagtgaggaagcaggtagaatcagagaaggaggaaaaaaggttaatagtggaaggccaactggaggctgcttaagcctttggagatttttgtataactgcctcagagttttgtataactgccccaaatgaaggggagctgggtggttttccatctacagtcaatcctcactgataaagattgcctttatctaaaaggctcccagaacttcccaggtacactggttaggtagggcttggcaagctcctgaggtgctggagagctgaggagagaagtagttgagatgggaagttgtcagtgtgttaactgtgcataccagctacaagtaaacattgaagtgagctgaaaggagatggtccaggtatcaactctgtgtcttaacaggcattctcattgaataatccagatgtgaaataaaagcctcaatttagatagagacctagaagaaatgtgagatgaaatgtggtta

SEQ ID NO: 227060 - DNA, 332 bp, Homo sapiens
gaaaattattttattataaatcaggacctttcgtggaactgtattgaaattaattatcctgggcctggcgcggtggctcatgcctgtaatcccagcactttgggaggccaaggtgggcggatcatgaggtcaagagatcgagaccatcctggctaacacagtgaaaccccgtctctactaaaaaatacaaaaaaaattagctgggcatggtggtggtgcctgtagtcccagctactcaggaggctgaggcaggagaatggcgtgaacgtgagaggtggagcttgcagtgagctgagatcgcgctactgcattccagcctgggcaaacagcaa

SEQ ID NO: 227061 - DNA, 419 bp, Homo sapiens
tccttcctgccttcttttcttttttttcttttcttttctcttaacaaagcagtgagttaaaacctgactgttggattgtagagccttcaattagtgtctagttcattctcctagaaagacaagtgctctgcttggctagtcattctgaaatcatctgtaagccccatcttagtttaagaatagccatcagataattcttctcagccttttctcctggtttcctgacagttccagttactttttcagcttttcttcttttagggccctaaaaacccttcatgaggccttcatcttgtgttaccttttcttcgtaatactaaagttttatgacaaacatcccattctggattcacattttactgtattagtcatggcatgtaaaacaattcaataattggtacccttctgattaatttatt

SEQ ID NO: 227062 - DNA, 500 bp, Homo sapiens
ataggatagcagtatcccgtggggtacgccggggcaaaatgacccatgtcaagtcaataacctccgcgctgcttcaccttctcgtgctggaatgccttctgcgtgccttcctggaaagcgccctgtggccccgtgacccagcctgggccggcaccttgagttgggcacaaattcaagatgacaactcttggagcccgttggctggcggcagaatgatgaggagacattctgcccgggcggtttattgtccgttctagactgagaacaattccgggctgttacgatgtgattgcccttgggcgcgttatcagcgtgaactcagggcagagcaatacccctgccaagcggccgacgctgtttcacagggagggccctcctgctctttcacccacagtggggctcggggccatgggtgcagggctggaggaggatgtgaggggcagctatttcagtctggaatatcaggattttaaccccaaataaatgtcttggttattatt

SEQ ID NO: 227063 - DNA, 570 bp, Homo sapiens
gtatttttaaaaatgttttcaaagccttcatatatattaggctattataatttacctcattctttttatacactatggggaaaaagaaactattacaattttatgcagttgcatgttaccttatcccccaacaaactctggggaagggagatactgtttgccatcagcaagtagataccatagttattttaaattgaatcaatttgtccctgttcctgcatacttgaaataacaaatatagatatacctatatgttcattcagaatactgtctaaaacccagataatctcaaaaatgtatggtgcattccatctccttaaagaattctcatagttgcccagctttgcttataagtgccagattgtcaggttggcacaaacccaaagacaacacacatcgcagaatgaaaatactccaccctaaacgttttcatgacctgtgtgcacttttctaagagaagccaacactggcagtaaacctgagtataggaatgcgtacaatgtgggaagtgatgatttgcatgagataactaaaaaccttacccttgatttactactttgaaaataaact

SEQ ID NO: 227064 - DNA, 539 bp, Homo sapiens
aaaagaatagagcttccagaacctctgggaccataactaaaaatctaacatttgtgtcatcagaatttcaggagaagagaatgagagcagagctggaaaagcaattgaagaaatgctgtaaaatttccatatttggcaaaagacagagtcctcagatttaagaagctgagcaaaccccaatcgggataaacccatgctaagaatttcatgccaagacaacataataattaaaatttggaaaaaagaaaaaaggaaagagaccagccttacctatgaaagacaagttttaaaatttgtacataaaaagtttacatattgacatatgcagaatgctctgtttatccaatttacatatatatatatgacattccaacaatagtggaatgcacatttttcaagagtccatggagtgctgggattacaggcatgagccaccacgcctggccacaaagtggcatttattccaaagatgcaaagctgttcagtatttgaagatcaatcattgtaataccatataccaaataaacagattaatggga

SEQ ID NO: 227065 - DNA, 514 bp, Homo sapiens
ctctgctttaaaattcattgattgataaaatggctggtatggggctctttttgactgcttctaagagtaggaacaaaataagactttaagtcgtggcttgaaaagaaagatacacattttcagaagaaagaaaggggagggctgcagggaacctgtcttggagggagctcttcagtcagctccattagcctaggagcgtgctcatggtgtcacactgccagtaactagtcactctctcacttccaacaggggcaacagcctgaaggtgtgagtgtcagaaaatacttactttggaagaaaggtgtgttttttgttgttgttgttgtttttttttaccctgaagtttcctgactttttttttccagaatgtcttccttgtaaacaggcacctaaagcatcggtcagcagagttcctgatgactgctacctctgtgtgacaaggacatttgcagctgtctttggaaggctattctccacattaataaatgataataatgatgataatatatttttt

SEQ ID NO: 227066 - DNA, 552 bp, Homo sapiens
aaatatgaaactataaacaattataaggaggttggccaagatggccaactagaaggagctaatgtgtgccactctcatgaagggaagggacaagtaataataaatatagcaccttcagttgaaagatccaggtacacacattgggactcatcaaagaaataacccatggggaagggagaaaagcaaggcaggatgacaatcctcccaggagtgacccagagccaagggagcttccccaacccaaagaagtggtagtccaaggcaattaggaactggagtggtcccagggcatagcccaggaactctatggagaggcagctagactgcttattcacatggaacccagatcccatttgtcttcactggccaaaatcgccacctggggtctccagtcatccaaactccagccgacagtgattgcatacctccctaggatgaagctcccagagggagggacagataaccatctgtgatgtttgacagccttagttgttcttgcctttgggctttggaaagtctgaggtgactggaggctggagtaggcctccagtg

SEQ ID NO: 227067 - DNA, 431 bp, Homo sapiens
agccatggagcagatacggtaagactcaggataccttgtttgtatccgctgtgatgagaagtgaaggatgctggagtgcagtggcgtgatctcggctcaccacaacctccacctgccgggttctgaaccctgatactgacaacaatgaatatataaagacactcaaagctgccgttctctgctgataatgctggctgtcattatattcccatcagctgaagatgattttatgacgtccgaggaagcccccggccctgaatgagtaaattccagcctggacgacacagcaagactccgtctcaaaatacaaaatacaggcatgagccaccatgccggcctctatctcctgtcttcaacaatagctttttcaaaccttccaccttcctacttatctccctttattgtggtcaataaatgtccttttaagagga

SEQ ID NO: 227068 - DNA, 1481 bp, Homo sapiens
  misc_feature (1240)..(1240): n is a, c, g, or t
tgcctccatcagtgcctgtggcgtgtgtgtgtgtgtgtgtgtgtgcgcgcgcgtgcgtgcacgtgtgtatgtgtgtgtgtgtgtattgggtttctctctcccttgtaagaacacagccagcccgccctctcctgctgttgctgcagctctgacttgctttttcctgcctccttcctctcctctctcttcttgcttagcttcttgccttctgatactactcccaagatggaggctaatcactctgaacagctctcagcggaacgacagtcaacacctccaggtgacagttcatcattacccagtcacaatggcctggagaaggaagatggccaggattctccaaccccagtccaaccaccagagaaagaggcaagtgtgcaccccgatatctctgaagagctgaatcgacagctggaagacatcattaacacttatgggtctgctgccagcacagcagggaaagagggctctgccagggccagtgagcagcctgagaatgcagaatcacctgacaacgaggatggggactgtgaggaaacaactgaagaggctggaagagaacccgttgcttctggagagccacccactgtcaaagagcccgtcagcaataaggagcaaaaattggaaaagaaaatcctaaaaggattaggcaaagaagccaacctgctaatgcaaaatctgaacaagttgcaaacaccggaagaaaagtttgattttttattcaagaagtatgctgaattgctggatgaacatcgtactgagcaaaagaagttaaagctcctccaaaagaaacaggtacaaattcaaaaagaaaaggaccagttacaaggtgaacacagcagagctatcctcgctcgaagcaaattggagagtctgtgccgggagctgcagagacacaacaagactctgaaggaagaggcgcttcagcgggcacgtgaggaagaagagaaaaggaaggaaatcacaagccatttccagagtaccctcacggacatccagggccagatcgagcagcagagtgagcgaaatatgaagctctgtcaggagaacacagagcttgcagaaaagctgaaaagcatcatcgatcagtatgagctcagagaggagcatctggacaaaatatttaaacacagagaactgcagcagaagctggtggatgcaaagcttgagcaggcccaagaaatgatgaaggaagcggaggagcgacccaaacgagaaaaggaatatttgctgaccagcncagagtggacttcaggcgaaagtgttgaaggagcaaaagacagtcctgcaggctcaggtaaggccaggtggacaaggcatgggggtgctgtcctccctgtccccaaataaaaaggctggggccaaaggtgggcaccaaaagtcctcctatgtggcaggggatggggggatgggaattggaaataaagaacaccttcccatttattcatattttcaagtaaaaataaaagccccattttata

SEQ ID NO: 227069 - DNA, 784 bp, Homo sapiens
tgcctccatcagtgcctgtggcgtgtgtgtgtgtgtgtgtgtgtgcgcgcgcgtgcgtgcacgtgtgtatgtgtgtgtgtgtgtattgggtttctctctcccttgtaagaacacagccagcccgccctctcctgctgttgctgcagctctgacttgctttttcctgcctccttcctctcctctctcttcttgcttagcttcttgccttctgatactactcccaagatggaggctaatcactctgaacagctctcagcggaacgacagtcaacacctccaggtgacagttcatcattacccagtcacaatggcctggagaaggaagatggccaggattctccaaccccagtccaaccaccagagaaagaggcaagtgtgcaccccgatatctctgaagagctgaatcgacagctggaagacatcattaacacttatgggtctgctgccagcacagcagggaaagagggctctgccagggccagtgagcagcctgagaatgcagaatcacctgacaacgaggatggggactgtgaggaaacaactgaagaggctggaagagaacccgttgcttctggagagccacccactgtcaaagagcccgtcagcaataaggagcaaaaattggaaaagaaaatcctaaaaggattaggcaagtagttatgttcaaatatgtgacttttctgtatggtattcctaaaaaaggggcacttcttccaaacttcactaaaagccacatccaatatttggatgactgtagtagccttctatattttccctcgttgta

SEQ ID NO: 227070 - DNA, 432 bp, Homo sapiens
ggaagaaaagtttgattttttattcaagaagtatgctgaattggtaagatcttggattagcttcttttctcagaacgattagtgagcccagtgcctctagcttcaaggaacaacaaacacctgccaatccgagaatgaattgtaaacagcaacatctgaggtctgtgcgctaaccctgcagattatgagacccacagctaagatgtggcattctctctagtaaagctaggcagtggccttctcctttatttctgcttcttaaaaaattcttttgaaggaatgcccatcagaatctctatctgatccatttggttatctaaatcagggaatgaaaataaaccatatcacccaatcccagtgacataggtacctctacctgaaatgcattgtgaccagaatcactgggttaattctcgcatgttagcacctcac

SEQ ID NO: 227071 - DNA, 886 bp, Homo sapiens
ggaacgcgccgtccactgcagctgcgtgacttagagtcccggatggataaccggtgttgccacatttcggacagatgattcagcttgtaagcagacaatgtaaacttacaatatcaataagtaaagtacagtagtgtaaatacattttctcttccttatgattttcttaatattttcttttccctagcttaccttaattgtaagaatataatacatatacagaatatgtgttaattgaccttttctgttatcaataaggcttctggtcaacaatagcctattagtaggtaagattttggagattcaaaagttacagtgaattttaactgtgcaggtgattgatgcctaattcccatgttgttcaagggtcaactgtacaataggttttctgctttccttaccctcctgatgatttctgaactagttctacagagtttcctcttttcctttgcatctctccttcccactgccaccatccagattgttttcagagcggcacttcatcagctgcatcgtcaccctctgagggtgtggaagggctctcacttccacttaaggccatgccatgctaattgcctttctggctcttttctcttaaaaggtggtgcttagaaaggaaaggaatagtccatatgtggtcttagtaggacagggaacagtaggtctttacctcccttaatccgaatgttagatctcttcaatgcaatcaaggtaatgcttatttttttttggcacccacatcacatccactgctcactcaggttgagtttattgataactacaaccccaagcttttcatgtcatattaaagcaaaagccattatgagctgttcttatatctcgtagaatgtctgccatcttgtgtcatgtagcttttgtctcagga

SEQ ID NO: 227072 - DNA, 368 bp, Homo sapiens
tccccatttcctaagggataaagaccagattcattagcctctaagaccgggcctcaagctacttctccaaaatcatctctaggcactcctccaaattctctttaccttctggccatggcaaaagcatgctgtgccttcatgcctccctgcctttcccctgctgttctttcggccttcagtgctgttctccctcttctcagtctgtgaacttgtaatcacccttaaaagcaaagttcttcattgatttacctgtacccccacagccccctgtgccaactcagagcaccagccagagtgtgttctaaatggaaccacccaatgatgtatctctgtctctggctagactaaaagctccctgaggacgaggt

SEQ ID NO: 227073 - DNA, 261 bp, Homo sapiens
cttttcagtttggtgttttgatggcttgcaaacctgaaaccccagcgcctggagtgggatcaaagcctgtcacaggggcagagggaggaccgaaaagtctagacccctccagggatctctgctctgcttctgctgggatccccaccccttcctgggcctgggtttttccaggcactggtggatggcacttctgtgcctggaggaggttttggttaaagatgctctaaatgtcttgtccaatcacagttgtacaaaaaaaaa

SEQ ID NO: 227074 - DNA, 421 bp, Homo sapiens
agagaagagactagtctctctctctctctctccttgaatttagtcaaaatataaaggtcaaaatgatgtatttattaaaaacagcaagattttatttgtttgtttgttttgagacagagacctgctcagttgcccaggctggagtgcagtggctcagtttcggttcactgcaacctccgcctctggggttcaagtgattctcctgcctcagcctcccaaggagctgggattaccaggtgcccatcaccacgcctggctaattttcatatttttagtagagatggggtttcatcatgttggccaggctggtctcaaactcctgacctcaagtgatccaccagctttagccttgacatagggaaaagtgaaggaggaagtgggaaaaggttgaggtgggtggatatatcagatcaaatagggc

SEQ ID NO: 227075 - DNA, 291 bp, Homo sapiens
tttgtttttatttaaatatatctctgattgaactgaatgttaatcctggttaaaatgagtgacaaaaatactagaagatgtgtgttaaaacatttataccaaatgaattaaggccatttccttcagttctacttatgtgctgaaaacaataatacctaaagaaaaaccttacggccgggtgtggtggctcacatctgtaatcccagcactttgggaggccgaggcgagcagatcatgaggtcaggagttcgagaccagcctgaccaacatggtgaaaccctgtctctacta

SEQ ID NO: 227076 - DNA, 597 bp, Homo sapiens
atacaagacgtcagagttgggaggagacagtgggacagtgaggagttccctttattaatactggctctgaactgcccgtgagatatctaggtgaagttgttcagaaacaatgagaaatttgtgtctgaggttagggagtggtactggttgagcatcccagatctgaaaatctgaaattagaaatgctcccaaacctgaaacgtattgagtgccaacatgccgttcaaaggcaatactcattagagcatttcagacttcagatttgactatgtatcctgcaaatattccaaaatccaaaaaaatcagatgccccgtcacagcagttgagaggcagaggctctccttataggatgaggtcttagaacggagagccttcttcataggggagtctgaacttctggattttgtggagagattgaaaaaaattggtggaccagcacagaattaccagttatttattttacctatgaaagctagcaactaaactgaaacatagaactaccaccactatgtatatgtatatttaaagaatatttaaacacaaaatttaaaaggtcatgctgtcaatatattcaaaccttttttttttttgaggca

SEQ ID NO: 227077 - DNA, 429 bp, Homo sapiens
taaatagaaagagaagaagagggagagtgagaataaagcgaatgcagcaaaatgttaacaatggcgaatctactgaaatatatacttgcatttgtcatactatgctttcaacttttcagtctttttgtaatttttaaaaattaaatgaaaaggtggagtaagcacttacatccttttaggctatatgtactgtctatgaccagaagctgcagacacctgggaatcaaaggcaggtaacggttacctgggcctcagtgcgtgctctaccacctgtccaactcagggctgtgcatcagctctttctaccttccagcattctttttccttcctttcacacttcacacatttttgtctttttcttatgcctggtcctgtttttcatcatatgcctctgttttcttatgttgaatgtggtgaaacatggttatt

SEQ ID NO: 227078 - DNA, 403 bp, Homo sapiens
gattaaatttaaacatcatgaaatgcaactcaaaggccttctcgtcatctgacctcattctgctattctaacacacacacacaaacacacacattatcaccagccctccttcccccatgcactctcagggttcccataacatgtctacgattctccattttccctatttctacttggaatgtcctctctctcatctctgcataataaaaattttcacctattacaaagcctacgtgaagctacaccactctccttcatagagcattcactgattgaattgtcagaatttatctccccttttataatactttacctactgtggcatcgatcacattctgccttgtgttaaagttacttgtatatatgtcttacctcctctattagactgaaaacttgatgataa

SEQ ID NO: 227079 - DNA, 387 bp, Homo sapiens
cagtgaaattttattatatgctatattccaataagttgtagaacttagggataccattattaagaataaaatacattcgactaaatgtaagaatgccatggatcgttaagatacatcctgacttcagagatgtgtgaacaaatatacaccaatgagcaagtatccatcaattttaaaatcaatgagctatggtacttataagtctagaggaggtagtctcagggcttgttgagcagctcatcaatgtcatcaagagctcagacccttttcatcctttccctctgctattctcagtgtcaaggattgggacttgttgcttcatagttacaagatggctgtgagagttccaggcataagagaagtactccatttgccgaacaattaaac

SEQ ID NO: 227080 - DNA, 520 bp, Homo sapiens
agattacagaagagcactatgaagaaagagtgaaagaaaaaacagtcaatgacagagcttggcagagttcttgagggcagtacaaaggccaagaagtcttacaaaaaaaaaaaacccactaataacaatctaagagctaagaaaataaaagtttcaaaaaaagaagaatggtcaactgtcaattgtagcagagggcaagtaagaggaatgccgttgattttgtcagttaggggccgcgtgtggtggctcacgcctgtaatcccagtactttgggtggctgaggcagctggatcacctgaggtcaggagttcgagaccagcctggacaacatggcaaaaccctatatctactaaatatacaaaattagccgggtgtggtggtgcagcctgtagtcccagctacttgggaggctgagataggagaattgcttgaacctgggaggcagacactatagtaagccgagatcgcaccactgcactccagcctgggtgaatcagtgcgaaactctgtctcaaaaaaa

SEQ ID NO: 227081 - DNA, 386 bp, Homo sapiens
agattacagaagagcactatgaagaaagagtgaaagaaaaaacagtcaatgacagagcttggcagagttcttgagggcagtacaaaggccaagaagtcttacaaaaaaaaaaaacccactaataacaatctaagagctaagaaaataaaagtttcaaaaaaagaagaatggtcaactgtcaattgtagcagagggcaagtaagaggaatgccgttgattttgtcagttaggggccgcgtgtggtggctcacgcctgtaatcccagtactttgggtggctgaggcagagaattgcttgaacctgggaggcagacactatagtaagccgagatcgcaccactgcactccagcctgggtgaatcagtgcgaaactctgtctcaaaaaaa

SEQ ID NO: 227082 - DNA, 472 bp, Homo sapiens
cattgctatcacccaaagtccatagtttacattagggttcattcactcttcgtgttgtacattctatgggttttgacaaatgtcataacatgtatttataattatagaaatatgtagaagagttttattgctctaaaattcctctgtgctccatccattcatccctttcttctcccagtctcttgaaaccactgctactgttacggtctccatggttttgccttttccagaatgtcatatagttggaatcataccgtaggaagccttttcagattggcttttttcgcttagtaatatgcattttaggtttctccatagcttttcatggctaaatagctcatttccttttagtgctaatattccattgtctggatgtaccatagcttatttatctgcttatttactgatggcatcttggttgcttccaatattttgcagttattaataaagctgctataaacatctgtgtgca

SEQ ID NO: 227083 - DNA, 759 bp, Homo sapiens
aggttgcggtgagccgaggttgtgccattgcactccagcctgggcaacaagagcgagattccatctgaaaaaaaaaaaaaaacaccgatctcaaagagggagttgtgagaaccccaacttgaagctggttgctctcaagttccagaggcccggacttgcgactgacgtctggggagttgggggcagcagtcttgggaactgagctgtgagatctgatactatctctgggtctatagtgctggcattgaattggagaacacccagctggtgttcactgcttggtgtgtggcggaaaaaccctcacacatttggtcacagaagcccttttctgtgttggtgattgttgtgctggtgtgagaacagaggaaaaacaccgcttgcagagtttttcctgaaacaatactctttagagcgatagaaataaataccacgacctgcgcattcaaagctgttgtatctggattgtgactgcgtggaaggtcgaggcgggaagacaggggctgttgcttttcgttataaactctgcattacttgatttttgcactacgtacatttactttgataacactggaaagaataaattggccatgtagtgtagcttccaaaaaaaactattgcttgggtttcaaggtcaaggaaatttcattctcatcagtttcttgggaaagaggaagtggaatgatgttgtcagaaagtgaaaccatgggtcattttcagaactactcagagtaataaatattttttgtcagttttgttctt

SEQ ID NO: 227084 - DNA, 764 bp, Homo sapiens
caggagggggaaggtgccatttaaagcaatcattgcactccagcctgggcaacaagagcgagattccatctgaaaaaaaaaaaaaaacaccgatctcaaagagggagttgtgagaaccccaacttgaagctggttgctctcaagttccagaggcccggacttgcgactgacgtctggggagttgggggcagcagtcttgggaactgagctgtgagatctgatactatctctgggtctatagtgctggcattgaattggagaacacccagctggtgttcactgcttggtgtgtggcggaaaaaccctcacacatttggtcacagaagcccttttctgtgttggtgattgttgtgctggtgtgagaacagaggaaaaacaccgcttgcagagtttttcctgaaacaatactctttagagcgatagaaataaataccacgacctgcgcattcaaagctgttgtatctggattgtgactgcgtggaaggtcgaggcgggaagacaggggctgttgcttttcgttataaactctgcattacttgatttttgcactacgtacatttactttgataacactggaaagaataaattggccatgtagtgtagcttccaaaaaaaactattgcttgggtttcaaggtcaaggaaatttcattctcatcagtttcttgggaaagaggaagtggaatgatgttgtcagaaagtgaaaccatgggtcattttcagaactactcagagtaataaatattttttgtcagttttgttctt

SEQ ID NO: 227085 - DNA, 363 bp, Homo sapiens
gtgagccaccacgcccggcctggaactactcttttaaaagctgcactcctggctgggtgcggtggctcacaccttgttatctcagtaatttgggaagccaaggtgggaggattgcttgaggccaggagtttgagaccagtctgggcaacatagcgagactacatttttatgaaaaaaatttaaaaattagcttggcatggtccgtgcctgtcgtcctaactactttgggggttgcgggatggggcagggaggatgaggcaggagaatcacttgagcacaggagtttgaggctgcagcgagctaagactgtgtcactgcactctcgcctgggtgacagatggagaccctgtcactttaaattac

SEQ ID NO: 227086 - DNA, 311 bp, Homo sapiens
ggcattttaaggtagttttgtttagcaaatctattctctttctccatgcctggagggcttctttttcatagtacatccaaagaatctgcttttaaaaaaaaaaaaaaaattagcatgctcatatattttcatcagttaatatcgaaactgatgaaaatattaatacttaacattgtattaagtgtcatctttcccaacatttcaaaagtttcatatttaaaatgttaatagagttcaaagcctctaaagttaactatactttccaaagttaactttgggattattattattttccttgccccatctaaaca

SEQ ID NO: 227087 - DNA, 526 bp, Homo sapiens
agcgagatttacaataaagtagatgttggagctatgctgactgggttcaaatcctcataccatcactgcctagttgtataagcttgaacaaattacttgttattgctgtgcttcaatttcctcagctgtaaaatatggttttaaaatgaaaagcctttgagatcttttagaattaagtgaaaatttaagcagaacagaaggaacaccagatgggagtctctcaagaagtgtcctcagggatatcacatgaaagtgaggtgatcttagatattatcttatctgaaataaattacccattgtaaatgaatacaaggatggcacatcatcttttctcatacatatattcagagagctggcagctatgttgcaggaagatgaaaggaacctcaagtgtgtcagctgtgaagcatgtactgtattcttctggtggaaattagcatggccactatatcacaaatggatattatcgcaaaagttaattgtattactagttctgtttaaagataaagaatcagacatgtgcaat

SEQ ID NO: 227088 - DNA, 469 bp, Homo sapiens
caggagcttgtttcaaagccccacaccctcagacctgcagaatcagaggcaaggcccaagagtctatgttttaacgggcctccatggtgactctgaccgacactcaaggttgagaaccactgggatgcagaatactgggatggggacaggataccatgaccattttagagtgggcagtaagctaggtgtggtggctaacacctataatcccagcactttgggaggccgaggcgggaggatcggttgagcccaggagttcaagacctgcctgggcaacatagtgagacctatctctacaaaaaaaaaaatacaaaaattagccaggcatggtggtgtgtgcctgtagtcccagctacttgggaggctgaagcatgagaattgcttgaacctgggaggtggaggttgcagtgagctgagatcatgccactgcactccagcccgggcaacacagcgagactctttgtctcaa

SEQ ID NO: 227089 - DNA, 270 bp, Homo sapiens
tcatgttattagcatatgtcttggtgttctgggtcaatattcgaaggatatagcgtattctttcaaaaaagtttctttttttaattataggaaagtaactttggattatagttcttagtattcattctgtttcctccctttggttttcttctttaaggactgctatcacctgtataatagatttttacctattttcaatatttgttactatctctcaaatggtatctcttgtttttttttttcctctctcttttttttttttgagagaga

SEQ ID NO: 227090 - DNA, 542 bp, Homo sapiens
ctcagtcaatgaacaaaatttttgagctttgggtcacaataatggttattcttggagtgaagatactgatggggaggaagcatgaagcatctggagtgctatagatatgttccatatcttgatctgcatggtggttacaccggtatatacagatgtaaaaattcaacaaaatgtacacttaaaatttgggcattaactgtaggtaagtcaacctccactcctctaaagatatcctgaccaccactctgattgcaccaagaagttaggtcatatgcttacgtctgaacaaattgttgaggtaaggtggtggatgtgatgaaatcactaattaaggctttctcctgaactggaggtaaggtcagtaacacccaaccttacgtaagggctgctacccaagtggggaagagatggaagggggcaatagggtggtaattataaagtcctcacctaagagtatgtctggcaaaaaggccaagatggggaaaaggcaaatgaattgaatgtccagaataaacaaatctatgaagacagaaagtagatta

SEQ ID NO: 227091 - DNA, 439 bp, Homo sapiens
aagcgcaaaagctacaacccagccaggcttggccaggaggcagcagcccaggcggaactttcatctctggtggatggcagcgtaaacccgtgcaagcactttgggaactcgaatggtatctaggaaagaggaacacacatttgccctatgactgagcgattcattcctaggtttacactcaacaggagtgagtacatatgcccaagaaaagacgtgtgaaagaatgctcataccagctttcttcatcatcttgccaaacgggaaacgacccaaatgtccatcaacggttgaatgcataaatccattgtggtgtatttcacagcaatgaaaatgatccaaccgctgctccgatccacatgaatgaatcatgacacgttgctgagggaaagacgccagtctcaagcgaggacgtcgggcagaattcggttcatgtggagcc

SEQ ID NO: 227092 - DNA, 433 bp, Homo sapiens
ccaggaggaggtccctctgccaggtctctgcaaccccgtcaaggtgggtgaaaggctgcccctcaccccggacacacagtctgggctcagagagaacaaggggagccaggggaggggtcctgcatctccacccaggcctggtctcacctgttccctgcggcaacaggcgcagagcctgccccccccagccacctgctgtggtcataaatctccggccccagtcacctcctggccttgcgctccgggaaaaggtctgggacccgccgggcgccgctcttcccagtggtgaagcctctgaagcagaacatgccaccagcctcagcggccccagcggcccgggaaggcagcggcctcacggctcaggccctgggtgggcatggcctcctccagatgggatgtacagagggaaccgtcccgccttccagagcccacc

SEQ ID NO: 227093 - DNA, 727 bp, Homo sapiens
acatacacaagaccaaaatgacaataaatgactgaaatggaactcaaacctagcaagtcttctttatttttttcactctttttacttaaattttgctacctctccttaaaataatgagacatttaaagttgaaaataactttatatattggctagtgtatttgaacaccctcatattataataacaaaattattcctgagctgacagtattagaattttgatattttctcattatgtatatatacaagcacatgcacacacacaaatacatacacacacatacttttcacacatacttttttggaaaaatatccatagtcttagatgttataaagatatttttcattacaagttttaaaacatataaatcatggtctattttaaatgcctttttctagattgcagagatattgtgtaacattggtgtcaaactgtctgatgaagaatttgaaaatgtatggaatcttgcatcaaaaaagcatcacagaggagaagtttgtgttgagaacatcagaaatgttctagatgagctacggcatgcagaccggatcaagtgtaaaacactcatgtgatatttttggacttcattcattcaagcaaaagaattattaactctgtgtttatctaaaatgttgaatccattctggttttagatattatgttagagttcacagtggtaagactcatatgcctgtatgtgttgctaataaattagattttggatttt

SEQ ID NO: 227094 - DNA, 525 bp, Homo sapiens
catcaatctacttgttaccccatttgtggtgttccaaccattcgatctgacattcctgctccccgaattcgtcgcatcagtgacagaactaattatggtgaagaaggtagtgcatattcactactatatcctaccatttttgcccggaaaggagtgtttgaaagagacttcttcaagaccagatcaaaagaagagattgcagagatattgtgtaacattggtgtcaaactgtctgatgaagaatttgaaaatgtatggaatcttgcatcaaaaaagcatcacagaggagaagtttgtgttgagaacatcagaaatgttctagatgagctacggcatgcagaccggatcaagtgtaaaacactcatgtgatatttttggacttcattcattcaagcaaaagaattattaactctgtgtttatctaaaatgttgaatccattctggttttagatattatgttagagttcacagtggtaagactcatatgcctgtatgtgttgctaataaattagattttggatttta

SEQ ID NO: 227095 - DNA, 376 bp, Homo sapiens
gacttctttcatccactcataaaggactacaaagaaagggccaattttgttatatgaattctaggcctgaataacatggctcttaccaagctcaaaaactttaagtagtggagaaacaaagtctcacctcctcaaagatgacattcaaagactttaacaagttaccttatcacagttcttacgtcagtgcccaaatcatggagtctgcatagctaacactaacatgctcatgtattttttaaacgaactaagggtgactaccattttggccaagctgcaagctccttgagggaaagaattgtgtcttaaatccttaatgagtctgttcaagcaattctaagattaaaaatgaagtactgcatacaaataaaaaact

SEQ ID NO: 227096 - DNA, 456 bp, Homo sapiens
gctgtgctggggaacttgcgcatctgggctgttggctcaggcttttaaggctgatgagtcttgaggggaagcccatgtttttgctgcctctgtcaggttctctgagtacccctgcccatggctgggcatgaaggagcctcacatagggactgggctcacctaccaagaagggctggccggagggccaggggagaacagcctcgggtcgattcatttggagggctgatgggtgaagctgggtcctcctttacttagcccgcctttaagccagcttcacggtttccaaggtgcctgatgctggcttttggaaacacaaaggtttttaaaaagaggccaggtgcagtggctcatgcctataatcccagcactttgggaggccgaagcgggaggattgcttgaacccagaatttgagatcagcctgggcaacatactgaaaccccatctctatgaaaata

SEQ ID NO: 227097 - DNA, 415 bp, Homo sapiens
ctccaaaacagcatatatgcctaataactgagattaatatgatgtttaaaaatgttccagaaatgatgttgaagaaaacaaagtaaaatatacacaccaattgcattcattaaaaagaagtataattggctgggcgcggtggctcacgcctataatcccagcactttgggaggctgagatgggtgcgtcacctgaggtcaggagtttgagaccagcctggccaacatggtgaaaccccgtctctttactaaaaatatataaaaaattagtcaggcatggtggcacacacctgtaatcccagctactcggtaggctaaggcagaagaatcacttgaacctagtaggtggaggttgtagtgagccgagatcgtgccattgttctccgacttaggcaacaagagcaaagctcgtctca

SEQ ID NO: 227098 - DNA, 1204 bp, Homo sapiens
ccagggtagcattctttgcttatccaatgatgcctctttctaacctctccctctccacttacatcccaaacctgatgcgggtcttctctgattcggcactctaaggaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccggcgttgggtgagagtgggggaggggttgtcggcttctccatccagcttgccatgttctgtcgtcggtttcacattttcagagagactttaccagatgcaggaaatgaggatgaaggcaactctggaaggatgcaaagaagggagagcaagcactgtacctactgtctgctgtctaagagggctggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgatatgttt

SEQ ID NO: 227099 - DNA, 777 bp, Homo sapiens
gtcctaaaatttctgtgcaaaaacacctttttgaacaacccctcccccactctcacccaacgccgggccggtcctgtttcggatcctgcacactgtggaagcttcttgcttccttgttttgttgggtgagagtgggggaggggttgtcggcttctccatccagcttgccatgttctgtcgtcggtttcacattttcagagagactttaccagatgcaggaaatgaggatgaaggcaactctggaaggatgcaaagaagggagagcaagcactgtacctactgtctgctgtctaagagggctggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgatatgttt

SEQ ID NO: 227100 - DNA, 463 bp, Homo sapiens
cgaattttagtttctctgaaattctttcctgtaaggcactaggctgtaatgcaaagagcatctcacacctttaagagcaaaaatatcaaatgtcaacagccactactgtggggtaagaagaaaacctcacctttaatcatccttaaacttcacctttaagcatgctgagggctaatgaatgcgcgaaagacgttagtaaagtcaccttctgctctattcacccactcacaaattctccctccttatgtaacttcctgtcttcactgggaattgtgtactgatgcagctcacctccagctgtggtgatgaagtaacgtttaaaagtcagatttggtttgcatgccatccctgcacttaatgactgagctgtcttatgcaagttactttagtatctcaaagtctcattttccccatctgcataatgggtttattaaagattaaaggatcatgtgtaaactacata

SEQ ID NO: 227101 - DNA, 1262 bp, Homo sapiens
caaagaaatcctttagggtcttgatcacacttgtttaaatttccattgaaagctttgctcttgtcttcagctgatctgggtgtacagttgtggcatccaatgagtggaaagtttgctcaaatttaattttccatcaaaattgtgtaagctgaaccaattgagatgttggcataaacaagattaacttttcccttgcaaatcgatgtgactggtctgctgctgcaggcttcatctaaaactttgcttcgtcttaaactagttatgcatttgtaaactgctactgatttctttggggcattgtccccataaactatttgtaaagtatcaatgatttcaccattcttccacatcacaactttcaccatcaatttgatgtttgtccttgctacaattttagcagaattgattttgccttgatagggactctttgcaaactgatgtcctatccttcttagtgcctcaaactagatcctgttcagacatgttataacaagttagtatgagtttattttggtgcaagaaaatttatgttctcacaaaactatatttttttcaataatgaaaaacaaatctctccttaatttgagaagcatctggttttcctgaacttattttttcttaattcaagttgaactaaagtatcagttacacttaagtctaatagaatggaattaaaagtcacaatgtagaaacaatgtagggtttgggacaatgccttgtcccaattagggaacccgcaaagattttgacaaaatgaagaataaatgcttactggacatttcaagctctaactagcatgtttaaaacagatttcatcatctttaccaaccagtggcttttcttgacttgccaaatcagtgaatggtactgctcgttccctctttcttaaatcttgagtatgtttcattttctttcttcttcacctctataatcagagatcaaatgctgtcaagttttcctccccccaccaaaacaattccttgctcacctattcctttctctctccagttcctactctagtttcatctcatgctgataccacttcaacagtatcttgtctccctacttccaattcctgtgtcatttcttcagttacaatgggcattgtttctaaataattttccaacactgtattttgtttatgacatgcctttctgtgcctattcaaaaactctcagcaaaagtaactaaaattaaaagggaaatctgtatggaaaaatatgtgcagcaagttaccactataataaactcaatcaattaag

SEQ ID NO: 227102 - DNA, 1244 bp, Homo sapiens
caaagaaatcctttagggtcttgatcacacttgtttaaatttccattgaaagctttgctcttgtcttcagctgatctgggtgtacagttgtggcatccaatgagtggaaagtttgctcaaatttaattttccatcaaaattgtgtaagctgaaccaattgagatgttggcataaacaagattaacttttcccttgcaaatcgatgtgactggtctgctgctgcaggcttcatctaaaactttgcttcgtcttaaactagttatgcatttgtaaactgctactgatttctttggggcattgtccccataaactatttgtaaagtatcaatgatttcaccattcttccacatcacaactttcaccatcaatttgatgtttgtccttgctacaattttagcagaattgattttgccttgatagggactctttgcaaactgatgtcctatccttcttagtgcctcaaactagatcctgttcagacatgttataacaagttagtatgagtttattttggtgcaagaaaatttatgttctcacaaaactatatttttttcaataatgaaaaacaaatctctccttaatttgagaagcatctggttttcctgaacttattttttcttaattcaagttgaactaaagtatcagttacacttaagtctaatagaatggaattaaaagtcacaatgtagaaacaatgtagggtttgggacaatgccttgtcccaattagggaacccgcaaagattttgacaaaatgaagaataaatgcttactggacatttcaagctctaactagcatgtttaaaacagatttcatcatctttaccaaccagtggcttttcttgacttgccaaatcagtgaatggtactgctcgttccctctttcttaaatcttgagtatgtttcattttctttcttcttcacctctataatcagagatcaaatgctgtcaagttttcctccccccaccaaaacaattccttgctcacctattcctttctctctccagttcctactctagtttcatctcatgctgataccacttcaacagtatcttgtctccctacttccaattcctgtgtcatttcttcagttacaatgggcattgtttctaaataattttccaacactgtattttgtttatgacatgcctttctgtgcctattcaaaaactctcagcaaaagtaactaaaattaaaagggaaatactagagggatcctcttagagtcgggcagcaccaggcg

SEQ ID NO: 227103 - DNA, 234 bp, Homo sapiens
gggggccacggcgcgcgcccccagcccccgggcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccgc

SEQ ID NO: 227104 - DNA, 226 bp, Homo sapiens
atgccataatgaatgaccttctactgggtgacttaaaacagtggaaccgtctcctttcacagtcctaaaggccagaagcctgaaatcaacctgtctgcggtgctctgctccctctgtggggaagaatcttcttttgcctcttgcagctcctggtggctcctggcaccttggcagttccctggctgcaccactccagtcttcacctctgtctccacgtggccgcctc

SEQ ID NO: 227105 - DNA, 1601 bp, Homo sapiens
gattgaaaaagtgaagctttagcagcaagtagaaaaactgaagcatcagttgcagtaactcatccattgagtgaaaaggttcttcccatgtccctactctcagaaatgcattctgaaatttcgaagaaacaagacattacacaagtacatggcttcactaccaaggggaagggcaaaagaccatctttgatttaattccaggcttcagtgtctaattctgtggcaaagatagctcatgaattctttgttcctctgccaagcgcaacagggataagtagccttgctctgggaatatgagtttgatgattgggttgcatgaaccctggaagcctggaatattcatctattttcacattcttctgtccctcctgactgcagcactccccaaacctacatggaagagctaaaatcaattctggtaaatctcatcaacttctaggacactgtggtagatttccttcagtttaatctctagcattaactggaagaaacattttcttactcagtcactacatttgtcaagaaataatgctatggttgaacactgcacgaaatgatagagattaacagtagcacaatactagacatttcttttttgctattctacttaatgcctgatgtaacctcatgaggtggatgttgtactcctgactttagagataagaaaactgaacttttgggaggctaaataacttacttacagttacatagtcaagaaatggagatggcaagagttcaggcctaggtttgtctgattgcaaatactacatcctttctattgcttcacttgtttggctttaaagctgttaaatgagaatgaccattaataccccccagaacttctgtgaggattaaatggatatgcaaaagctctcgacataatacctggctcaagtatcaagaggagtgtagcacacacatgttacagctgaaaatgatgcgctgtgatgtcaagcactttcccaaggagatgcagctaatagttgccagagccataatgatattaggtgttgttccctttgtctgggacgccctctccgtacgtattagtctggaaaactccacttatcccatcagcctcagctctcacctcttccgagaccttccctgacatcactaggcaaatataaatgagccctctgaccatcccctttgtgcaagactcaggttaaaaaaatgaccccatgagagagtgttaatatttctttcctcaattagaatcttgaagtccagaactgtgcatttccatccttatatcagaatgtctagcacacaagaagcactgggaaatatgtgtggaataaataactgagcatgttgataaaggagcatatatttttaatatccatagaagtgcaaatctttgctgggtagcgttgtaggaatgtttttccacatgtcatgacgacatttgttttgcattttagtccattaccataataataactctccatttgcagcttatgaatttgaaaataaattgccttccctaggaaataggagaaaatactattaaatggccataattgttattactttgtcacctgtatattatgaaatctgaatagaaaaattcaactaaaagaactgaaatgcttagt

SEQ ID NO: 227106 - DNA, 1048 bp, Homo sapiens
gacggagtctcactctgtcacccaggctgaagtgcagtggcacgatctcggctcactgcaagctctgcctcctgggttcatgccattctcctgcctcagcctccaaagtagctggaactataggtgcctgccaccacgcccttctgattttttgtattttaatagagacagggtttcaccgagttagccaggatggtctcgatctcctgacctcgtgatccgcccgcctcagcctcccaaagtgctgggattacaggcatgagccaccacacccggccaattggggattatatttcaacacaaattttggaggggtcaccatcatccaaaccatagcagtgtctttgccaggggacagtggcctggagacaggatgatagaggtagagggaggtctgggaagcctttacaggggtggaaaactgggggcaaggatgggttgctgtctctgatgggccctcccaacaggcagacctgcttttggtcaaggttgaggcaaaccctgtgtattcttaaaacatatctcttctacccttgagtttcaggagctttacacagcagctaaagtcccccatggtcaggaccaaggatgttgggtttgggtgtgctcatggataaagaaggtgtataagaaaagaggaggacatgtcttgggtgtggctgagagtctgactcccagggagtcattcatttgctgaatccaccaaggtctttcccagtggagtcttgtgctgtactaatctggtgaccccttggacatgcctgttttgcactgacaagactgagtgtgggagcaagttgtgaaaaggatcttatgacactcccagcctggtatcaggcacagcaagcagatttcattccatcagcagctgtttcacaatagctctcgaggcctatcttggagcattcttcatttttttgctgacagcgctaggaatcctccctgatgggaaaggagctttatttgtaaacacatttgcaatgcattttcatatcactttgctgggtgaagcagagaagatataccatgcttacacataggattgttt

SEQ ID NO: 227107 - DNA, 460 bp, Homo sapiens
ctcatttcaccagaaataattgaattttaggggacttgtccaatttactatttttggctagttgtaggactcaaactagaactgcttcctggatctgtgctttttcattagaatatgttgtagccatgtggtagacagaaaaatctgctcccctcccctcttcagatgtccatattctattccatggaacttgtgaatatgttaggttacatggcaaagagagattaaggttgtagatgatattaaagtggctaattagctaaatttaaaatagggagattttcctgggttatctaggtgggtcctgtgtaatcacaagagtcctttaaatgttgaagggagaaacagaagagtgtcagagcaatatgctatggaaaagtttggctgccatcactggctttgaagatagaaggggccatgaaccagggaatgtggacctcttttggaagatgaaaaagcc

SEQ ID NO: 227108 - DNA, 636 bp, Homo sapiens
caagacagttctgaatacaaaaatgttttactgtctatcaccaccatctataaatctaattcactaaggataatctgtgtaaggtggctggaaagaaccttgaggagagaggcttatttaagtattggctcaggaccacacctaaaattctcaaaacgttgagattctgttgttttgtttttaagcgccagagacccaagttgaggaacagcctataaaataactggcctgtactcttacatacatgaaagccatcaaagacaaagactgaagaagaacttttgcagattaaaggactttaagagacatgatcctgaaccagaaaaagtaaaaaataaaaaaataaaaagatctgtagattagataatagttttatatccatgttaatttcccatttgttgtaatattactgtggttgggcaagagagtgtctttgttggtggaagtatctactgaagtatttaggggtaaagaggaatcatgtctgtaacttatgctcaaaaggttcagacaaaatatatgtaaagggaatgataaagcaaacgcaataaaatgttaacattggggaatctgtataagggaattattaacttttctgtaagtctaaaattatttcaaattaaaaataattttttt

SEQ ID NO: 227109 - DNA, 467 bp, Homo sapiens
catgcgctccttaccacggtcattctcagctgaatctacatcacattcacccggaagcctgggagtaatctgtacctaggagtctgtagggcatgaccagcctgcagtactgtgttgacgaggaagatggcagcctctttgatatgagatagggctcatctgcatgttacgtgtagtggcatgtcactgctgccactgctcttctgctaccaggatggcttgaatgcaatataggctgttccatgtgtgctttccctccgttatgaaacttcttcctgtggggtgagatgctgcagtgtgtgtcactttattcacttgaatcagaattcagctttgtatattgaatcccaatttttatggttacatctgaagagataatcacctatttgatattaactgtagaatcagtctttgaaatttataatctgaagcattactaactgcattaaagaacattaactgttttg

SEQ ID NO: 227110 - DNA, 504 bp, Homo sapiens
agtggtttccaatctttctattttgagccattaggcctgtctttcatttaatttttgaaacacagaccttaaatgttttgagatctttcatacaccaaactacttacttttgaagtatggaaaatcatttatcaatattcatcctgatcatcactggagctttttggcagcgtgaagtggctgggatggggtgtgtcggggtgctctgtgtaaggcaagcaggcctgacatttcagttggcccatatgtggtttggggtggggtacccatggtgcctgatagattttttgaggtaaggaagtcaacttgaggactcggcattccttctgttgaccctgagaggttggaaatttttggtctactccttacacccaaatcatgactcagatctttgtaaatgagtattgacagaataaccaaccctcctacttaatccctgagccacacaacaccctaagggggaaaaaagaacggagagggaaaaacccatatcttcccttaaaa

SEQ ID NO: 227111 - DNA, 211 bp, Homo sapiens
cgagcagcgtggtagagaaagagggaagagaagcagcatctgaatgttgagaggagtttggctggggacagtcggagaggagattggccgcaggacgacccaactccaggggaggaacatcttcctactccattcgcttccccactccccagccattccactgagagccacctccatctggcaataaaatctcttgcattcactatccttc

SEQ ID NO: 227112 - DNA, 472 bp, Homo sapiens
ctggtgttagtcttccttttgtttccaagcaaaagttatgcaataagacagaatataaagtctccgagagccttaagctttttttttcttcttcacgtctgtagtagatatttgtagatactaattcttgatgatcttagggttttgaatattatatccaaatataatagtacaggttaatttcctgaacaccttggtagtaagataatttaagaaacttaaggcatgatgggaaaaatagacatgagagtctgatgttcagaatttatctttgaaagcccttagaaatgttttaacacttaataaaataatttttagaaagaacaccacgtaaagaaaatatgttctgattttacactgttaatatctattaatagcatgatttttaacatttatctttatattgtgcaatgccagtttttactttttattgtttttcgagacagggtcttactttgttacccaggctgga

SEQ ID NO: 227113 - DNA, 831 bp, Homo sapiens
agggcaatacagtttttgtaaaattttacaaaaattggactccccccattgaaacactgtactttgaaagaaacttcaaattcagcatattttttaaaaatctggatgatgactcgttttctttctttcaaaccttttaatttcgacaacatttagcttaaggcaaattttatctttgttatagctatttcagaacagcttttaaaatgcaatttaaaaaatggcatttagcaagcaattgccttttcaaccttaaccatagagcctcttccatggattccattatattttattaacataagttaaaataggagtgttctgggtttcacaaggattaaagttcctatctaatgtgcatgtaactaaacgcacgtttacgtacataatagctattggtcacagtttgtatgatggtctttcagccagaaaacagggctgcagttcttacagtagtccttgaataatgacgttacattcaacgtcttttcattattgggttatgagaaaaaaatttgattccaggtgggtgcccctgtctgtgtggaatttgcacattctcctcaagtctgtttgggttttctctggatactacagttttctcccacatcccaaacacacgcatcgcatgttaggtttatcggcttgtttaaatggtcctacttttgagcaagtgcgctgtgtgtgtgtgtgtgtgtgtgtgtgtgtgtgtgtgtgtgtgttagtgcaccctgcgatgggatggcatcctggccagggttggttcctcctttgtgccctgagcttctgggatgggctctggcaacccataagcctgaactggaataagcaagt

SEQ ID NO: 227114 - DNA, 437 bp, Homo sapiens
gcttcagaataaagggcgcccgcggtcccccagcacctgcccaagccacacccctagcttccctccctatccctgcagcctgagggtcccttcagccacccctaagtccccacctgggctcctgccccgcccctggctagcagcgccttctccaccggggcccctctgctcacagagccccctcacctccctggggatgaggggccaggccatgaccctgaaagcctagccctggccttgacctcccaggagcgccctccccgccctctcccggccccggccccgtcctctgctgctggcctctgggtcgtgccccgcagactgagctgcgcttgggggtcctggcggcctgggccgtcccgcaccgaacccaggcggtcggagcccggcggggaggcgcgaggtccttctgggggctcctccgacgcctgagggcg

SEQ ID NO: 227115 - DNA, 413 bp, Homo sapiens
aggttgttttaatatctacttggtttttctcaaaatggaaataattttaaaatcaggaaagaataaatcagccaggtgtgatgacttgtaactgtaatcccagttataggggaggctgaagcaggaggatcacttgaggctggtctcgaactgctgacctcgtgatctacccgccttcgcctcccaatgtgctgggattacaggcatgagccaccacgtccagacttatgtatttgtttttattcatatgttcattattgtctcatataacacagttttaacagctttattatggtgtactttacataccataaaattcacctgtcttaagtgtataattcaaagatttttagtaaatgtacagaattatgcaatcattgccacaaagtggcaacagaaaattttcatcacca

SEQ ID NO: 227116 - DNA, 490 bp, Homo sapiens
ctgacgctcagccttggactttgaaaaggcacgactgtcctgtctgatggacaggatgcagaagcctttgggaatgggcattttgccagaataaataaaagaagacaattggcaaaagatggactgtaccccatggccccaggctgctgtgtggagagacttgtcctctcctctgcccacggtcaccagtgagcaccagggacggggtttcctgctgcacctgggcctcttcctgctgccaggagctgccttgctgcctccacctgtgacagtccaccccccataccccccccacccgcaccatgagaggatttccagggcccacccgcctccagtccccgttctctctgctgctttcgaggtcaccctgggctggaaggggtgcctgggatactgctcagacgtcttggccgccctcccaccccgcaacaccccgctcctggttttcaggatgaaattgtcctcaaataaagcaagcttttgagtcaac

SEQ ID NO: 227117 - DNA, 479 bp, Homo sapiens
gcgtgtcaggacggagggtgctgtaggactatggagttagcgtgtggtgcaagctgtaagccagtgagtgtctggttagaggctgggctggggctgagcacgagggccaagaggtgaccgccggccagaaccagccgtggctgcccagtcgcccagatggtggtcccagggcagggagtgttagcacctgccgggctcagcctgggcggctcagagggcgggacctggagaaggagggccgctcggcaaccgctgagccggcgcaagagctcaggccctcagggagcgtggccagatccggcagatgaaatccaggacacccagttcaatttgaatttcagatacacagcacacaagtacgtcccaaacacagccagcattttgttgtgtttaccgcatttattctattgattgactgaatttacagcatttgatctggggacctgcccccaggctcccaggccttttgcgatcccatt

SEQ ID NO: 227118 - DNA, 778 bp, Homo sapiens
ttgatccttccagatagtctgtgcacatacaaacatctacagttttttaacaaatggtagcatactatatatgtttcaccactttgctttccttgcttaaaaatattccttggtgagcatcccatatcaatacatatgaaactacttcaattaaaaaaaaaattttaggccaggtgtgatggctcatgtctgtaaccccagcactttgggaggccgaggtgagtggattgcctgagatcaggagtttgagaccagcctggccaacgtggtgaaacctcatctctacttaaaaaaatacaaaaattagctgggcgtggtggcaggcagctgtaatcccagctacttgggaggctgaggcaggagaattgtttgaactcaggaggcggaggtttcagtgagccaaggttgtgccattgcaccccagcccgggagacaagagtgacactgcatcttaaaaaaaataataaaaataaatttttttttaagttttattttattgttttaagaatataatttaggccgggcacagtggctcacgcctgtaattccagcactttgggaggccgaggcaggtggatcacgaggtcaggagttcaagaccagcatggccaagatggtgaaaccccatctctactaaaaatacaaaaattagacaggtgcagtggcagttacctgtaatcccagctactcaggaggctgaggcaggagaatcgcttgaacccgggtggggcagaggttgcaatgagctgaggtcatgccactggactccagcctgggt

SEQ ID NO: 227119 - DNA, 580 bp, Homo sapiens
gttcaaatggtaggttattttgaaataggatagactttgcagctaagattccagatttagttcagttaattcattctttagtgagtttttcttgggaaaatattttggaattttcatttcaaatgcatcctcctcatttaagaaaaatccagatgagtagtttatttcacaatataataactaaataggatttataaagcagaaatttataaatcctttcttttgctgggacaaaggcaatggtgaaaattaaaaaaaaataaagttaggacatttaggtaactcaaagacagaacttaatggctgttaagattggagtatttggttttgtagtttttaaaccatatttaattttggccatatctatcttatttagtagtttaaaggataaacagttcaaacagtaagaaaaaagcagtttgtgttttgtcagttttcaactttagatatcagtaaatcattgctgtagctttctttatcttttgtttgcacaaaaaacctgttagaattatgtctgcggggaccatctgctgtggttcccagtcttgtcagtgtgataagggataagctgtataaacag

SEQ ID NO: 227120 - DNA, 388 bp, Homo sapiens
tgagtatctcactcatggaagtggcatttttggaattgggaagggggaaggttaatggagagttagtgcacattgctttgatctgcactctcaaaaaaaaaaaattccggctgggcgcgatggcgcacgcctgtaatcccagcactttgggaggctgaggtgggcagatcacaaggtcaagaggtcaagaccatcctggccagcatggtgaaactccatctctactaaaaatacaaaaattagctaggtgtggtggtgggtgcctgtagtcccagcaacttgggaggctaatgcaagagaattgcttgaacccaggaggcagaggttgctgtgagccaagatggtgccactgcactccagcctgggcaacagagcgagactccgtctc

SEQ ID NO: 227121 - DNA, 490 bp, Homo sapiens
tgacattaggtatttcatttgcctacagatagaaactacattctctaatattatgtatataaatactaaaggtctctaattggccttagctttccctttctggtaaagttggataaggaagaattactgacttcctaaagataccagcaatcctgaggccttttctgaatcacaattccaataaatggaacccaaaataacattttattgatctcacatcaaagttgcagtatttattcgcaaatacatttttctttttttttgttgttttttttttttgagatggagtttcactgttggtgcctaagctggagtgcagtggcactatcttggctcactgcaagctgtgcctcccggattcaagcgattctcctgcctcagcttcccgtgtagttgggattacaggcgcccaccaccacgccccgctaattttttgtatgtttatttgagacgggcttcaccatgttgagcaggccggtctcgaacttct

SEQ ID NO: 227122 - DNA, 745 bp, Homo sapiens
agacatggcaggtggctttcccagagtggcagtctaagaaagaaggcaggagggagcgttgtggggctttcttatgatctgggcttggaagtgatattctgctacattctgtttgttagaagcaagtcactacgcccagtcgacacttagaagaattagcttccacttcctgaagggaggactgtgtaagaatttgtggacttatttaaaaactaccacatacctaatcacattgtaataacattaaagagcacaaagaccaagaaaataccttaaaatcagagagaaaggacatactaccttttgaggagcaacatagcagcagatatctcagctataaccagtgtaaacaggaatgaaagaaagttgtcatcctagaattgcatactcagggaaaatatgagacgtgttttttgtttttttgcagagatggggtctcactattttgcccaggctgatcttgaactcctgaactcaagtgatctgcccaccttggcctcccaaagtgctgggattacaggcctgagccaccgcacctggcctaagatgtttttagaccaacgaagtcagggattctgtcaccagcagactctcactaaatgaaaatctattttggggtaatgaaaatgttctaaaagtgattgtggttgcacaaatctgtgaatatgctgaatatgccaagagccattgaattgtacactttaatgggtgggctgtatatgtataaagttgttttttaaaaatg

SEQ ID NO: 227123 - DNA, 412 bp, Homo sapiens
ttgttgagtctcctctttgaagaaatactttttggcaatgatgacacccaaaagagcaagaagcaccaagacagaaatacagactccagcacagattcctttagtggtgttgaccatctgtggactatatgctggggacagttgagtttgattgttattccaaaggccatctgaagactctgtcatggtgtcattcccatctgttgtgaaagagtgcaatggtgagctggtgggttgtgtccttatttctccctgaagtgtcatagggtgggtttctgctggctgaggtgaagatggtgaagtggctactgattgatggttctgcgtgggcaatggcgttggaggaacaaaggtagagaccattgttgtcattggaacacttgttttcattgaaatgctcgttgttgttgga

SEQ ID NO: 227124 - DNA, 688 bp, Homo sapiens
agaaataacagagtttacacgtatttgaaatgactggattttatatcactgtggttgagaaagggaacagctcgctgtgatagaattatgatccctgtcaccgaggagcaaagagtatttgggtcaaatattttcccacgaatgttaacaaacttatggagtggatgtccataaagggttctctaaatgaggaacattaatgagctcagcagacattcatccagtgactcaaacagtgacattaaatgctattcctgctacacacaaaaacaaaaagtttgatatttacggaattccacacactgaatccttaaggcttattccttctttaaaaaatgacatcctatcccttgtttgcctctgtagcatcactgataagtctgtttatttgagagcttcaacccaacctctcaaacaggaaatgaatgaaggagtatggatagaggaaaaatggagaaaaagagtgtggtgataaaaattttgacatttctgaaaaaaaataaaaaattaaaattttaaaacttttgttttccctatgtaatagaaactttccaaaactacaagatagttacaagaggcaaaatacatgcacaaaaaaaggaaaagtttgataaaattttgggcttaaggactacagttagtatcagtcttctcccctcccgggatacagggctctcttagacatcac

SEQ ID NO: 227125 - DNA, 552 bp, Homo sapiens
aactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctc

SEQ ID NO: 227126 - DNA, 455 bp, Homo sapiens
aattcatgctctaaggtgacctgggacagagtgaggcttaatccaaattatgtcataagctgcctctacattgcaagagtggggaataaatccaagaggggatgtaccttaaagcatcaggccagctccaggaagtgaatgattagagtgaataaaggccttgagagttaagaaggcaagtctcctgacccttgagaatctgcaaagagcccttaccaccttgcttatttctagtcctcataaagtttctgagaacagaatgcagtgttctcagaatgcatattatcttggcataactacaaatcttaaaaagcatattccttgagcctcaaaacatccctagaccatttaggacatacattatctaggttaatctttacaacgagaatatttttgcttgtcctttgtggaatggttctctatagaaataaaataaaacttaggaaactctggtc

SEQ ID NO: 227127 - DNA, 487 bp, Homo sapiens
gggccgtctcatttaactctgtggaaggcacacagtggaaatacagctagtactgtacttgcggattgatgatcaagtgcgttaattaactggaaaatgaacaaataaatagaaatatagctctgtcttcttgaatgaatttcccatgagccagtgaaaattacagctgggatttggaaataagcttggttcatagattgcaaaataaattttcttcagtggctttccaacagagataatgacaagatttgagagcttgcctcttaccagttaatttaaattaagatgacctaataaaggtctctgggcatttcttcataagaatggagactcctgctgaatagttagatatcagaaacaaggaaaagaatgcaaaggttctgaaatatgatattgaagacttgtatggaggatgttagaaaatgattagcaatatgttttaagcactttttttagagatagacattctatatacttattaatattt

SEQ ID NO: 227128 - DNA, 372 bp, Homo sapiens
ggatcctctccaactaggtaactcgattccctgcagcccagcaccagcccagctctggccaccagagccggagctctgaagagtttacctccaacatggcagtgagcagttttcaaggtcaaggagggtggccaccaggagctcctgagccagggtgcatggggagaacacagggctggcaggccaggttctagctccagctcttcactaacttgctgtgtgtctttgaatgtatcacctcctcactccggacctcagttctcataaaagggagactgacagaaggtccctaagtgcttacagatggactggccagggtcgtcttggtctatagcatccctttcaaataaagatctgactattctgtgcctg

SEQ ID NO: 227129 - DNA, 375 bp, Homo sapiens
aactgtgaaataattaatgtgtgttgcttaagccactatgatggtagtaatctgtcatgcagcaattaaaaaacactactacatcaataatcaacaaatatttactgagcacctactatgtgccagtagctgttctaatatttgggatacaatgttgaaaagaacagggaaagtctctgccttcaggaagtttctattatgtgttgaggaagaagatcattgctattgtcaatttaatgcaatcacttttttcttttctctgagtgatatctgttatgtggatttttccagtttcattaggttaacactagctgctgtcagcagatgaatacccaaacactggtgacttaataataaagcataattttttcttta

SEQ ID NO: 227130 - DNA, 199 bp, Homo sapiens
ctgagtggtgtccccccactaattcatatgatgatgtccttaccctaagtacttcagaatgtgaccttatttggaaatagggttgttgcagatgtaattggttaagatgaggtcgtactgcagtagggagggcccctggtcctgtacgactaggtgtccctatggaaaggggaaatgtagacacagagacagacacaca

SEQ ID NO: 227131 - DNA, 903 bp, Homo sapiens
  misc_feature (168)..(168): n is a, c, g, or t
  misc_feature (180)..(180): n is a, c, g, or t
  misc_feature (218)..(218): n is a, c, g, or t
  misc_feature (251)..(251): n is a, c, g, or t
  misc_feature (335)..(335): n is a, c, g, or t
  misc_feature (360)..(360): n is a, c, g, or t
atactgagactacataagtgtccttcaaataatgcagaagataaagatcataggcaggcaaaaattacttaataaattaagctctttaaagaagtgaaagaattctctccagaaccaacagctcttaaatattctatttcaataaaaacaatttatatacaattgcgngtgaaacttatnttttggcaaatactcttccggtaagttatgaacatttnctcttgataaattttatactaggtatataagtntcctttattggtgttttggatgacagcaaatgactttccataaggcagatgtagattttattcacacaacttttcaggagtagnctttatgtaaatatgttaggactgntctttccttgagctttacagttaaccaatgaaagtgagttattttagggaatggttagatttggacatggaccaaaattagttttctaatgagtggtgttaaagatgtgtaactactattacagagataatgtaaatggccttctactttttaattctctgattctgatcttgttttgtagtaagaaaggctcagtatgaatttgaggtacttaactaacttgttacagtggtggtcagtgaagaaagattctatcgggcaggactctctggaatgcatgtgtcagaagcccagcccaaattggcctcagcagaaaacaaaacatagcgaaaagcaaatgacaattcattggctaaagcaatggaaaaatacaaggatatctagcttgagactcagctagagccaaatattcaaatctggtcatccaacattgattggtttttttcactttacttagctgtgctaaacactgttggcttggttttggggcacgttcttctcaaacatggtgaaagtggcccctagcaccgccaagattgatcc

SEQ ID NO: 227132 - DNA, 696 bp, Homo sapiens
gggcagggagggcaacattgcagagagtttttgtgccacgccttggaatcggacaatactgggttttaaggctggatcagtcacatactagccttgtgtcctagggaaagtttcttaacctatgaaacctcagttttctcatcagggagaataataattactaatatatatttcatatggtggttgtaagggttaaatgacatactgtgtataaagcatagtgcttggatgtaatgagtgtttaataaatacccattacgtcacatttgtttgttaaatggctggaacattccacttggggaatgctttgagttcctagggaaaaaaaaaatatgtttaggtgacattacatgtaattaccaagttggttaaaaaagtgagattcgtgaattttaagcagattatctcagcaaaaggccgtgaacttaagttgtgatctggatgttagtagttgccattgagaataaatatatgatgtccaccactgaatttgctcaatgtctctggttcgctaaaagaatgcagttacttcatcttagctgaagatcagccattaaccatgacacagggctatggatagaatagtgcaggtttatctctgtgagtgtgggaaggaaatggtaagaacggtatatgccagtggctagagggtgaattcgtgcagagagataaggagtgcttgttaggatatttttg

SEQ ID NO: 227133 - DNA, 426 bp, Homo sapiens
gatgcctgcaggatcacactgagcagacacactagtttcatcacactagtttcatcttctgcaccagaaaggaagaatctattttgcctggccaggcatggtggttcacacctgtaatcctatagcactttgagaggcagaggcaagaggattgcctgaggccaggagtccaggaccagcctgggtgacatagcaagatcctatgtccaaaaaaacaaaattcaaaaacataagccaggcagggtggtgtgcacctgcagtcccagatacttgggagcctgaggtgggaggttcacttgagcccatgaggttgaggttgcaatgagccgtgattgcactactgcagtccagcctcagtgacagaacaagaccctgtctctaaaataaaaagtaaaataaataaatattttgcttggaaaccgagtt

SEQ ID NO: 227134 - DNA, 142 bp, Homo sapiens
tttttctacatttaagaacaggcaaaaatggctgtcaaatggagggacagtggagatcattacccctttattaattaggctgtatatagtaagtttgaatccttaaagatcctgatttaacttacattaggcctttgtgaat

SEQ ID NO: 227135 - DNA, 686 bp, Homo sapiens
gagctcccaacaagagggcagtgtattactcgtgtctgtggtgctgcagtaggtgtgaccaaacctactgccccagtcataccagagtatacacctacagttacgtacagtaccatacagtacgtaataattgatgataaacgactgttactactttgtgtatttgctatacttttaagagcatattctgcctacttactagaaacaaagtcaactgtaaagcagcctcaggcaggttcttcaggaggaatccagaagaaggcaattggtgtcacaggagatgacagctccatgtgtgttgttgcccctgaataccttccagtggggcaagatgtggaggtggaagatccagaccctgtgtaggcctaggctaatatgtgttttttgtgtctttttgggtttttggtttttttgttttgttttgttttgaggcagggtctctccctcacctgggcggaagtgcagtcatgactcattgcagccttgacctcctgggcccaagtgatcttcctgccttatttttgattttttgtagagatggggtctcactgtgttgcctgggctgttctcgaaatcctgggctgaagcagtcctcctgcctcggcctcccagagggctgggattataggcatgagccactgtgcctggccgtgtcttcatttataacaaaaaagttcaaaaagtta

SEQ ID NO: 227136 - DNA, 475 bp, Homo sapiens
ttcagccatgaataagaaaatcctaacatttgtgacagcataaatgaaactgaggacatgatgctaagtgaaataaatcaggcaggaaaagacaaacactgaataatctcacttagatgtggggtctacaagagtccaacttaaagagtaggatagtggttaccagggcctagggcttgggggagatggggagatgttggtcaaagggtacacactttctgttataaataagttctagagatctactgtacagcatggtgactctagtcagtgatattgtattgtgtgtttgaaacttgctaagagaaaagagcttaaatgttctcaccacaaaataaaagtaaaattgacaactaggtgaggtgatgtctaactgtataatcatttcacaatatatatgtgaattaaatcgttacattacacatgttaaatgtatacaattttatttgtcaattatacttctgcaaagcgggag

SEQ ID NO: 227137 - DNA, 246 bp, Homo sapiens
acctactctatccccagcaaacattaaagctgagggcagatctaccagtgttgtaatgaatggagttcattgactggctttctaagtgttttcttaaaggtgaggtggcatgtgatccctgtgtttggagtctgaagagaggcctccattctaaactggattctccttttagttagctgtgctttggactcaaaaccttcttgggatgaacatatttcttttgagtctccattcactggcccaagg

SEQ ID NO: 227138 - DNA, 142 bp, Homo sapiens
aaattgttcctgactttgttaagaatgaatctaaagttttaccatttaccatcatgtttgctgtagattttattaaggaagttcccttttgttactgattttctgttttattaaaattgtgagtgaaggtaaaaaacttttt

SEQ ID NO: 227139 - DNA, 520 bp, Homo sapiens
ctgggcctgctctactgttgtcagtgagaaaccaactggtaaatgggtgtcagctgtgaccctcgaaggaaagggatcaccctctttctgaccctataccaccttcagcagggatgaaggcagtcagagaaaacttagttaaaaaatttctaaactgctttgctgatttgatctggggccctggagtgccaacatcctgtgatagcggctgattgttgatgcctgggaggatacagcagtgacgatccaaatttacaagactcaacatggttttcaaaacctccttttaaaaaagatgttcctgagttctggaatctgaacaaaatatgtctggttattatataattctaatggtccttgtggatgctaccattagagttcagttagtgtctcatctatcactgtaatatttgtattgtaacactaatcgtggcaaagtatgatttgataaatgctcattctcaaatcttttattttagtgtgttcatgtaagattaatgaccatgatgacttgagatag

SEQ ID NO: 227140 - DNA, 418 bp, Homo sapiens
tcatactatgatattactactgtttatttttctaatgtacattatttctaaactgctttgctgatttgatctggggccctggagtgccaacatcctgtgatagcggctgattgttgatgcctgggaggatacagcagtgacgatccaaatttacaagactcaacatggttttcaaaacctccttttaaaaaagatgttcctgagttctggaatctgaacaaaatatgtctggttattatataattctaatggtccttgtggatgctaccattagagttcagttagtgtctcatctatcactgtaatatttgtattgtaacactaatcgtggcaaagtatgatttgataaatgctcattctcaaatcttttattttagtgtgttcatgtaagattaatgaccatgatgacttgagatag

SEQ ID NO: 227141 - DNA, 462 bp, Homo sapiens
ctgggcctgctctactgttgtcagtgagaaaccaactggtaaatgggtgtcagctgtgaccctcgaaggaaagggatcaccctctttctgaccctataccaccttcagcagggatgaaggcagtcagagaaaacttagttaaaaaatttctaaactgctttgctgatttgatctggggccctggagtgccaacatcctgtgatagcggctgattgttgatgcctgggaggatacagcagtgacgatccaaatttacaagactcaacatggttttcaaaacctccttttaaaaaagatgttcctgagttctggaatctgaacaaaatatgtctggttattatataattctaatggtccttgtggatgctaccattagagttcagttagtgtctcatctatcactgtaatatttgtattgtaacactaatcgtggcaaagtatgatttgataaatgctcattct

SEQ ID NO: 227142 - DNA, 415 bp, Homo sapiens
aggggaagctttggtccagcctggcagcctgaggtccagtcctactctgcctaccccgccgttaggcgagtccagccctgcaggagtgccctaagcactaaagagatttccccagcttgccagctttcaccccggagctcagcagatggctgtgactgcctatggtggggtctccggcagcttgcttcccgcaaagctccttccagggctcagggcttccttcggggtttcctgctacgggagatttggagacagatgtgccacatgaaggagaggatggccctctgcaagccaaggaggcaggcctggaacggacccttccctctggccctcggaagaacccagcctgctgacaccttgatttcagacttctggcctccggagctgtgaggcaataaatgcctgttgtttcagc

SEQ ID NO: 227143 - DNA, 383 bp, Homo sapiens
acaattgagggctgttcacctgcttagaatcacagtgagctgcggcagaggcctccaaagcacatttgtagaaatgaagagcggcccattcaaggaaaaaactccccctgtttgcttcttacagcagtttttgtttatctcattatctcccaacctgaagaacaggaccatctggcatgcgggcatgttaacaagatcataaattaggaggagaaatgaagccagatttccataatggtcgcaagacagaaatcaacagcgctgggatggaatttgcttggaaggtggggtgggagggaaatggagcaaaataaaaatgcctcagcacatccagcctgaatgaaaaacacaaatccagagtcatttagaaggagtgatttaaa

SEQ ID NO: 227144 - DNA, 349 bp, Homo sapiens
cttgtttatgggatatatccagagtaacaaatccatagagacaaagtagatttatggttcccaggagttgaggggaagggagatgagggagagtgactgctaatgggtacagatctttttgggggggtgatcaaaatgttctggaattagaaatggtgatggttgtacaactttatgaatatactaaggaacactaaattgtatattttaaaagggtgaattttataatatatagattatattgcaacaaaaattttaatatgtcatacagagagaactgactacaaataacactttataagtttgaaggctcttttttattttatgattcatgtacatggctttttaa

SEQ ID NO: 227145 - DNA, 532 bp, Homo sapiens
acaggctccatcagatctgagtgagggctcccaaaaaagagtgaaaaggcaattctctgtccaactgtgtggatgcctcagaacactgacacagcccatgtgaagtctggccatttcagaagcccacaggagatgaggctgagaccctttgcaccaaggcaagatggcacctctgcagccaacaccatggccatcttcactgttgccagggctgagtggggtggctcactcccgctgagcctccctgcttgaatctgaatcccaggcctgccccttcctagctggggacattggtcaagtttcataattgctctgtacttcagtgtcttcatctgtaaaatagggataacgacacccacctcactgggttgttgtgtcaggggttagacagcgcgtggaacacactggtgttaggtaagtgctaggcaccctcgagtcctcttcccatccaaagaagccagtgggaggggccctccctgacaagctgaacccacaccctctgcaaaagagagaaagactgaactgacttaga

SEQ ID NO: 227146 - DNA, 490 bp, Homo sapiens
cagggaagaaccaggtggttaaggaccagtgtcttaaagtaaatactctgtatttgagtccaaaatgaatttcaaactcaggttagatgtttcttcttaatcacttaggagccagtaagactctctaagccttccttcctacgctctttcactaaaggaccaggttctttcaggtgctatcctatttggaatttaatttgccctaacatttctccaagagccattacagcacaccacattgctgtatcccatttaactcccaaaccgcagagaagctggctgcagcatcaaacactattaaaaataccacaagggaaccttagagtgggatttcaggcacaagttacagcctaaggacaaacagcggttgtaaagagcttgaatgatactggaatggagatttaggagaattttcagagtctgaaaaaacagtccttaagattttagtgttggttcctagggctggttctccgtggttatatgggttagt

SEQ ID NO: 227147 - DNA, 598 bp, Homo sapiens
agtaaatctgttgacaatcaccatgtcaatcagcccttgtatatgaacatgaatatgattttacttactctgaaagggtatttaataacataacattaataatattttacctgttaatttatctttacctgacagctttccccataatgtgagtgcaataaacagaattgcctactgttgacctaattaaagattaaggaacaaatcaattaaaagtaattatttctagcctctctttcttgtaagtaccatatcctggattataggagacaaagcaaatcttcggtgctacctagatgctattatgtatcaaacatggattgggttatcaaagtgcctcctcctttttatatagctccaaattaggaacatgatcttaaaggaaggcagcattttaacatgttgtcagataagaatgcagatgcccagggaattgagaaggtcatagtattgcctagcttatttactaataactgtatcagaaagtacataagaaatgttagaattttaatttctctagaggccaggaatctttattattcttgtttcatttcggtattttgaaatactaaaaagcagcacaaaagcatgaaattga

SEQ ID NO: 227148 - DNA, 289 bp, Homo sapiens
agagccaggcacatagtcaacatgctccaaatgaatgtctgtgacgcagcactctataaactgtcgttcccgcaactttggtcccatctacccctgccatctgtggatgctgtgtaggcagcagcctgcattgaaccaggccttcacttagggcctagtgcctagctggtgctagggaaagatttgttcagtaaacccatgaggcatcaccaccaccattcttcccgagtccctggagctgggaggaagtagaagggagggttctaaataaatgcgtgtgaggcccctg

SEQ ID NO: 227149 - DNA, 358 bp, Homo sapiens
gagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttctgtcgtcttctc

SEQ ID NO: 227150 - DNA, 987 bp, Homo sapiens
gtggggagcgcctctgccccgccgccccgtctgggatgtgaggagcgcctctgcccggccgcgaccccgtctgggaggtgaggagaccctccgcccggcaaccgccccgtctgagaagtgaggagcccctccgcccggcagccgccccgtctgagaagtgaagagcccctccgcccggcagccaccccgtttgggagatattgaattttccaagaccactctggcccaccatgcccctcatcctgtgcccataaaaacccaagaccatagcaggcacacacacaaggggctggatgtcgagaggagcagaagagcagaagaacacaccaacagacaccagcagacactgacaggccatcgacaacaggacaacgtggaattctgtcaggggtggttcttgaagagcccagccgctaggtggcgcaactccaggggaagaccaccttcccactccatcctccttctggctccacatccatctcactgagagctacttcccccactcaataaaaccttgcacccatcctccaagcccacatgtgatccgatttttccagtacactagggcaagaagccgggatacagaaagcccttgtgataagacagagagtctaattgagctgcttaacacaagccacctgcagagagcaaaactgcaagagcacactgtaacacaggcccactggggcttcgagagctgtaaacacttaaccctagatgctgctgtggggtcggagcccaaaaacactccccagtacctgcatcctctacatgctccccctagaggtttgagcagccgaggactgaagaagcgagccacatccctgttgcatgccctgtgagggggataagggaactcctccagtttcagaggcaggcggatcgctcgagcccaggaatttgagactagcctgggcaacatggtgacatcctgtctgtatcaaaaatacaaaaaaattagccaggcatggtggtgtgtacttgtga

SEQ ID NO: 227151 - DNA, 401 bp, Homo sapiens
tcaaaaaatggtctttttcccctgaagactcaaagattcttatgggaacagaccttaaaagatgaccttttcaatttatccctaggttctgcttttctaaatatatgccacagaattcttgagttttctctcttaaaatagaaagctaaatgcaactatattatagctaacagaataaaaatttcacaatcatctagaaaaaaacccctgacaaccagtcagatcaagattcccttgatatttccctactccagaattttagattacctattctatgaaacaatccactgtaaaatctaaaatgtttacctcttattctagtattacaaatacataaaagtttcatataacagaggcaagttagtaacttctagttaaaaactaatactgtaacaaacaac

SEQ ID NO: 227152 - DNA, 342 bp, Homo sapiens
ataatagttgttctccttaagagtcccttaaaacttttttttttaattaaataactaggccaggtgtggtggctcacacctgtaatcccagcactttgggaggctgaggtgggtagatcccctgaggtcaggcattcaagaccagcctggccaacatggtgaaaccccgtctctactaaaaatacaaaaaaattagccaggcatggtggcgcatgcctgtactcccagttactagggaagctgaggcaggagaatcacttgaacccaggaggtggaggtttcagtgagccaggatcacaccactgcactccagtctgggcaatggagcgagactccgttttg

SEQ ID NO: 227153 - DNA, 235 bp, Homo sapiens
ggaggatcgcttgagcccagaagtttaagaccagcctggccaacatggtgagaccccatctttatttaaaaaataaaaattaaaaaaaagagccgggcatagtggcctgtggtagttccagctaccccacaggctgaaacaggaagatagcttgagcccaggagatagaggtgacaatgagctacagtggtgccactgcactccagcctgggcaacaaaatgagaccttgtctca

SEQ ID NO: 227154 - DNA, 676 bp, Homo sapiens
caggtagagcttggggttagtacatcactggcctgcgtgctccgctccaggaggtctcggtgattctgccacagcctcatcctccgtcgccctgtgacctactggtattggaacattcatagctaagactccaggacacccacaaagccgagaaatgctgagtttgcgggtcagggcgtccggagactggggaggcctcatcggagtcggccggaaatggcggtggcgggaccgagtctgtgagcctgagcccccctcagctcagccctcagtctcctctggtgcagggtacccaggcgtcctgtaccgtttcagcacagcggctttggccccagcctgtagccctctttgcgcagctctgcgcccgcatcttccccagcttgtgaggtgatgaggagaggttcaccagggaaagacgccgacttggtgtgcagggcttctgcgtggaaggagctctggtctgtggggtcaccagtccctactttaacctattcagacataaacggaggcaccattaaaacattaaagaatttatatgagcaaacagtgatgaaccagtgggacagccccagacatggtttgtcgtttgggggctaccagcgggtcttgaagaaaaggctttaaggtttgtgaagaggcaaagcaaactaaataattgattgggtaaaaaaaaaaa

SEQ ID NO: 227155 - DNA, 154 bp, Homo sapiens
gttgttttgtgacatcatctcctgagcaaaatcctggggacgtcatgcgagagaagacagcgtggtgttctgggaagagaccagccttgggaaggattcctagggataccgactgtctgaccctgggcccctcaaacctttgtttctctatctg

SEQ ID NO: 227156 - DNA, 516 bp, Homo sapiens
ttgcctaaaacatggttctaccagtgattttcttaagttcaagaagaaagtcgcttctccactgagatatttacaatcatctctgacattgcagaagtgaattactggttacagaatgcttccattatacattatctcacaagactggatcatccagccatgaggggaagaaaagatgtgcaaatattggaaggaaaaagggttatggagatgaatgatctgtgcacctgggctatggatcgagatctactatcacccagttgagtaacttcaaataagtcacccaacctccctgggccttgccctcctgtgtaaaatgagagactttgagtcactcacagataccacctagcttttaaaactcttattctgcaattcagctaattcggcaacatcgctgagacacggcccccgatggtctaagtccttgctggttctttgtcctctctcaaacactgtaatccctcttaacaatatctgtttctccacaatcgaaaaactggacttcattaagga

SEQ ID NO: 227157 - DNA, 414 bp, Homo sapiens
ttctctctttccaaagatgaaccaataaacaacttatgcttggcaccagcccttagttctgacagcacagagaatcaccaggagatctttcaaaatactgactctaggacaaacattgcatgattgcactcataggaggtaactgtcaactttgtagagccagaaggtacatggtggttaccaggagcggcaaggagtggaaatagggtgttagtgtttaatgggtaagagtttcaatttgggaagatgaaaaggttctggagctggatggtggtaatcgttgcatagcattgtgaatgtacttaatgccactaaattgtacacttaaaatggttaaaatggtaagttttatgttacatattttactaaaattttgtaaatgcaaaaattaaaataaaaaaatactgatgccca

SEQ ID NO: 227158 - DNA, 430 bp, Homo sapiens
atggggtgaagtctgtgccaggaacaatggtaattgtgggagtttcaatgaattgtgagtagagttggaggagttagggggtggaaagtatatacaccaagtgtgagtaggaaaatagatgttgaaagttatgagagctgtagagagtaagtggggcatggtttgtgagcttgaggtcctccagaagtattgaagcggcagctgctgctgcacgtagacatgagggccagcctagaactgtgaggttaagttgtttggacaggaaggctacaggtcatgggcctggatcctgtgtaaaaactctgaacgcacagccttgtatttcagctatatgtaataagaaggattgggacgagttagggagtgctaatgtggggactgtttctagggttgtctttaaggaatgaaaagaagagtggggaaaggactt

SEQ ID NO: 227159 - DNA, 267 bp, Homo sapiens
agttaaggagcagagagaggctagcatgtcgcactagtagagctgctggcacttgaaagattacacctgtcatttggaagtgaaggacatcaatttgaacactgtgcaaccaataacaaagtaatccaaaattctatcttaaaatggtgttaacatttgtattccaatacatgtattaaattgtgctcaataatattttcattttgcttagggaacatgtacaatgtaaagactatctcttgcaagatttaaataaaaaatatcaac

SEQ ID NO: 227160 - DNA, 406 bp, Homo sapiens
ttatattctgtcctgtactatgtcaatagtaatattgctaaaagtattctatttatatactatatatggaatatagagaggggactattttaaaaagttggacagcaagatgaaataatgatgaattctatgcttctgccttactcattgcttagagattcctaagttttacacagttgacattacagggagtcaggctgaaaatacatttctaggcccgggacaccaagaacagtcacacttcccaggcctgaggtgaagtggcacattgcacctggataactattaccttggctgagataagtagctccacttgccagagctggactgagatagcaccacccgttctagggaagcagagtagaagctgagctgagacaccccacgctacaggccaaacaactgt

SEQ ID NO: 227161 - DNA, 601 bp, Homo sapiens
gtgctgagcagggaggagatggattgttttagcctcccaggcctccaacaccgtaattttcaggcaaaggtaagatcagacagaatgatcctgtcaggaagcttctagaacgggaaagcatgtttttactttcatggctgtgatccttagtccactttttctctagacttgttctgatatctcttaagccaggagaaagttgggttttccttttccgtcagcgattggaacacagtatgtttctatttgaatgactgggcactcaagcgagtcccctgtacctgagtggtgggctgagaaagttcctccatcattgaaggagttgtctgagtgcagggaggggttttagagaagagctaagaaccctgtggtgggaagcagcagtcaggccatccccgttctgtgctgctcaggctctgacagtctcccttgcattgtctaatttacaggttgaggttgtgaggttctacccctggtaatccaaatagtcccactgtgatctcattccttctgcatattgtgagcaggcacacgatgggcgagacagagttttaattccccaagggcaaacacttactgattagaagaatgacgctgtggg

SEQ ID NO: 227162 - DNA, 330 bp, Homo sapiens
agtcagccctctatatatatatggatttcttatctcatgaatactgttcttgatccacatttggttgaaaaaaccaaatttgtatgattggcctcttgcagttcaaacctatgtttttatttagttatttattcaagggtcattcatatttattgattgataatattttggcacatttataaaaatctgtctttatatctgctatatattatatatcctttaaaaaccatttgaaagttacagacatctttacctcagaagcatcagcagtatctccacagaacaagttgctttcttacataaccagaataccattatcacaccccccca

SEQ ID NO: 227163 - DNA, 591 bp, Homo sapiens
aagtctgtgatgattgagatgtagaacagataaatttgtggttaactcagtatgaaaaggattgttaggtataagtgatggctgtgcaagattgcttttaagtagctagagggcttcttgagtgattgtccccttctattgggacaactataattggagggaccatttcacctggtatcatttgtggcaagatatttggtgttttgacagaaaaatatattctgtgtgagatagcttgctggatctatgcaggcctaaggtttttatgattgcagcccttaatacaactgtaaaaaaaattttttttttggcctggcatggtggctcatgcctgtaattccagcattttgggaggcccaggcggacggaacatgaggtcaagagattgagaccatcctggccaatatagtgaaaccctgtctcttctaaaaatacaaaaattagctgggcatggtggtgcacacctgtagtcccagctactcgggaggctgaggcgggagaattgcttgaacccaggaggcagaggttgcagtgagttgagattgcaccactgcactgcagcctgtgcgacagagcaagactccgtctcaa

SEQ ID NO: 227164 - DNA, 438 bp, Homo sapiens
ctgaagcaccacagcccaaaagcagagaaactccaagctgctgtcagtacctggagaagccctggagacagcagtcagcatcctgagggtagcacctggcaaagccaagccccttaggagttctcatctcagttctgccagttcctagtcacccatacagaagcctgatcaccacctttgactccttcccgtcttccttccccatatccagtgagagaccaagtcctgccaattctgactcctaaacatcttttgaatccatcaatcctctctgtctcacttttcctaggtcctcccatctgtgcctggactcctcaccagcctctctccagaaaaatcattttcccatacaaacctgataaagccattatcctgcttaaaagccttcaatggctcccaattgcctcagaataaaatccaagctccttgccgcaactc

SEQ ID NO: 227165 - DNA, 244 bp, Homo sapiens
gttttccctttccttgcatttgatagtagaatattttagggcaggatcatatgtgggtgttagattaagccattgggatgagaagggagaaatggcaagagtattttccttcattactttattatttattttccttttcctgaggtaaggaaggggatataaagaaatggcctttatggttcccacggtgatagggatgaacatacaatattctctcccttctcaccacagcagctccctgtct

SEQ ID NO: 227166 - DNA, 445 bp, Homo sapiens
cataaaagcagaagtcataatgaaaaatattagtgtacttaagactaaaaatttatatcatgtgatagatgctttttttaaaaacccagtttaaaattaacaaagaaaaaccttatagaacaaaaagtggggtttactccaggatagaaaaatattttaatatttaaaaatctattaatataattattcattttagtagctctaaagagaaaaggtgggcggatcacgaggtcaggagattgagaccatcctggctaacatggtgaaaccctgtctctactaaaaatgcaaaaacttagccgggcgtggtggtgggcgcctgtagtcccagctactcaggaggctgaggcaggagaatggtgtgaacccgggaggcggagcttgcagtgagccaagatcgcgccactgcactccagcctgggcgacagagagagactccgtctca

SEQ ID NO: 227167 - DNA, 411 bp, Homo sapiens
agactctaaaaatgagctggtcgcttccaagtgagatagctgccaacttatttcagattgctgagaatttattcattcacttctttctacttattcttcttccctccccctttccacatttattcaattttactatactaagagatacaatttagcacaatgcctgccacacggcaaacattcaataaatggtaattgtaattattcaaggcactaagctaatatcatggggagtttatgaagataaatcagacttagaatctgtgttcaaggaatttgtattcttggggcaatgtgatatgttcatacataaccattttaaaaagcagaaattagtaagttgctagagaggcatttaagaaattttaggccaagtttagaaaatacaataataaaaaaggaagaaagaaa

SEQ ID NO: 227168 - DNA, 192 bp, Homo sapiens
ataccaaagacctgcaaaattgggcctcacctgctgcaacctcagcccagacttgtgtacatttcaagggtggctggactcatggccgcctgggacgtcagagtggtacgaagtcctcttaacctaagactgtcggggtacaaggatcagcatttttttcctttctctccagggccagatggtaaatagttc

SEQ ID NO: 227169 - DNA, 359 bp, Homo sapiens
agataagattgaacatccaggaaagcttaagtggcttccactgtggggagacaagggataggggtaggagggtattggaaccagacagaccatggtagtatcacccaaaggtgactattaatgttttagaagtaagagggatacatgatgacccagaggagccagtcctagattcagtgctatttaacacttccatttaatggatagattagagaacaagccattagttactcaaatggcatcaagtaaaaatagttacttgcatattagtaaataagatttcagcataatcttaaaaaactggataactgattaaaacccaagagtagcttaacaaggacaaaagcacaacagtacct

SEQ ID NO: 227170 - DNA, 396 bp, Homo sapiens
ccacggaaggattaaaccaaaagtggaaagagctcgtgcctgggggccccactcccagggaggaagcgttgagcagtggctggaggaagcagcagacagttctggggcacacggagtcccccctcctgcccttctactcctcttacaccagagagagctaacaaggatgcagtggcttaaaaatcctatcaccaagccaaattcagcccttagcatgcctctgaaaccaccgaggaagacttagccacttaccaagaacaaggtaacctgtgttctcccgggtgtaaaccgcgtctctgtgaagggaaagggggaagagggccggcaaggacctccagtatcagcgaggactatcaggacgtccagctaataaacgactttttcactgtccacact

SEQ ID NO: 227171 - DNA, 811 bp, Homo sapiens
tgagaaatatgtaacatgacccaaagataaccacttaattgtcatgtatattccagactgtttatttcctgttcatatagatcacatcttatttttaaaaaatggagtcgccgggcacggtggctcacccctgtaatcctagcactttgggaggccgaggcgggtgaatcacctgaggtcaggagttccggaccagcctggccaacatggtgaaatcctgtctctactaaaaatacaaaaattagctgggcgtggtgacacacacctgtaatcccagctacttgggaggctgaggcaggagaatcgcttgaacccgggaggcggaggttgcagtgagccgagatcgcgccacttcactctagcctggacaaaagagcgaaactcattctcaaaaaaaaaaaaaaaaaaaaaaaaggagttatcctgaatatactgatttgtaacttggaattgcactgttctgtaacttgtttttttttttcctcttccaaacaatatgctgtgaacatctttccacatcagtaaatattctacttagtatcttaatgattatataatgttttgttgaagattgaaccgagatgtatttaattaatcctttatcgttactcatttacgttgtttaatttttttattttgctattgtaagcaatgctaaaacgaatatctttttatgtatgtctttgtttcttcctttaagttcctagaagtgaaattactccatcaaactcattcctggattctcttctagaaagattgtacttatttgtgcactggcatggtctgggaacacctggtttcctatacccag

SEQ ID NO: 227172 - DNA, 201 bp, Homo sapiens
ctccagagactgtgctgggagtggcgaggggttggctggctcttcctccagcttcccaggtactggcgtgtgcagttagagttgatgagactcgggctcagactttaagctagagttgctgctgagtgcctcctggtgcctcacagtggaggccatgatgtccaggtgtcctgccttgagtgaccacagcccatcaggggc

SEQ ID NO: 227173 - DNA, 651 bp, Homo sapiens
cacagcctggggcagcaaggacagcaggtttattccaagacgaaggtggccccactctgacacctatcttcaaaagtgagactggctctgatcccccactctcatgaggtatttggcctctcttgtatcctacgcacgtcatgcctgtgacccagaacccagcaagcccacagctccagccctgcattttatattttcagtctgtgatccacagagatagatgtcttgtttttgagttcagctatgttgttattttatttttatatgttatatacacatatctatcctgtgtatataacacaaaaacaaactttctttttcctgttttgagcagaggccgcatcaatgtgtgaacacatgaaaccatcttgatcccaaatctccttagcctgaagtctcttcagcaaacagaaccatagaatctcaacagtcagaaaaagtgtggaagctagagaaaataatcaacaagaaaaaaggaagggaaaggaaagagcaacatgctcttcgttaaattgaagcactgaaaaaaagacttcctccttcaaagaagtttgaaaacccccttcccaccggctttcttttattaggccctgatttcatttcttgcttttactaaaggtagtaaagaagacggtgtcactgggagaattt

SEQ ID NO: 227174 - DNA, 665 bp, Homo sapiens
aatccaatgggctcatttttaaaaaactgggtgtgaatttatgaccccttgtgactatactcatatactgcattcttaaaaagaaaatatttctttgccaaataattcccttataagcatcatacaacctgttggactaatggagaagttaaaatatgcatgggaaatttaatttttcaaaatttatgttaagtaattttgatcattcctatatcctgtcaatagtggaattgccttttttcttcttacataatgtcaggattgtatatagtagaatgatatcagcaaatatatttcattaaattacctaacaagttaaatatacctattctcatatttcaggattgcatatagtagaatgaaatcagtaaatgtacttaatcatcattcacaatttatatctaacaccaacctcacaacacttgttttagaggatgaccaatgtggtaataatagcgccaacattaccttttttgagttcttaacacaattaaaaaatattactgcttatgaaactaaaaataatttttagaaaatctgtaggcaagtgaacatgatgcttggtctaaaggaaaacagagtgcctaaatcaaggtgggtatgggctgtaataattttgcacatacaatatatgtgggaatatcggtaaaaaaattcaaattctg

SEQ ID NO: 227175 - DNA, 480 bp, Homo sapiens
atgatttgacttgaaattaatggactatgtacagtactactgataatccccagttcaagttaagtggtgaggatagcccccaaaatagaaacttccaaacagtgccagaaactcattttagcctttggttataattttgaaggttatgaataagccacaaactggaatttgaaattttgtcttcgttcagaaatgggaagagagctacagggggtttacatgttcacaaactagataactaatcccttaatgaatcagagttaaatacaattatgatggttccttaaatttatgtgtcctagatattatttacacctttaaatattagttatatgaaaacaaatttcatttactggaaaacactaaactatgaaaacaaagattgtatatctacatatagtagatctgtaacagtcactcttggaacattaagtcagttgcaaaaataaacatgaaatacaacttttgatgctcacaaga

SEQ ID NO: 227176 - DNA, 473 bp, Homo sapiens
aaggagactgccagtacaagaggctttcactccccttgaaggtttgcaggcaggagaaaagagtgacaaagttttttcttcctcctctgttctatgctccccgctgatacctctggtagagcattcacctactgggctgtagcctgttgggtgcattttccccctaataccacaggctctcaatttccagcacaaagctcaggacaccaggaaacatctggtgatggaaggctgaggtcataaaggacagcaatatcccagcccacagcagggtccccacacctgctgtactgcattcactcggtagtgactccatttcaaaaggggcctctcatggggtggccatgaggagctggagcttgtgagccccttaaaatgaaggcaaagtcatatacttcacgtctgcccattgcaagagttcatcaagaaagacagcactggtgtgtattaaaaaaccacaatgtattaagtac

SEQ ID NO: 227177 - DNA, 476 bp, Homo sapiens
atttatgtttataagatgttagatccaggcttaggttgtactttgtgattgtttaagaaagcaaagtaggtttgggcttagtgcattgtttttccatttattactgtagtataatgttacttagatgatatatatatatgtatgtttggagctccatacatgttaaatttcaataataaaggtcgaaacgagactgtatactatcctaaagtgattattactctccaagctgtactgtcttactagtgtgcgtggatgccctatgtgtaaattttgcgtgttgaatcactgaatggtttggaaagtgaccttaaagttgctgttttgtttgtactaaaaaatgacaaagtaggctatatccttatttttatgatatttttgaaattctaatttttctgtttatataacttcaaggtgagaagtagaaattgttatttgggtcaataaatatttcctttaatttaaacatcctaaag

SEQ ID NO: 227178 - DNA, 730 bp, Homo sapiens
gagttagcattggtgtttgaccaagcaaaaggcgcccatccatctatgagtcaagagggccaaacaaatcttcatttgttaaaaactaacccaccagttcctccctctggagacacagaattgctttcctttcctgtagaaattcaggtaacagcagctactcctatcccagaacaggataaagagtctaaagaagtgtttcaaactgaggagctggaacctaaagcaatgcctcaagatcaagttactcaatcaccaaaacacagatttgtatttttgtctgatattactaatgaaccaccaaaaatgttacaagaaatgccaaagcatgccaggtgtagagaaggggattccatcattcttgaatgtttaatatctggtgagccccagccagttgtaacatggtttcaaaatggagtccttttaaagcagaaccagaagtttcagtttgaagaagttaattgtagccaccaattatatattaaggatgttaattctcaagattctggaaaatataaatgtgttgctgaaaacaattcaggggcagttgaaagtgtttcagatctaacagtggagcctgtcacttatagagaaaatagtcaattcgaaaatattggtgaaatttatggaaaatattccagagatcagcaactgcaagaccagggagaatctgtaagggcacatttttatgattatccagctggtccctttactccctggacaaatgtaa

SEQ ID NO: 227179 - DNA, 362 bp, Homo sapiens
tgcacataatcacttctatgtatggctgatgttggttcagtgatggagtataaaatggttgacgtggtataactgagagtgctttgatgcagtagaaaaaggcaggggactggattctgaaaaacaagtggtaggtgaatcttcttgtagagcatgtgcctgcagcaccgagcaatgccgcctgctccgggatgtggggaataccttgcgcaggtggttctgcctgtgtccagagggcggccagggctggcatcggactcttccactgtgtccggagatttgaagagggtgggagtgggggttccttccgaattcctgcaggtgaacgtttaataaagtgtatcttttaaaagaacagcatc

SEQ ID NO: 227180 - DNA, 2394 bp, Homo sapiens
  misc_feature (49)..(49): n is a, c, g, or t
  misc_feature (79)..(79): n is a, c, g, or t
  misc_feature (314)..(314): n is a, c, g, or t
  misc_feature (599)..(599): n is a, c, g, or t
  misc_feature (1012)..(1012): n is a, c, g, or t
  misc_feature (1152)..(1152): n is a, c, g, or t
ttgtagagacagggttttgccatgttgcccaggctggtctcaaactccnaggctaaagcgatctgcctaccttggcctnccaaagtgctgtgattacaggcatgaaccatcacacccggccaaaattttgccgctgatttttagaaattgaattattattttagactgaagttgtatctttttaaaatgaaagccatacctccgtatttctaagaaatcagatgggatcatcatcccatcaggtattcactgagctcctgcttgtgctccactgtctgctcagtgctggttctgtattgcggagaggatctaancagaaagtaatccaaagggctacatctgtctttcttaatgacgaaccgacggctttccaccttacccttttggctacaaccagtgggattgactgctgtcttattgactctgtttatctagatatggtggacatattgcccagttagatgggctaagataccgatagccccccaaaatgccagattccagaataaatgaaatcactcagtcattaaggtgatatatttaactgggctggctgggctaatttgtccatgttaccaattattattgagcagacaaantcaggtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtaagtgtcagctgtttatgctgttatatgccttaagttatttcagccttaccacatgcagtgaaggagacactagtattatccttatgttgcagctgaggaaactgaagtgtggagtttaagtaactggcccaaggtaacagatgcagtgatcagaggagcagggacccacagccaggcactgtgacncagagcctgcgctcctcactcatatcctgcttcaggcttcacaggtcttgggaagaaaaagagaacgtttacaccctgaataacattgcaaaaggatagtgcgctgtgtctgccggtcagcagagctctttgatgatatnagtaggagacacctaagcaaagtaaagttgaggtcagtgtagctccataacaaaagatagggaatgctctaggtctcctcaagaaaaatctacaccatggttttctgttttcacctacagcttagttgcccaggaagattcatttattatttatttaagtaatacatcacagggacaagattcattgaagtgaaggtatttcacttccaactgtcctacagggaaacaatgagcctaaataaatcctacaaattctccctggagagggagcagtgattgattcatttttgcatctgtcaaatgcctctatagtccaaagagtgcgttttgttccctcccttaacaagattctcttacctttgttttgttcaggctttattggcgctgtgtgtataaataagattacaatgaatagaaattaacactgtatcccagttttctgagtcaaagccccaattccaaacagaaaaaaaaaatcttgttgttaaataatatatgggtattatttgtcacatatgataaatattgctactcatgcccaaaaagagactttacaactgtccttgtgctagacgaatgactggtctacaggctacagactattcacagagctttggggaagccctgaaactcacctgatagcagtgtccttgggactgaatataaacttctacagttacaaggccttaagaggttacaaagtagagcaagtttggggacttcaaaagcagtgcctgggatggcagacatcattgccgtggtgcaggggcctctctatgatcccatcgctgtgcccccaccgagacccaggtggacagtttggaggtggggagggagctgggatgtgactcagcagtcatgtggggcaaaaccagggtgggggcacgaccctgctagattagcctgaaggtggggcaaatgactggcaccttgtcacaagacattgttgtttttacgcatttgacttgatttcacccttcaggctcagggctggccctgtgaggcctttccactgcattcagttgttctttcttgaatgttagagggaggaagttggagtctctgttctggggaactgaacacaccgcacgcagcccatctggcctgtgccgtgacccacgcagcacaaatcactagttccagcggcgacaacactaacatttatacatcatgcaagttgtagtcttttattttaacttaaactttttattttcaaataatttcaaactcacaaaaagttat

SEQ ID NO: 227181 - DNA, 574 bp, Homo sapiens
gagcagaggaatggtatgatctaacttacattttgagaatagtactctggcttctgagtttagaatttattgtaggggtatgagatggaagcagggagactagattggctatcccatttatccacatgagagatgatattggcttaaaccaggatggtaacagtggaggtggtaagaagtagttgaattagattcaccttttttgtaagtcaaaccattaggatttgctggtgaattgcctgtggaatgtgtgagaaagagaggggggtaaaagggtgaatctaaggtttttggtcaaagcaagtggaatatatagagatgggcaagactgggtgagataggattgtggaaggatgatctcagttttgaacatgctaagtttgaggtatttaactgacacctaagtggatctgttgaggaaacagttggatatacaaatctagtgtttaaggcagacttccaggcttgaaggaaaaatttggaagtcatcacgacatatatgtggtatttaaaattgtgaggttcaaggaccaagccccataccatttagaggccaggaatgtgaggaagaagc

SEQ ID NO: 227182 - DNA, 2137 bp, Homo sapiens
caactcggccttcccagagtgctggaattgcagatgtgagccacagcgcttggctaaaaatatgcagttattgagtatgagtagcttcataaaagaagaaaaatatgtccctcgttttgatcatgtaaacagcctagacctaagaaattgagccgcacataaaatgaatcatgcaattgctgcattataatgaatctcgataccttacattgtttgagctgagaattttatgctagcaaatgtctcaaatgttcatcagattctagcacctctacgatagagcagttctacagagctaatgggcttaaagtgtcacccacctgtgaatgcagagagagggatttttaatgctgtactaaaatttagctgtacattggttttagacacataacagtgaagaaaagaaaaactgcggttatagcctcagttcagataagtgggtgataatttcagtttggttaatttccatctgtgtcaaccaaaattgaaaagctgccagagactccacatgtggagttggaagagtccgtgtacattgtggggagggagcattggtgggaagatggggaaatgaggggctctcagccctgggttattgcttcctgcctgcctcctgcactgtgagcggggagaggtcgaccaggaggctgctcttctgcccatagcggggtactctgacctcttctccctcttcccttctttgccacacatcagctcctctgggaagctgatttgctccagggacaggaggtgggggaaattgcctgttaaccttcccaacacatcacctcaagttaaaattggtggatttccagaatttgtataggatgggaatggggacgacacacttttgagctagtagcttctgctcgtttgttatcccgtaaatgttgtcttcccaaaaggtgattgattggagcagagttagagacattggtgacagcagctaccatgtctctgcctctcccctaaacacctctgcacttttgtaggctcaacaagtactggggagcctgccaccactgtatgcctttgaggcccctgccctgcctccctggctggccacggagctcgccctccctggtagggggtgagtttggaagtgagaggctggtgtgggtctgtcccatgagctgactcacacttgcctcaccacacataccatcagaagacccacgtggtggagctaccgctgctgctccccacagtgcacctaggcaccctcctgtccttcccatggcactcggttgacctgggggttcctgtccaacaggtgaggcctggtgtgcacagacactctgccattgctagaaggaggctgtgccccctgctaagatatcagtaggtccttcacagcctcaccttgttcctcccatttgtttttaaaaattgtttcttatatatacagtttatttagcttacgtaaacatttggtgcacataacttctctcaaagatcatgatgtttcttttgtggttttataaattcttattccatttttttctctttatttccactgttcacctcccattattgtcgaggcatgaagtcagttggaaatgtttttctgagatgtacctgactgactagaattttgagatggaattctcaaaattttgagatggtatttgataggtgcaatttctagtattttgtctccctaaatggctcattaagtgacttaaacactgaggatctgaacagattttgactgcaaagcagattctacagttcgtttcatctaaccgttggaattaaaatggaaaacgttgccagtttgtaaacccaaatccagatgctgtgttaagcatggtgcccaggtggaagcactgcctcttgttcccacgtgctgccacagagatggccctggtggggtgaaatggacggagaacaccgttcacaaggataactcatggtgtgggctccagaagcacatttcactgaaatcctaagaggacccagtctcagttttcattaataaaaaatacatggggggattctagaacctaagagtgttttgcaggaatttaaagccgggagaggagggtggcttgtttcactggtcgcgtgagctctttttttatctgtctcctccagagttgtcagcggcaataaaacgagactgggagtcatcaga

SEQ ID NO: 227183 - DNA, 415 bp, Homo sapiens
caactcggccttcccagagtgctggaattgcagatgtgagccacagcgcttggctaaaaatatgcagttattgagtatgagtagcttcataaaagaagaaaaatatgtccctcgttttgatcatgtaaacagcctagacctaagaaattgagccgcacataaaatgaatcatgcaattgctgcattataatgaatctcgataccttacattgtttgagctgagaattttatgctagcaaatgtctcaaatgttcatcagattctagcacctctacgatagagcagttctacagagctaatgggcttaaagtgtcacccacttatctgaactgaggctataaccgcagtttttcttttcttcactgttatgtgtctaaaaccaatgtacagctaaattttagtacagcattaaaaa

SEQ ID NO: 227184 - DNA, 693 bp, Homo sapiens
agaggaaggaagggcatctgatctagcctggggctcagagaaggatccctgaagagaggccttggactaataaaagttgtgtaggagttatccaaggcaacaaggagtagaggaggagggtatttaagacaatgagaaaaatgaataaagacatggaaatgcaaaacatcttggaaacctctccttgttgaggatgcagacagatccatcccactgccgagctctggctaccctttccaggacaggattgtactcctgcgacaccagtctccagaggcctggtgatattcaaggtcttcatccctctcgggcacgcctaactaacactcacctcttggatgagatgatgtcctcgtgctgcccttctgccgacccttccctgcaatcggccctgacctctcagaatgcagcttgccccagactgatatagctcatccctcattgggtgcatctgtgcccagctaccctggttctgatgaagtaaataggacacatatgtcaccgtggagcctcatgagtctctttagataaagataaatttggaaaattgcaaaactctccagagacaataccttcctaatgatttctgccttctttgacacctcattgcactgattaatggtcattcaaattgatcacctggcatagctcactgtcaaaataaaaaaggacatattttaaaaagtcaggtgc

SEQ ID NO: 227185 - DNA, 514 bp, Homo sapiens
actccaaccagcctgtacactgggaggaatgtgcactgggatggagccatagaagtttgtgtcgtttgcagtggggaggagcctggtccctcctcttcctgtgaggaacctggaattcaatctgtgaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaaaaaaatt

SEQ ID NO: 227186 - DNA, 554 bp, Homo sapiens
tgatcctagccaagccccctccctcatctcccattaaagggtccatcttcaaccaaacttaagtctcaataaatatctggacattgtccttccaactctgggaagctgctaagactctgtccttactgcagaagaaaaaacagccttgtaccctggtcttctcaacaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaaaaaaatt

SEQ ID NO: 227187 - DNA, 488 bp, Homo sapiens
ctgtttattcaggggaaagttggagaagggagggcgagtttagcagaaaagctcgagatgcctggataacaaaaagtttgcgctcatacttccttcgagggacaatttgctgaatatttacacacctttgcgtgctgcgaggtctttgttggctactgggatgcgagatgtgtatgatgtgaatgtgcaaatatgtttgcatgtgcgaaaagtggctgcacatttgtgggccggtgcagtaagtgtgtgtttgtgccggtgacagagagcacttggctgaatgtgtgcgtgggtgcgtaaggcattggtgcacacgggcgtgagtgcgcatgtgtatagtgtgtgcacgtgtcatgtgtagtgtctaagtgagtggggtgtgcatttgcaaaagtccgtgtgtattgtgcaagagcatcgtaaacgtgtgtgagcctgaactcacacgtggttttgtgtgcacgtgtgcgtatgaaattcagcaaaaa

SEQ ID NO: 227188 - DNA, 455 bp, Homo sapiens
aaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatt

SEQ ID NO: 227189 - DNA, 466 bp, Homo sapiens
gactactgtacatccatacaatggaatgttatttggccataaaaaggaatggagtattgatacgtgtcatgacatggatgagccttaaaaacattgtgctaagtgaaagaaggtagtcacaaaagaccacgtattattatatgattccctttatatacattttctagaatgtccttcataatattcatccttctgatagacctgagtgtaggttcaggtctctgctcacataccactcctcagagaagtttcccctgaccacctagccaaaactgtaccctatccctctcagttcctctgcctttatttatttttttcatatcactctaatgttacattgcatacttatttatttggtttactatgtctttctcagtaggatgtaaagctccgtgagggaaaggactctatcccaataatggtgcatggccttagtagatgctaaataaaaatgattttaaatgca

SEQ ID NO: 227190 - DNA, 560 bp, Homo sapiens
cagttatcaacaccctggctttgtattcaagaggactacctcctctcatccgtctttttcataccacagtattgaaggggttgttttcctctttgaagaccttaaacatctcattaattaaagtaatgcttcttccctctccccatatgcatttagggaagtcgctaagcagtgattgaagtagtaaagcttatctaatggcacagcactcctattttgactctgatcccttcctgtatttatttgtaaacattttttcatgtgagtgtgtttgaaattccaagttttagtttcctacaggatgtgaaaaagacctagcagcacgggagataggaatgtatttttgtgcgtctgtctcttgccttcacgcttcccctttgtttttgtgctttgctaatggaagtgatgaatggtgctttcaaaaactttccagaatactcaagtgttttataacaaaattgcagagaaataattcggagaatttttgacagatcttagagtgttttgataggggggttgtaaatattgacattttaaaataaaacttttaaatcagcctt

SEQ ID NO: 227191 - DNA, 423 bp, Homo sapiens
cagtgcagagagctggagtctgagcacagtagggagatcccaccgggctgaggaggcagagatcaggctgagatggctgaaatggcagagaaatggggcagaaaaaagaaaggagggcactatgcaaagagggagttctagaaatctatatatgaaacaaacccacggctgaaggctggagtgatgggtaatttcaagtgtcaacttgaagggaccatggggtgcacagatacttggttgaacatttatttatgggtgtgtctataaaggcatttctggatgaggtagtcttttctttatttatttactgatttttattttttgagatggcctgttgctcgttgcccaggttggagtgcagtggcgcgatctcggctcactgcaacctccgcctcccaggttcaagcgattctcctgcctgag

SEQ ID NO: 227192 - DNA, 601 bp, Homo sapiens
ttctttactttaaattgtttttctttctttttttttgagtcagagtttcactcttgtcgcccaggctagagtgcagtggtgtgatcttggctcactgtaacctccacctctcgggttcaagcgattctcctgcctgagcctcccgagtagctgggattacaggtgcccgccaccatgcctggctaatttttgtatttttagtagagatggggtttcaccatgttggtcaggctggtcttaaactcctgaacccagatgatctgcctaccttggccccccaaagtgctgggattccaggcgtgagccaccgtgcccggcctaacaaaattgtatgcatttttaataaactcttaagctacttcttaggacaaaaatgacagctataaataattacatcttatttaaaaataaccatcttctcataaattttgattgtagaaagtacagtatacttttacttttgcactccctgcctctccaaggccgagattttgcaaaaatgtacctgaggctggagagacagcaaataacagatgggtcctgggctgagatttaactccaaagcaataccatgccacactcacgcctcttgtgaaactgg

SEQ ID NO: 227193 - DNA, 318 bp, Homo sapiens
gaggctaggaagtccaagagcatggtgctggcatcttgtgaggaccttcttgctgtgtcataacactatgaaaggcatcacatggtgagagagcaaatgtgtgccagctcaggtctctcttcctcttcttctaaactgccagtcccatcttaggggacccaacctggtgaccttatctaatcataagtatctaccaaaggccccatctccaaataccaccaacaaatgattttgagcattaagttttcaacacatgaaatctgggggacacaaccaaaccatagcaggaagagagagaaggagatgggccgggaatgt

SEQ ID NO: 227194 - DNA, 755 bp, Homo sapiens
tgggaaattattagcaaataaatatttttcctttaattttttattgtgaaaaaattcaaacatacaaaatacacgagtatgaccagctctcatttatgcatgcctagcttttatttttgttaacatctgtttctccacccagctcaccccactactccataatgataaagataatggattttttatcatttttagttttgattttgcattgggggtggtttactctcttttgtatatgtaggcatgtgcttttcctaagagctttgcaaataaactttttactgtaactttttcagaattaatatgacatgttaatgattattagatctcatctatccttggggtacatggagtcgttccaagagatacacaagcagatatagtttattgacttaagttaaatgccatttccagggtaaataatatgaacaaacaataatcaaatgcctttacatttaaatgaggaagtatgggggagaaacattctttagtcaatgcaattattcaatacaggcatacctcagagatattgcagatcacctaactaaagtgaagattgcaaaaaagcaagtcataccaattttttcgttaaccaatgcatacggaagttgtgtttatactatagtaagtgtgcagtagtattgcatctaaaaaaaaacagtgtgaataccttaattaaaaaatattttataggtaagaaatgctaaggatcatcggagccttcagtgagttctaatctttttgctggtggaagg

SEQ ID NO: 227195 - DNA, 614 bp, Homo sapiens
gatccatgggtggatatgcttagatgggcttatatccaggacaacctgggtactggaaggagcaggatagcactttgagtcagcttcctacattttgatctatgccctttggaagtcgtttcacttctcttggcctatttgcccatatttaaagaaaggggggtggaactgaatgtcctctaaggtccctttgagacctctgaacccaagcttctctattgaatgtaccttcctttgagatgcagttatagcaggcaaactgtttctaaagaaacttaaaaaaaaaaaaaaaaaaacccaacgctctcacattaaaaatatcttaaactacttcaaaaataactgggtttattttctcaatttataacttcttggtggcaaaaatcactgcatctcatacacaagcaatattctgctgcaaatcatttgtgaatggtatttggccttcagcattccgagaaaagtggggttctgagtccaaaacccaatgtgttcccctagtgaggaatgatttgaccccagtcagcttggatcagtcaggcattcagatttcctgagaggaggactcccagaaaccttattagcctaatctgtgagcagcgtgtttatgagag

SEQ ID NO: 227196 - DNA, 424 bp, Homo sapiens
agcaggaaggcagctcttcaaccctaccttaggttggccaccttgcgagaagccagtaatctaaaagtttcagccttgaattttccatgagtatcagcttgtgagaaaaagaggaaaacatgtggaagattctgtgacacgttctgaaacaatgggtagtgacttatgactggttaatgtaaagtgatcttgatcgtcttgtgagatattcagagtagctgtggagacttaaatattttagagttgatatgtgtatttgtgtctaggctggttatatgtttttagaacatttagggaatctggctaattcagaggatttttccattatgccaaccacaagtacagaagtcttgtgagagcatagcaaaagatgatgggcagttttcccttccactttggaaataaagaactttggctgaaaaaa

SEQ ID NO: 227197 - DNA, 435 bp, Homo sapiens
acattcccaagtcgtaaacttgcatatagtctgtccttaagttgctttggaaaaaccaaagagtataggggagtggttcttaaactgtggtcctaggaccagcagtgtcagcatcacttggaaacttgttagaaatacaaactcttggccaagtacggtggctcacgtctataatcccagcaatttgagaggctgaggccggcagatcagttgaggccaggtgttcgacaccagcctggtcaatgtggtgaaaccccatgtctactaaaaatacaaaaattagccaggcatggtggtaggtgcctgtaatcccagctactcgggaggctgaggcatgagaatcaattgatcttgggaggcggaggttgtagtgagccaagatcatgccactgcactccagtctggtcaacagtgagactctgtcttcaaacaaac

SEQ ID NO: 227198 - DNA, 804 bp, Homo sapiens
gagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtgagaataatgtttgaggtacaggacttgaaatacgcgaccttggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatg

SEQ ID NO: 227199 - DNA, 267 bp, Homo sapiens
gaggtgctgaggatgcagcactaaacaaacatatgaataaatgatgataagaaggacattgattgagctcttattgtgggctaggccctgagctcagtgctgtgtatacagttgacccttgaataacactggttgatttgaactgcatgagtccccacttatacgtgaagcttttttcaataaaagttataccatgggccaggcatggtggctcacgcctgtaatcccagcactttgggaggccaaggcgggcagatcatgaggtca

SEQ ID NO: 227200 - DNA, 110 bp, Homo sapiens
caggagtctgaggtaggaggacgacttgagcctgggaggcagatgtttcagtgagccaagactgtgccactatactccagcctgggcgacagagccaaaccctgtctcaa

SEQ ID NO: 227201 - DNA, 296 bp, Homo sapiens
aggctaggaataaatactagaatttcaataaaacattttcatgaatgtcatgaaaagatctatttaatccaataaaagattctgtgttttaaaattgtatattatttgtgactttctaagtttacaaaccagatttataaatttatcggtgactacaagtccttcttaaagcagattgggacatttcttctgaaattttgagtgctatcaaagttatcacctgtgttttgtacagttcatgtaaattgtacttcttgaaaatttcaaaaataaaaaagtagttactaaaggaaaag

SEQ ID NO: 227202 - DNA, 326 bp, Homo sapiens
atggaaagttgtgaccatcagaggaagatcagagatcaagccttgttgatgtaaaaggaattaaagttgagaaaccatttcctgcaaccagaattgtgaaagcatacaacgtagtaccaaaggaaaattaccgaagcctccttccctgaagaaccttcaggaaggggaggccagccgtctgacgtgatcacagtgatgtcttgccctgaaacaagaagcattcttcccaggtcctttccgccggaggattcttattctgtgatcaatgctgagctatgtggatgagtgtttgcgtggatttcttttaaaactatattgctaaataa

SEQ ID NO: 227203 - DNA, 1694 bp, Homo sapiens
  misc_feature (530)..(530): n is a, c, g, or t
  misc_feature (557)..(557): n is a, c, g, or t
  misc_feature (561)..(561): n is a, c, g, or t
tttttttttttaaatctaagctattcccatcttccccattctatgctggggtgatacaccacaagaagttacaggaacaactgctaaaagaattaaacatcttgggcctttacacagctgttgccatatcatggctttggtgcatggtcggtcacagatgctgtcaagaggcttatgtttagttatccttttgcttccccaacccccacattaaaggtctccttcaccttctctgtcctttttgctacctcccttcttcctgctccaagctcccacaaaccagccttaataaaagaggaaggatcaaggcaacactccacatcagtcatatttcagggcagcttgatgtttgtttgctaatagatggttggtattatctaaccaatagggtgactccaagttttaaaaaacagcaagactaattcagaaataatattatttcttaatttttttaaaaatagagatggggtctcactttgttgcctaggctggtcttgaatgcctaggctcaagcaatcctcccaccttgncctcccaaagtgctaggattacaggcntganccattgcacccgggctctcagaaatcttaaaaaggatttagtttcatttaaaaataacaaacacagttccccaaatctgaaatttagttattgaaactggaccatgttgtccatggaaaacatatcttactttataccagattttaaaattaacactggtgtaagtgcagcctaaaattcctctgagccccacttttacataagaaaaattattgaatatgataaaggtagcatttccaatcagtgagaaaagataggttattcaatttgtgttgggactggtggatatatatctaggaaaaaaaagtacagactctaaatattgaaaggtaaaactgaaaacataaaaatatttgaagaaatcactggaaaattattctacaaactgcatggggaatgacagtctgtgataatagtaaccaagaaccatgaaagaatagattggtaacaattcagctacataaaaatccctaaatttctctatggcagaaaccatgaaacagataaatttaccaaactggaaaaaattttcacaaatcatgtcacaaagagctaattttcttaaaatatataaaaaagatctttcaaagtgtcatacacaaaacactgcttttcgaaaaacataagctcctacaaagcagtaagaaaatgatgaacaaatagaaaaatgggcaaaggtgatgatttaacagttcacagagaaatacaaatggcttctaaaatatataaaaagatgcccaacttcgttcataatatgaaaaatgtaaattaagactacactaagatacaatttttcacagatctgttttctaaaaataaaataagcttgagagagagcctcttatctgaattctgggacagcctgatttgcatgagggaaataggcatcctcctgcactgctggtgggagggtaaaggtacagtctcagtggaggacagtttgctgttacctctcagaattacaaatgcatgtgtttgttttgatgtagcaatttcccatctaggaatttattcttgaaagacagtcatacaagattttcacaccagcattatttgtaatagcaaaaagatgggaaattacctaaatgctcatatataggggactgctaaattgtggaattccatgcaattct

SEQ ID NO: 227204 - DNA, 279 bp, Homo sapiens
tatttggttctgtctttacagctgagaacactgtaactggtaagtccctcaacaacacccgacggttccccaatgcttaatgaatcaagcatacactccttgccctaatattcaatgtccttcctttatggccccagcgtcatttttcagtgtcatttggtgtcactttgtatgtctgccatacatgcaagccagatgaatacactgggctctcctgacttctgcttatgctatctgccgagcaggtacccaaaatgtgttcctcacatatctcagcct

SEQ ID NO: 227205 - DNA, 499 bp, Homo sapiens
gaaaattttgttagaaagttgaaagagtgtgactatttttaaataacgagacgtggggccatagtgtcagcacagtcaaaaaggtaaaaaacatttgtatcttgctttcttccaccctccccttcaattcagatggatagactgcagaagaaaacaagggaagttaacacttcattcagagcttgccaaatgtcaggaacttgctttatcctggaccaggagttctcaactatgcaccgtgggacatctctctgccatatcttgcatcacacttggatggtgtaatggaaataacattagactgggagtcaggagacttgtgttccagcagaagggaaaaagaagtctcagagtggaatattgcaacatcccatattctcccgagaagggctgctggattcccttgctgatgaggaattaccatggggtcaccttgctacatggttcatcactgtcatccctcccttcagaaaaattaaatcattcaaaggtcacataa

SEQ ID NO: 227206 - DNA, 591 bp, Homo sapiens
agcactttggaaggccgaggcaggtggactacctgaggtcaggagttcgagaccagcctgaccaacatagtgaaacccagtctctactaaaaatacaaaaaatttgccggacgtgggggcgggtgcctgtaatcccatctactcgggaggctgaggcaggagaatcgcttgaacccaggaggtggaggttgcagtgagccgagatcccaccactgcactccagcctgggctcgacagtgcgagactccatctcaaataataataataataataataataaaacaaatagaatgtttttgtgtcatgaaacactctagcctctcccccaagcaccctcatgtatagggtgagtccatctaagtgaggccaagccctttaaccaaaacaaacatctttaaataaaattttatttgcttcgtttttggtctacatgggaccaaatatctgaatctaccacatttggataattttgccaatattaccccaaatatatgctggttatctgttcgtatcactaccttgtggttatggtacttgaaggacaatttcgtcactcctaagtcttcatcgtgagcaaggttttttgcatct

SEQ ID NO: 227207 - DNA, 391 bp, Homo sapiens
gaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaatga

SEQ ID NO: 227208 - DNA, 363 bp, Homo sapiens
  misc_feature (27)..(27): n is a, c, g, or t
agagcatgaaaaccaaaatccatgcanatgaaatgtaattggcacgaccctcacccccaaatcttacatctcaattcccatcctagcactcatactttatgcatccccgcagctacacacacacaacacacagcacacgcatgaacacagcacacacacgagcacagcacacacacgagcatacagcacacacaccgcacagcacatgtgctctgctcattggtggatgcagctaccagcatggctttaattaccttacagacacacacacacacgcgcgcacacacacacacacacacctcgtgccgttcggcacgagtaccagcagagggctcaccaccaccgacctacgtgagctgcctg

SEQ ID NO: 227209 - DNA, 387 bp, Homo sapiens
tctcaaaaggccacatgtagaatattcaaaaagtgttgaaggttcaaaaatcttctaacattttaaatgcctaatagacataaaacaaaagaccaaactctcctgcctgctcagcagtacatatggcttttgaatagccacactcaaatgacagcccctgttccccagttcaaactttctgagactgcaagcctactttgcaagaggaaaatctccacagctatgtcatctacctgcttatagggtgtaaaattcaatctatgactaacaaatcaatattgtaaattatattacttggatactcatttgtcttacatttatttatttagcctgctctgtgggtcaaataagaggagaatcttaataaacagtcttactactattaaa

SEQ ID NO: 227210 - DNA, 395 bp, Homo sapiens
ttgagcaagccagggtttaaatcctgcctctgctgtgtaacagcaatgaccttggacaaatgacctagcctctctgaacctgagtttcctcacctgtaaaatagtaaaacttcttgataggttggtgaatgggtacaaacttagggaagaaataccttctaatgtttggtagcagactagggtggctacagttagcaacaatatattgtgtatttcaaagttgctagaagagagaacttgaaatgttcccaacacataaaattataaattctcaaggtggtgaatacctcaaataccctggcttgataattacacattctgtgtatataaaacacattcatatgcaccccataatatgcaaaatttcatgtatcaataaatgaaaaaaagccaga

SEQ ID NO: 227211 - DNA, 547 bp, Homo sapiens
ggggtgcggcccacagctcagtcgcgccagcttgggtaggacggaggagcaaggagacacggaccgctcggccgaggccgcgccgcctcagagcgcggagcttgttttggcaaaactttgaaaagaaaaggactccgattacctgagcggcgcgggcgcgggctcgtctgcggtacggctgccgggccaggccggattttcagcagccgtaaagcgggagaagcgggcgcgagccgcggcgcgaaccctcgcccccgagcggcggccccggcgcctccgccgcgagcgtcagccgcttggcaaggaacgggctgggctgagtcataataaaagacgcgtttgtcgagccaagtgggaagaagagccgcgggcagcagtgttcaatggcacaagcctcaaaaattgggaaggattttttttttaatgggcaaaactggaaacttgcccccatggtgcccatcaaaagatatgtttcgtttataatttgcatatattttatacatagtctttgaatctaataaaacttttaaaagaatttttaaagccc

SEQ ID NO: 227212 - DNA, 333 bp, Homo sapiens
aatctatcttttcacagattgactgtcaaatgcattctgatgggaaaatgaatagtaaaaaaagacataatatactgacattgagcatattttatattgaacaagactgtttaaaattcttcacatagcatgttcaggctgcattttaattaaatgccatgcagaagtgctcagcttttgaaccatgtaatattcccaggacaatagtaaatttccagggaaaatttgaactgctaaaaagttatttctgaaattgtcctctgttatttattatttcaatgtaatgaccttgccactcaaaaaaatccattaaaatatttttctctcataagt

SEQ ID NO: 227213 - DNA, 738 bp, Homo sapiens
aaagaatagcatgggaaatacctgcctccatgattcaactacttcccattgggtccctcccacaacacatgggaattcaagatgagatctgagtggggacacagccaaaccatatcaaaaggatatacaaaataaccagaaaacaatgaacaaaatgacaggaataaatcctcgcctatcaataataacttcgaatatgggttaaattacctacctaaaagatacagtcaggcttaatggataaaaagtgacccaacatcacttcccttgtaaagacacacacagactgaaagtgaagggatggaaaaagatataccacacaaacagaaatcaaaaataatcaggagtagctaaacttacatcagataaaacagactttaagtcaaaaactgtaaaaaggacaaacaagatcattatatggtaataaagggatcaattcagcaacaaagtataacaattccaaatatgcatgcaaccaacacaagcgcatccagagacatatagcaaatattattaaatctacatggagagatagagtccaataaaatgatagttgagaacttcaatatcctactctcagcattggacagttcatctagacataaaatcaacaaagaaacattagatttaagctgcactttggaccaaatggacctaacagatattttcagaatagttcatccagcagcagcagaatatacaatcatctcatcaacacatggaatattctccaggata

SEQ ID NO: 227214 - DNA, 1742 bp, Homo sapiens
caggatattgagaagcgcacagttttcacataaaccaaaggggcagaggaaaaatatggggaatctgcattttacataagataacagacaaaatggggtagagggaacaatcagatatgcatttgtgtctggcgagcagggtgactgcacatgtaaagataagctatcaatttgcattgccatggtgaagttttaacagctcaccaggaatttccctgtgggcaaaatatgggagaggcatgtagcttttcatcttgtagccatcttatttaggaatcaaaagcgggaggcaggtttgtgtgacccagttcccagcttaacttttccctttggctaaatgagtttggggtcccaaagtttaatttcccttcacagaacacagttttattttataaaattaacaaaaacacacaatatgtagatacatattgataaaaataaaactatgtaaaaaggtaaacaacagaatattcaatttagtaataaaataaccaactgtggatggttatcttgaattgaagggttggaaataagggatacaggaaaatcacacacaataaactaaattggaagatgggcctaatgctaacaccaaaaatggacctcttgacggcagaattgcatttatctatccagcctcaggaagagttacacaacctcaagtttcctcaagtgaggctgtgtgtctatgaaatgtggggcatggagaagcaagcatagcacagttttccaggaggcgctggcttaataaaagagggtggaatgtgaggggccaaacttttcatgtgtagatcccctctcaaactctacaaccagataattcattagtttagtggtgagaactaaaagatgagacatgaaactaaagttattcaggtataattgtaccttatagaaactggacaagggggatgccacttttcccacttatacaatcattcagtgtattgaactaccctgtgaaaagataagtacaattgcattaatagattaagtaaactacaacaaggtatggggtcacacacctgtagtcccagctactcaggaggctgagacaggaggattggttgagctcaggagttaaaggctgtaatgagttataatcatgccactgcactccagtatgcgtgacagagtaatacttcatctcttgaaaaatagagaaaagagagaaagaaattatagcttcaaactctatgctattttgaagacataaagtaaaatgataaaaagagttgaaaataaaggagtggacaaagatacatctgaatctaatcaattttttgaacttttattttaggttcaggggtacattgggtatattttaggttcaggtgggtggagggatgtcctttagttctgtcctttgtccagtacccatgaagataagctgttaatttacattgttagggtgaaattcaacagaactattttagggtacagatatcaaggtccacaagaaatttccttgtgagcaaactgaagatggtatatagccttttgtctttgtagctctctatttagaggaaaaaataagaggccattttatgtgacttgggtccaagcttgacttttcccttcaacttagggaatttggggtcctagtatttttatttgcccttcctagctgttatatgtaagttgctctggtgatttttcctgaagtttatattgcctaacttcagttggcagggctttaagaaaaagcacaattttaatctttagtgagtctaaccaagaaa

SEQ ID NO: 227215 - DNA, 679 bp, Homo sapiens
ttgggtgtcacctaggcaacagactgcttccgggagagaaaagggaagcaatcagcccctgaaaccagcagttgcttatctcctcctacgcaatggcctccccaggcacacagagtggccagtgttgctgggggcagagccatgagggggtccagggagcagagccaccctggctagctctcacctgaggcccagtctgcagacctgtgggtgcccttctgcagcaccccttccttctgagcaccaggcaagcgcccgttctgggagaaagctggccagggctgccatgaacacatcagggccagggcgcaccttgcacccaaggagaaggccacccttgaaggtcaagctttcccatgagtggaaaaccagattttctccactaccattttccagactatgcttccctctaacaagatgtcccgcacaatctgtgccatctgacagtagctgaagctccccgcccccaaccctcagtgcacgaagcagcacacacccacagctagaggttcccagacatacctgcgcaaaggcattctggaagaggaggctgtgggatgccagttggtcaatgtttggggccttcactagttcatccctgcaacttgaaaggataggacatgtgctttggaaaataacacctgtagccagccacagtggctcatgcctgtaatcccag

SEQ ID NO: 227216 - DNA, 444 bp, Homo sapiens
cagataccttcaattatcgcacttgtgttaccgtggaaacccaagtccatcctttctttctgtaaaaggtgttggaaaaggtggtatgaagtgggaaaggtactgtattctgggacttcctgacaccagcaagaagcaaatatgcagataatttaatagaaacaaattagtagaggatgtttgtaatgcgaggggtacttttcgactgtaaaaccctgattcctaatgcttcttattaaagcctgcatgcctctgattaaacataaaggggaagggcatgtcaagtacatttagcacctgtgaaacgctgctggcaagtataaggagagcagacgatggtttcttgacctgtgaggctcctaatacagttgagaatctgcagtatatatgtggagtggaaaggaaggggcaaaataaactttgttcttcctttaaaaaatgtga

SEQ ID NO: 227217 - DNA, 941 bp, Homo sapiens
ctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaagatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatga

SEQ ID NO: 227218 - DNA, 483 bp, Homo sapiens
ttgaaccaaggaggtggaggttgcagtgagccgagattgtgccactgcactccagcctgggtaacaagagcaaaaactccataacaacagcagcagcaacaacaacaacaacaacaacaaagaaatatacaaattattgctgctaaatatagtccccgtagcaaacattagcatttagtccttctatctatgtatgtttgtacccatgaaccagcttctcttcagcctgccctaccttgctgctcgactgtggtctctctccctgcaatgagggagcagccggcgtggcatctcattagcagattctatgtgccacacgctgggggattttctggcctcacatttctcttaggttagaatcatcagggctctgttgtgtttctcagtacttacaagattgaaagctcactttatatgtatgctctatgggttttttcctgagaactctggggcaactgagtgttgggccaagttgtgggccag

SEQ ID NO: 227219 - DNA, 492 bp, Homo sapiens
atccgtgcttgaatgttggggtacaatgatgaacaagcacactccctgcatcaaggtgctcatcagacaggcggagcaggcacctgcaacatagtatgctgtgggaactctcggcagaggggttctgggggctttcctagggaagctgtagctaagttttagcacagctaagagatgttactgagaaacgattactcaggagaggggggctgtcttagtcttttcaattgctaaaacaaaataccacagtattgtggctcataaacaatagaaatgtatttctcgcagttttggaggctgtgaagtccaagatcaaggtgccagcagatccagtgtctgcggagggcctattttctggttcatagatggtgccttctcactgtatcctcaagtggtagaaaggacaaggcagctttctgaggactcttttataagggcactgtcccattcataagagctctcatgctcgtgatctaatcacttcccaacgtt

SEQ ID NO: 227220 - DNA, 396 bp, Homo sapiens
gtggtattgcaattttgtatgtagcatgaccatttttaaaaatgacatttcatagtgagtgattcagacacctatcattcagcttacctgccggggccctccaaaatgagcagaaggcctctgtctcattctagaagcttgaaggtctccacgtggtttgcccaggggcccacaacctccctgcagtccaggagtgctcccattaaccccagctgtgtgattcaggccagattcttaggactttttaagtgaaatgggacagaaaattgcttgatgtattttgccacatgaagtacattttgctgccgcttagttctttattgtcgttagattaaaaactctcctaacgttgtgtgggtaagtaaaaatctttttatttttatctggtatgttttg

SEQ ID NO: 227221 - DNA, 422 bp, Homo sapiens
ctgtatttaattttttaggagagtttttatcatttagaagaatcacaaaaagacaagaacattgcagacggtacagaaagtctcatttttatgtgtatacaaaaatatatgtaaatatgctacttttaataaaaataaagtatatgttgttttgtaaccctttttttcacttaatatatcatgaacatctttccatgtcattgaatacaggtatcccttgctatctgaatctacttggtttctgagtcagggagcttgagttcaggtagaaagggatacctgtacttctctgtggcttctaatagctgcacaatattgcctgtatgaatgcattgtggtttagttaacagacctttgaatattgaggctgatagtaacttttctctatttataaataaactttgtatgtgctaataaaaaaa

SEQ ID NO: 227222 - DNA, 357 bp, Homo sapiens
ctctctccacactggctctctctctctctctctccctctctccacactctctctccacactggctctctccacactatatgttgttttgtaaccctttttttcacttaatatatcatgaacatctttccatgtcattgaatacaggtatcccttgctatctgaatctacttggtttctgagtcagggagcttgagttcaggtagaaagggatacctgtacttctctgtggcttctaatagctgcacaatattgcctgtatgaatgcattgtggtttagttaacagacctttgaatattgaggctgatagtaacttttctctatttataaataaactttgtatgtgctaataaaaaaa

SEQ ID NO: 227223 - DNA, 443 bp, Homo sapiens
ccgcaccacccccttttcccgtgtcggctcccccttcccctcccgagaccgcggaagctccgacccccttccctcgctgactgtccatccccaggacccccgtccctgtgtgtggccagtcccagcggcctctccttcgcggcctcccttcgccttcgtggccagcgtggtggagcactcccgccccccttttctccgtacccccgcgctcccttatgttgtcccttcttgtccctctctaagtccctcccacactatgcccccccgcggtacacacacacccctccccgcgaggcgtcccccggcgcccctcccctacccccgctcgtctatgcccctcccacccaccccgtccttttgtctcctctttggtctctaagtcccccgcccctccctcgctcccgccctcactcccccgagcacgctcttatcttccccaggtc

SEQ ID NO: 227224 - DNA, 483 bp, Homo sapiens
agtttcattctttctttcaatgtggttgccttttgtttttatttttatttattttttagtgttacagtattaagcagatgggaaaataatttgtcatactgctataaaaatttgtgaacattttttctctgtttttgctcttcctttatggtggaccattataaaacagttcatggacacacggaggtccactgtctaatatttgaacttcactgttctaatgtatttttataggtcactagtgactgtacacacacacacacttttctttttaagtgagtgaggaaaggtaaagataagaagttattcaataggcatagatgatttaaagtattaaacatgttttgaatatatccatatattcagtattgaactttcaatattatgttaaggcccattcactgaagcaaaatcaataaaacaaacaaaaaaattccttaatgaaaaacaagtagcccttctttcaagatggaatggctgatt

SEQ ID NO: 227225 - DNA, 410 bp, Homo sapiens
gatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgcccccccccaccaaccctgatgtgatttgggtagggatggtgggccttcgccagccacacctgggccattctgtcttcttgccttcctggccttgccttcccctattccagctttctgccaggtaaacagtactttccagcactacc

SEQ ID NO: 227226 - DNA, 450 bp, Homo sapiens
tgtcttcatctccatttcatatatccacctgcctatttggcatcttctcttgaatacagtagtatataaaaaggatactacatcactaccaactgagattcatttcaggaatacaaggctagtttaatctttaaaaatcaatcattgtatgacagtcatctcagacttaacacatctgaatggaactcatgatcctcccactataaatgaaaccatgttctccctgtattagtaatagcagcatccagtgcttcctctacccaaatctagccatgaacaagccctgttgattacctctctaaatgatacctgaaatctgtccacgttctgtctctccactgccacccctagtccaggataccatcagttcttccatggacttctgtaatagcttcttaattatacacctcacttctcttgccttattactatcccttctctactctgtta

SEQ ID NO: 227227 - DNA, 561 bp, Homo sapiens
tgggggagaatatattctttatatttttagctttttcctctttgttttcagagcaaattcacaccatccttgggatttaccctgtctttaatgactaggaaaaaaaataggatgttatgaagtttgtaggtaatataaaactacaagtcagccataaataacaactgtgaatatacagcaacagttgtagggagaggataaaatatcttttgtctaagaatgagttttgtttgttttttgtttgtttgtttgttttgagacagggtctcacgccctgggtgtcagagggagactctgtctcaaaataaaaacaaaaacaagccaaaaaacccttaaatccatttaaatacttacaagttctggtggaaagcagattagctatttgtttaaaatgtggtctggcagcaaaacactgagatttttagatggcatatatagagaaataaaacaagatagattgtttctctcctattctgattagatgacacctggaatactgctttctcttttgaacactttattactttgaaatttgaaatagttcagagagcagtaatgtga

SEQ ID NO: 227228 - DNA, 230 bp, Homo sapiens
ggaccgccagagatggatgcaagaggaagggtgataaggtggcacatcatgcccagcagctaattaacactctggagaagagaagttggagaccctcactgggccttttggcctccagctacgttttttttgttgttgttttttgttttttttttgagatggaaggttgcagtgaactgagatcacacttcagcctgggcgacagagcaagactccatctaaaaaaaaaa

SEQ ID NO: 227229 - DNA, 799 bp, Homo sapiens
atgtgtaatgaaacatgaagacgtcaaatataaaggatggcaattgctcagacttgtcctttgcttgtctagttatccatcaaacactatcagtgtgattgtgccagaaagtttcatgatcaaaaatcagcactgggatgtctgcttgcactattcccaggtttgcttccttggttcttcatatcatccagacccctgaactggaaatatcttgttaactctgcactgtttaatattctttggaaattaaactacttgggcatgtttagagctcaaatggaatctatgcattttgcttgacaaggtcgttggttgctttttagagcttacatattgaaaatcatgtttgcagtcagctgatagagaaatttccgtgtatcaaagcattgttgtgatgaaaccacctctgttgtgaagatcacctgaaataatgtgtgtgagagccctgtggaaaccaaaaagtgctgtgggcatttgaacactagactgttatgattagtgatgaacagcatctcagcctgccaagggagaacatgaaactagagaacaaatttggttccaggagcaaggggaaatgtaatgtggaatctcacagtttggggtttgtaattgggatctgttgctattataagaaaatgtagttcaaaagacacaggattttctgttgttaaaatcaatgaagttaaaagagcagctgcttgtaaaagttaattttatttgacatctgccttggtcccagtaataaaagtgattcggcctgcaagtgttttctatattcggatgtaattcaataatcaaa

SEQ ID NO: 227230 - DNA, 532 bp, Homo sapiens
attaaactacttgggcatgtttagagctcaaatggaatctatgcattttgcttgacaaggtcgttggttgctttttagagcttacatattgaaaatcatgtttgcagtcagctgatagagaaatttccgtgtatcaaagcattgttgtgatgaaaccacctctgttgtgaagatcacctgaaataatgtgtgtgagagccctgtggaaaccaaaaagtgctgtgggcatttgaacactagactgttatgattagtgatgaacagcatctcagcctgccaagggagaacatgaaactagagaacaaatttggttccaggagcaaggggaaatgtaatgtggaatctcacagtttggggtttgtaattgggatctgttgctattataagaaaatgtagttcaaaagacacaggattttctgttgttaaaatcaatgaagttaaaagagcagctgcttgtaaaagttaattttatttgacatctgccttggtcccagtaataaaagtgatagttctgttgaacaacctgttctct

SEQ ID NO: 227231 - DNA, 722 bp, Homo sapiens
caagtagagcttgttatagaggcacttttgtgaaggacacaggctgggattggagttctgggtctcaggtcccagagcttcaagtctgtttacgagtctcttgaaaatgcccacattctttgttctgtacttaagacgcttggataatcaaaactgccaaagccttaatgaaaatatttgctttgtcttacttttaagatgtttaatgcatttagtatggccctcacttcaagccttctggaatatttctcaaagtattcaagtagtttgtttcataaaagtaggccaaagttgatatcttttgtgtagaattagtcaaacagaaggagccaaagtaggtgtttgaatttgtataatctttgtctaatgcttatgacaatgcattctgtttttaaaattgcctgatttatgaactagtttgtaaataaagtataacgttagtttcagtggaattcgccaatgctgcagttttggatttagattctactaagagaaaaacatgtggtagacaagacagaaacaaaatttgtgatgatacctttttttctttacaacaatatattcacagttagtaaaaattgttgatgaagcacaaagttgtcaaactcaaactttaacagtttttttaatccttgtgtaactgttttttttttaaagcatttactcctttctttcagtataatgattattacagagactttattgcagttttttttttaata

SEQ ID NO: 227232 - DNA, 475 bp, Homo sapiens
acaccctcaaatgattggtggcattctgggaatagttagctgggtggagatgagcatgtctcagcagaataatttggtattattagcatgacatttgatattaaatatagtataataatcagggatcactgttacttgactcagagaagtcacaaacttaaaaagcattaaaaccagttaatcccaattagttaaaaacaaatacaagaatgactctggttcaatttgattgctgattagataattaacaattttgagaaataagcttgataataatagttactagagtaaaataggtttttattgttgttgttttgtgtcttttcggagagctgagctaggctggagttgggggagaagagatgctataggtatatgctatactgttttttctctccagaccatgaatttaatcagttactgttgtgcatatgtggaaaattacaaaataaaacattctgtaattgattgaatt

SEQ ID NO: 227233 - DNA, 167 bp, Homo sapiens
tggacgcagagggagacggaagagtggaatccatctgtttatggacactcaagtcgatccctgcaagaactaagcatgaaaggtggagaaaggaagactagcattttttggatgcctactgtgtgacaggtgctttcacttgcctcctcatttaaccctttcagcaa

SEQ ID NO: 227234 - DNA, 472 bp, Homo sapiens
cgagcctgggatgacagcttgggattcgaggaggctttttattgtctgactacagggtctggtctttatttggcccagatggagactttgtgcagggtggagacatgatcagaggagtacatttcaggatgtttatgactctaagaccttcttatgattccaacatcctttcatgctcctaagctcttccatgtgatgctgaggaaactcccctcccctccccagatgtctcctgcagcctcagcccttgagcattttcatctctgggtttctgtgctaaggaactcagggccctggcttcccatcctaccattctgaacatcagcacctttaaaaaaaacccctctcaattcttgggattctgagaagaaaactccttcatcttcccctttctgctctttcctagattttaacctaacttcagctatttcagaacgttttctgttcaataaatgaataattagatcttctt

SEQ ID NO: 227235 - DNA, 432 bp, Homo sapiens
ctttaattgcagtaattaaactatatttacatgttcagaatacttgtaatttagcaaattgcactctctgctctacatttaatcaaacaaccagttccagtatatttagtgtggaaagaagtaatttcaatgttttgattactatagcagatttgacagagtaagtgcccctctagtagagggcttgaaagggaaggcaaacatgaaatatagtcatggttttgattgtcatgtgaatgcctaattacatgttggaggattaactattaaagggtatcatggttgcagttgatgtttagaaacagccggtattacagatagcatagactgtcttttaggaaaatttcacaagaagttttctctttaaaggttgtgagatcataggaaaatttagtgaaaagatcgcctacattgtataattgttattatgtc

SEQ ID NO: 227236 - DNA, 306 bp, Homo sapiens
aattaaagaaaaaaaaaaacaagagtactagacaaccaagagtaaactgctcttctgaagctcaaagcctaatccactgtgtcttcaggtttggggggattcttgatttttaaatttcctttttttattcaaacttacacttggattttatcttcattactacttctaaaattaatgactcctatggtatttctttgggcttccttccccatcagaacaagccagttgttcataagctaacactcttgcatgcgtggtgagatacagagcattctgtcccacccattaaggcacgccatgaagaat

SEQ ID NO: 227237 - DNA, 601 bp, Homo sapiens
gcgtggtggtgcactcctataatcccagccacttgggaggctaaggtaggagaatcatttgaactcgggaggcggaggttgcagtgagccgagattgtgccactgcctgggcaacagagtgagactccgtctcaaaaaaaaaaaagaaagaaaggaaattttgaaaatacttaaaggtgaaaaaacaaaaacataacacatcaaaatgtatggaatgcagcaaaagcagtactgagaaatttatagttacaaacataaacacctacattaaaaaataagacagatttcatggccaggcgcggtggctcacgcctgcaattccagcactttgggaggctgaggcagcagatcatttgaggtcaggagttcaagaccagcctggccaacatggtgaaaccccgtctctactaaaaatacaaaaattagctgggcatggaggcacatgcctgtagtcccaggtactctacttgggaggctgtggtggaaggatcacttgaacccgggaaatggaggttgcagtaagccgagatcgcaccactgcactccagcctggaaaatacagtgagactctgtctcaaaaacaaaaacaaggccaggcatg

SEQ ID NO: 227238 - DNA, 549 bp, Homo sapiens
gagaaacgggagcagagggttggagggcaggaggctcgaccaggagggcgaggccgcagcccgaggctcgtggtagtctgccttcctgcgcctctgcgctgcaacggagctgcaatgcaagacgccttcatttcaatgtcccgggctccaatcccgggttctactccgtgaacttggctaagtcatgcagcttcttgggcctcaatttccttctctggcaatctcgtggatctccgaggtcccccagtctggacttgcgggggcttcgggggacggtcggcctcgcgggtgtcacctcccggcagtaggcagagcgcttccctccaaacgccctcagccctcatctcggcctggagaggaaatgctgctctctatatgacctcttagggctcactgaggggcctaggctgggaggggccccaaagcgacgcctcagactgctggggggcgggggcggacaggagcgctgaataatgaatgagacttaattgggcccgcactgcgcgacggcgcgctaagctttgcaaacagcgtgggcggcggcggccg

SEQ ID NO: 227239 - DNA, 475 bp, Homo sapiens
ccttagaacattattttcctctgaagcatggtttaccactgctgttcacagggtccagaaaattatttggactatgaggctgtgtattagagtgacttaaggagctgatgccctgaaagcagccaatctggctctgaatcccagtgttgccatttcctagcatgtagacttgggtagttaaaccaaaactctgttttcttatctgtacaaacatgttacacggttatgaggttaaaatggaagagtcactataatgcgcttagcacagaacttggcatgtagtcagaactcaaaataccagccatcctttttaaaaatcacatttgtttatcttctgggatggagggattactaaaagtacaggatttcctgcatcccgtttatgatgagatttgtttgatttaccttaaaatgtaaataccttctctttgaaaccctcccaacacaatgaaagtctctgttcccttcctaaggc

SEQ ID NO: 227240 - DNA, 737 bp, Homo sapiens
ctttatcacctagcagatgttagtggctgcaggatgggaataaaagtcaggttgggaggggatatttttagagcctggaacagagagaggtctaagatggttggctcagtgagggtcttgcactgggccctgaagcccggaagggaaggtggagaggagtgcaaatgatgaggaaattaagcctggcttccttcaagaatttatgtaaagctgagaactctgtttctttcttcttcttcctcagcagaaaggaagagagttaaaattagtaaagatttttttatgtgccacaaactttacatacattattttatttaaggcattattttatctccagtttatatttaggagccaggcctttttaattccagaattagtacatgtaaagctgacactctgcagccttttggtgctcaattaatgtctactgaatgaatgaatttattgtagaagtacttgatctcccatttggcataattcttcataaggccatcgtctttagactcagaattcctgttggtactattggtatgatggttgagttgcattcaggattgaattgggctttgcgtgctggtgtaacaacctgatcacctaatatgttattggttcaatagaattcattgagttccgaccattaacttaccgatgagcttttagagcacgaatcaatagtaagttggagattacctgtacgtgaatgtagaaatattataaaatgaaatcgtatgtagttg

SEQ ID NO: 227241 - DNA, 431 bp, Homo sapiens
tatcacaggtgagcaacagaaatgttcaaatacaggtgtgaatcttctgaatatgaaatcagtggtgaaatttctactcgcagtaataaggagacagttgtagaggaagggcaccaccagagtcgtgggtgcatgccttcaccccaggtcaggttcttggaggagagagaggagtgtgtgggtgggagcatggggatagcgtccagcactgctgccccttccagtacggtaagcaccaggctcaggtggctgctgcgtgcttgcagtgtggctctcacagattgagatgtgcttaaaatacacacgggatttcaaagacttgggtgaaaaaagtaaaatatttcaatatatttgtatatggatacatgttgaaataataatgttttgatgtattggcttaaataaaacataatttaacataaaatgtctca

SEQ ID NO: 227242 - DNA, 393 bp, Homo sapiens
tcacagtcacttcaaaagatggaatgacatgctatatcctcacagcatgagatgtttcttaatggttaccttccaatttgctcctttagcaccagctcaggcaaaccaacttgataaaactcacacactttcattggcttctcctccagcagcatttctaataatctatatttaatttcattcattcagaaaacatttattgagtgtctactccttgcaaggtatctgacagccaggaggctagactaggtcccggtacagggtctggtggtactctctgtagctagagtattgataattggaatgagagtaaggtaataacaattaccagttaccattcgaagtagaaataaaataagcccatcaaagttgattttttttagagaataatgc

SEQ ID NO: 227243 - DNA, 2037 bp, Homo sapiens
  misc_feature (1367)..(1367): n is a, c, g, or t
  misc_feature (1640)..(1640): n is a, c, g, or t
cagaaaaattagttaatttttttccttaaacaaatcattacttaagaatttaattgataattcccactgggagaaagcatcaagatgagcaaaaaacaagtggcattttatttggaatatttaagaagtaaaacaattccaattgttagaagagacttgacgtataagaactaagcattaaaaatggtaattaagattaattgaaggtttactctgtgaacgccattgtttcattgctctatgcaaattttgtagagcaaaaaattcattgaccagcagcatcaaaattaactggggagagtgatgccagcaagatgacataatagaaggtaacccactcattacccgccaccccccataacaacaataattctgcaccaccacagaccaaagtctctgtgcaggagcctcaggattcaggtataagattgtgaaaccccagtggatcccaagacctagaggttgttttgagagtgcagactaacaccctagtggctgatctgctgattttgcttctgggttcaagcctggaaatggttccattccccaaggagcttggctaaaaacccatttggtcttgagcctacaaccaaaaccatctgccaaggagtccagaaagaatcatgtacactagtgcctcaacagagagcctcctctgactgctgacaatgaatctgaaagttgccctgtgacttgacttcagcccttctctgctaaagtcccagctcagaactgctcacacaaggacctagagtgagactcgcccatgtcttgcatcctgggagtctgaacttccatgttgtgctctccagcctctgtcccataatagatcctgagggaagccagcctcagttctgacccctctgcagtcagggaactagcccatctgtgcagagacttgctgggagatgcacactcatctgagccaataagataggcttgccagctgccttctgcaggagatccaagggtccccagtctcagccctggcctcacctgctacaatcaatgaactacctcacctgtccagggactgtaggagatggacatccatcttagctaccagaacagtcttctgggtttaggtttctggccagatttttcatacaacctgggtacccttctttggtcttccccaggtctatctgggctagaaagctgcataaatctcagagctctcccaagactcatagcaaacctgggcttagcatgccctttaatgctctaatgctgagacagctgtactggtcttgggctcagggaagacaacagtcagtctccttagagtctgtggaagatctcctgaagaagaatggatataaacaaagccagattggggaaactagaataaatgcctaatccgtcantgtgcagacattgtcacacatccacaagcatcaagaacatttaggaaaatatgaccttaccaactggacaaaatgaggcaccagggactggccctaaagtgatggggattgtgatctttcagacaaaaaatgtaaaatagctgttttaaggaagatcaatgaacttcaagaatatacagaaaaacaattcagaaatttatcagataatttaatgaagattgaaataataattaaaaaaaccacaaacatgccggagttgaaaaatacagggancataatgaaaaatgaaatagagaccatcaagagcagaactgatcaaatagaataaaaacattagggaactcaaagacaggctgtttggaaataatcagaggaggtaaaaaaaagaatgaaaagacagtgaagaaggcttatggaattgatggaacaacattaaaagagaaaatattccagttgttggagttaaagagagagttgagaaagacaaagcagtgtgaaggttattcaaagaaataataataggactttccaaacctggagaaagatataaatatacaggaactggaagatcacagctaatcaatcagattcaacccaaataagaataccccaagatatattataatcaaactttggaaggtcaaagacaaatagaggaccctgaaaatag

SEQ ID NO: 227244 - DNA, 365 bp, Homo sapiens
aattttttgtgtttttggtagagacaggatttcgccatgttgggcaggctggtctcaaactcctcacgtcaggtgatccacccaccttgacctcccaaagtgctgggattacagacgtgaaccaccacacccagcctgctacagtcagttataatcacaccactgctttccagtctaggaaacagagcaagaccctgtctctcaaaaaataaataaaaagcaaatattacagtggagtgcagtggcattcacttgtagtctcagctactggggaaactgaggtatgattacttgagcccaggagttcaagctcggctgcagtgtgctatgatcgtgcctgcgaataactactgcactccatcctg

SEQ ID NO: 227245 - DNA, 370 bp, Homo sapiens
aaaaaaaaagagagaggacacaaattactaatatcagaagtgaaaaagggaacatcactacagatcttatggacattaaaaggataataaaggaatagtgtgcacaacctaattccttggaagacagtctgccaaaactcaaacaaaaagaactagataatctgaataggctgatatgtatcaaagaagttgaatcaataaataattaacctgcaaaatagaaaacaccaagcccagatgtcttcacaggtgaattctaccaaacattttaggaagaaatcataccaattcttgacaatgttttccagaagatagaagaaggataaatactttctaacacattctgcaaggccagcattacctaataaag

SEQ ID NO: 227246 - DNA, 292 bp, Homo sapiens
taagcctcccttctttcctttaccttccacccaagatgaatgcacgtgatcaagcaggaagtctctggaggatttgctaacgagacacacaggtccccaaagctcagtctttcttcattttgcaagtatgtatttccttcatctgtctgttttctcattccacagttactggaattaaagagttagatcttggggaaaagcaatcaatagcttttttaatgaaaggggacaaatgcaattggtatcacctaaggcttgagaagtagatctctactttctttaaaaaaagctc

SEQ ID NO: 227247 - DNA, 649 bp, Homo sapiens
agaaagaagaaaaatgggaggaggggggaaaggccttgctcagtgcctcaacaataccattctccacctgaaggcagagggcagagaggcagagcagctccaagaacagccatggggttatgagaacacgggcacgcgtggaagagaagctatctgggcctgactgggcccagacacacaaaggacgtacttgtggggagggggtcccccaagattccatttaggaacaagggcaagcttggggaaaaaagccagtaaagacatgagctccatacagctgatgacccacggttaaatgtgcccaattgctagggtaccgggagctggggtcaaaggcgagtgaggacgggtctccaccggctctcatctctgtgaggcacttggataatgaagtgatattcctctgccaaagtccaacagggccacgggcctatcagccccctcctccatggtccagcagagcagaaggctgaggacggagaagttggggaggaagggcgcctgggcaggcacggccgcctcctgcaggctccctgtgccaatcaggggcaaatgaagggcagaaatgtggacacagacagcttgcacctggcaacctgggagcgcaaacatcaccacgcctcgctaacgccaggtccagggtcctccc

SEQ ID NO: 227248 - DNA, 2709 bp, Homo sapiens
atgggggcgtgggccctggcaagtgcactcctcagccaatcagcgtcctgcccggctggtggattcggttacaagcccaagatcaccccatactccagcctctttcctcctcctcccgcagctccattcattggtcccgccgcaccgggcctgctgggctccgcttccgttccactgctcagctgccgcctggtggggccaccaagggcaggcatcccaggggctttgtctgactggactgggccagtgcagaatgggggttcaggcagggctgtttgggatgctgggcttcctgggggtggccctggggggctcccctgccctccgctggtacaggacctcctgccacttgaccaaggccgtccctggcaacccactggggtacctgagcttcctggccaaggatgctcagggactggccctgatccatgcccgctgggatgcgcataggaggctgcaggcatgtagctgggaggatgagccggagctcaccgcagcctacggtgctctctgtgctcatgagactgcctggggctccttcatccacacccccggacccgagctgcagagagcactggccactcttcagagtcagtgggaggcatgccgagcgcttgaggagagtccagcaggggccaggaagaagcgagcagcagggcagagtggagtccctggtggagggcaccagcgagagaagagaggatggaccatgcctggcacactgtggtgtggagttggagattctgctgggaactcctcggagctgggggtcttccagggacctgatctctgttgccgggaacatgaccgctgcccacagaacatctcacccttgcagtacaactatggcatccgaaactaccgattccacaccatctcccactgtgactgtgacaccaggtttcagcaatgcctacagaatcagcacgactccatctcggacatcgtgggcgtggccttcttcaacgtgctggagatcccctgctttgtgctggaggagcaggaggcgtgtgtggcgtggtactggtggggcgggtgtaggatgtacggcacagtgcccctcgctcgcctgcagcccaggaccttctacaatgcctcctggagctcccgggccacctccccaactcccagctcccggagcccagcccctcccaagcctcgacagaagcagcaccttcggaaggggccaccacatcagaaagggtccaagcgccccagcaaagccaacaccacagccctccaggaccctatggtctctcccaggcttgatgtggcccccacaggcctccagggcccacagggtggcctaaaacctcagggtgcccgctgggtctgccgcagcttccgccgccacctggaccagtgtgagcaccagattgggccccgggaaatcgagttccagctgctcaacagcgcccaagagcccctcttccactgcaactgcacgcgccgtctggcacgcttcctgaggctccacagcccacccgaggttaccaacatgctttgggagctgctgggcacaacctgcttcaagctggcccctccactggactgtgtggaaggcaaaaactgttccagagaccctagggccatcagggtgtcagcccggcacttgcggaggcttcagcagaggcgacaccagctccaggataaaggcacagatgagaggcagccatggccttcagagcccctgagaggccccatgtcattctacaaccagtgcctgcagctaacccaggcagccaggagacccgacaggcagcagaagtcctggagccagtgacctcagtttcagctttcctgggcaccagcctggaccttgcccatggctatgccaagccttgggaatctcagcctcccctccgtaggttagactgaagcatggcagaggctgttgtggacaatcaagaggatgaatggggggatctcaaggcccaaatgctggaccacatctcctgctgttctgggtaaccttgagctatgtatgacacaactcttctatgcctggatgtggtgttcaggaagctcattctgatgccctgggctttggccttgccagggaacttcacatacagatgagaatggggaaagggtaacttattgcagcagccccaggcagtaccaggaggaggtacatgtatgtccgtgttgcaaaaataatacatgcctcaaaaacctgcctaggggagccctagtgcctgggtgctgtggcctgaggtagcaggtgggaagttagggatgtcacagaaatgtctgtgtctgaatccaggattggggtgggtgttggagagggctttcagctcccctcctcccaggggggcctctttttttaacggctgccgtgcccttcctggcccagccctaaacctaaattcaaatctcctccatgcctttgcgcaaaggacctccctcttgcactctaagccttagtttcctcctctaaaaaaagggggtctctaaacaggagctacctcatagggttgttgaggattaagtgaaccaatacatatacagtgcttagcacttaataagtattcccccctgcgacacctagctgaactatggtttggtgtctgatcttgagaggttgatgtaaccttttaaaggcctcagttcgctcacctgtgaaatgggtctaagaatagcactgatctcacagggttgtgatgcagattaaaggagatggcatgtgtaatgtatacagctggt

SEQ ID NO: 227249 - DNA, 886 bp, Homo sapiens
tctccctgctagtttagaccagagcctagattctgacccagtcagtacaatgcgagaagccccattctcagcctcaaaggctgggtgcctcactgatgctttggccaaatcacaagcctcagttccctcagcggtgcgtggggatgatcatcctcagtttaacattttttgaatctgctcaatctcagagaccacagtagcaaagaaacatagtagagtaactcaaatcaatctcacaccaaactggtcttgacttgcactttttgaacaccatggagggaacagataacagagctcacagtgactcttctatcgattgatcaatctattgatctatttattatagataaaggtcaaaacaaggtctcacactgccaggttgggaggatagcttgagcccaggaggcagaggttgcagtgagccaaggtcacgtcactgcactctagcctgggcaacagagtaagacaaaaaaatatatattattgaaaatcaacggaggccaaattttgacagggaaggaagtaactgcaaaacactaggcttagtaggtacttatatacatctagtcccagttctctcatttacacacaatggacgaaccctgaagtacagacttaaatagctcagatagctaattaggaaattcagttggccataatagcatcctctctggcctttaaaatacttctatccaaatacatgcttattgtgatttcacctcatcccggggcacttctggccgtcggtcgcgcgggccgcaggcccaacacgctccaaaagggggtgtgaaaaacccggctgttttacaggcaattaaggcgcgttgccggacaaataatgatgcccacaaaaggatttgtccggcggaaacccctatagaggcga

SEQ ID NO: 227250 - DNA, 574 bp, Homo sapiens
tctccctgctagtttagaccagagcctagattctgacccagtcagtacaatgcgagaagccccattctcagcctcaaaggctgggtgcctcactgatgctttggccaaatcacaagcctcagttccctcagcggtgcgtggggatgatcatcctcagtttaacattttttgaatctgctcaatctcagagaccacagtagcaaagaaacatagtagagtaactcaaatcaatctcacaccaaactggtcttgacttgcactttttgaacaccatggagggaacagataacagagctcacagtgactcttctatcgattgatcaatctattgatctatttattatagataaaggtcaaaacaaggtctcacactgccaggttggaatgcagtgcatgatcacagctcacagcagcctcgaactcccaggtttaagctatcttcctacctcagctactcgggaggctgaggcaggcaggagaatggcatgaacctgggaggtggagcttgcagtgagatgagattgcgccactgcactccagcctgggcgacagagaaagactccatctcaaaaaa

SEQ ID NO: 227251 - DNA, 832 bp, Homo sapiens
tttaagtctcctcctcagacagacgtgggaagtaaaaatagcccagcccggtgtgtttgcattcctgagaaaacagctctgtggctttaaaaggcagtgcaaagaatggaggaggtgttatggaaacagtccctcagccatgtagcttgtcatcgttcaattggaagtcctagaagccaggaccttgtctctctcgttcacccacttatcctgcactgcgtttgatgccaggcacattgtaggcaccaagtaaatgtttgttgacttactgctggttgaagggaaccattttaaataagactcgagtcattgggttgacatgagaggttaggctagttggttctgtgtgagcacctcttaccacagttgacacaggagagctgcctgtccagctgacctggatagaaatggtgggcagcagggaatacagagattcagggtatacacgcagaatagtatgatagaggtcggtttatacaaatgcaaatgcagtagatacttatagttacagatagttattcaccgtagttactggacttcgtggtaattaggcatgaatagtaaacattttaaataagcaacaaattgacattccttttctctgcttattttccgttgtgtataaacattgtcagtatacatagtatcctttgcttccatgaagagcccctatccatacaagcatggtacttctaaattgttccctaccagaggagagaactgggatgcagaaagattatctgccttgccctaaggttacacatgaacactgacatttgttcttcaaaacaggtctcctgagctgcacccttaaaagtaatgcattttacca

SEQ ID NO: 227252 - DNA, 449 bp, Homo sapiens
ctttatgatttcgtctcttctatcatttttttggtatagatgggggtctcgctatttggattattgttgcaggcgtgtttggggtttttgagtagtggtagtgtctgaggtcagtcagggttgttctggccccagcagggctcttcgtagcttttcctgtgcaggtgaacaagcctgcggtttcacttgtttctcttaacttagaggagctgttgttcccaagagcagtcttgggctgaactttcaaataaaatgagtttcctcagggagcttcagagctctttccttatggacggcctctctccccaggctgatttctctgcaccacccttctgggcactgggtaagacagcagcctctgatcttcttggcctggctttcccagcatgggtgctctaccctactgttttaacctagaaagcctgaactgtatttaaaacttgtggttt

SEQ ID NO: 227253 - DNA, 359 bp, Homo sapiens
agggggcttgggtagtggctggaggacgatgaggtgatgaggtcgatattgtgtcatgacgatggcgcaggtgaccaatggatgggtgactgtgagttgtgtgtgggtgactgatgtgactgactgtagatgacgaaggtgatgatgacttagaaataaacacctggagcaaggtaaacacggcaggcaatgctcaataaagctaagagtatagattcttatccaaataatctaagaagcaaaatattcctatctggtacccaagggctgtttagctgtccaaccccaaaagctgaaaagctaaacagagctctgtcccatttctttctatttttgcaaaaaagatagatgctctttgt

SEQ ID NO: 227254 - DNA, 224 bp, Homo sapiens
gacaccccagaggagcctgacagctccttagatgcggacagcaagtgctcactgtggcactggcctttctgtgctcctgggctcagagctcttctccctccttccctcctctttcgtaggaagtctcactacctaaaattgtctgtccaataatcaccaccaagatgttacttctgagggagcatacacagtaggtgctcaataaatacttaataaatgaaggc

SEQ ID NO: 227255 - DNA, 224 bp, Homo sapiens
ctcttgcctagataactatgacatccttcactatttatattatttttaaaactctaaacaaataaattgcattattttcatacaatttctaaagtaattttaatgtcattttagccttataaaactcaatcataatgacagaagcaaaaatttatcttagttcccaaaactatagtagatttatttctaggttttgttgtttcccttaaaagatacagaccaaa

SEQ ID NO: 227256 - DNA, 429 bp, Homo sapiens
caatagtaatattttctaaactaatacaatacttgaagaaatttctgttaatgttaatgttattaatagccaataagttaaaaaataaaaggaagagtccattttgggggtgaacaattcattattttctactatacaataatggcttaaaaagataaatttatttttgagctttgatacaactattttcagacttgctttagaacaaagaggtgaatatacaagtaagcttttgcacacatcataagtattcagaagacgttctaaatttagcatgaggcttggtgcggtggctcacgcctgtaatcccagcactttgagagggcgaggctggcggattgcttgagcccagtagtttaacaccatcctggccaagatggtgaaaccccgtctctacgaaaaataccctagaacttaaagtataattta

SEQ ID NO: 227257 - DNA, 505 bp, Homo sapiens
ctgctcaccccctcagcctcatctctaactgccccctctggcccctggggattcagcttgcttgcttcctccaccagtctgacctcagtcctccctccctctgttgtcccctcctcaggcttctgttccattccttagattgtctggggtggggaggggggtatggagggaaaggagggtcatgtcatatgtctggggttcagcaaattgtacccacataccaggcacagaaacatacaaggaaggcacccccgctctgtgggcgagacaaagcagcaatcctcttcccacatgccaacccatctttttctttgccttcacaaacgtgccttttttctttcttctttttttggtcctctgcagcttggaatacatgaggaagaagagtgggagacaggaggaaaggtaaggttgggagagggcaagaggaaaggaggagagtagagggaacactccatcgattgccagcacaataaactgtatcatggactacttcaaactggcc

SEQ ID NO: 227258 - DNA, 805 bp, Homo sapiens
gacaacatggggtttcaccatgttaagacatgcctgaggaggaggagaaggttgtaaggaaattaagaggagacagttagaaacctaggtgttgcgtatagcaattcagctgctctcagtcagcattcactgagtgtccatatgccctgggtgtatctggagacaagtgagacttgacccttgacattaaactcagagtagtggccatcacccaattgccgtcaaccttctgaaacaagagacccctttctcgcaggccaatgtcagtcctattttctaaatgatagattgtgcttcattagcagtttatatgaggcactggagtccttcccaagcttaccctcctgtatcacccaggcccagaaaagccaggccttgcagccaagccaagagccttctgtccatgggagatggatggcctgaaagggacactccaggattgtctggggtggggaggggggtatggagggaaaggagggtcatgtcatatgtctggggttcagcaaattgtacccacataccaggcacagaaacatacaaggaaggcacccccgctctgtgggcgagacaaagcagcaatcctcttcccacatgccaacccatctttttctttgccttcacaaacgtgccttttttctttcttctttttttggtcctctgcagcttggaatacatgaggaagaagagtgggagacaggaggaaaggtaaggttgggagagggcaagaggaaaggaggagagtagagggaacactccatcgattgccagcacaataaactgtatcatggactacttcaaactggcc

SEQ ID NO: 227259 - DNA, 556 bp, Homo sapiens
tctgagccgtaggattagggctctgggtgaggccagagtccctaaagttgtacccatatctgcgtgtttgtatttcctgtttgtaattcctcctgtttgtactttttgtctcttatacggtacacttaaagtttctccacaaggtgtttcagcataaagtactcaaaaactaaaaacgtttaatttcattattaggttaagtgtgtaaaaaatgccccatcaaggttcttgtacaaactcccattattctcccagactccgaagtggcactccagaataattttacgtgggttagcatcttttataaaacgggcaggcagagcggcttatgaaattaaccttggaaaccacgcggccactctttcgggaaatgcctcctatttatgtttacatgggccagcaagagaatccaaggttggaaaggtcattcctcactacagaggctcatcgcaatcacagttccgtctccaaattcgagttttgggtgtgaagagtttataaagtccagccgctgtcctcgcagtgtttggggttagcggagggagagcttgtttgc

SEQ ID NO: 227260 - DNA, 365 bp, Homo sapiens
gtcagaaggttatgatacaccattattcatttttgtattttatccgcaacaaatagctagaaaatcaattcattattaaataccagagacataagagtagagtagtataaaatacaaaactgttttctactaaaaagcgttaagctgaaatatgattagatctctgttaaaacattgggaagtacagttctatttagtacatttttcagctacagttgatgtttatcactaggaaaaaagctttgttgaacctgcttttctacatgggtgaacctttactcagtgggatatttggaagaggtattaaagcgtaaacaatggttttggtagggtcaaacctgggtgcaagagaaggttcgggctcc

SEQ ID NO: 227261 - DNA, 409 bp, Homo sapiens
gcactggaaggtgggggggatcaacattttcaaaaaggtggtcagggtgagcttcgctaaggtgatacgtaaacaaaggcctaagaaaatgagaaccagctatgtaactatctgggaggaacgtttcaggcagaggggacagcaagtacaaaggcgctaggaggaaagagtgactggcaaggagcccatatgacttgagcagtgagtgaggggaaaatagtaaaagtcttgcggtaacagaggccagtgaaagactctgctttaaagccaggcagggggctcacatctgtaatcccagtgttttgggaggccaggatgggaggattgcttgagtccaggagtttgaggttacaatgagctaagatcatgccactgactccagcctgggtgacagaatgagactgtatct

SEQ ID NO: 227262 - DNA, 160 bp, Homo sapiens
ctacttcgacaccgtcatcggaagtcagaagttgagctcctttttgatgtttaaagcctgcataatatttgctgtattactattcagtgtattactatttcctttgtgatggaaatttggtttgtcccaattttctattctattaaaacactgctacata

SEQ ID NO: 227263 - DNA, 412 bp, Homo sapiens
ttgagtactatactaggttcattacatatatttccttttgacttcctgataatcctatcaggtagatattttacaactcagcaaagaagctgaagctcagagaggttaaatacctacttaagataacacagaaagctgatcaccaactctaatcacagtctccatcctgctgtgtgccagacaatgctttatgttctttctatattaactcttctaatctttaactcgtgagctgagtacttttattatccttattttatgatgaggaaattgaagcacacagagattagtactgtactctcctggctgtgtggcagaatccatgatttgaacccaggcagtctggctacagagctctgcaggttgagtatcccttacctgcaatgcttggaactatgttttggacttttag

SEQ ID NO: 227264 - DNA, 444 bp, Homo sapiens
caaaatgagaaatcaaattcaatgatataggtgcatttagtagacttcaaatttaatgttagcgtgtgtggctgttggtggctttttagcagtttactccattggttggctgaaatttggactcattggtggccttcagttaacaaggttgagatggctgaagtggcatgacaggaaagaaggaaaccaaaggctccttttccttagggagatggaaatgttgagtggccttatcatgcatgacctgtgtacccaccccatccccagctatcttttaccagtagacactggcttcactaagtctctgagaaaggcattaatgacaggatcacctgaatccttgaagagctctgtggttgctctgtgagatctgtgttcatctccatgactagcctagggctttgttagttgagaacataaaaattgctgtcttaaattactgag

SEQ ID NO: 227265 - DNA, 803 bp, Homo sapiens
ggaaaaaggcttgcgttttgaaaagcagcttttattcattcacataatctgaaatgcccctggccatgatcaccatcatctttgatgtggcttctgcatattgtctgtgcaacacactgccttccaagagaacggggacgcctacatgagagcagcatggtaaggcttgaaagaaatacttaactattgaacacaatgtcttaaaacagaagctctgcggatttccccctgttgatacaaaatgattcttctcaagagctcacagaaacttcttctcagattcactacacaggtcctgaagggaagcacattctttttgctcgttgtggcatatcttggcagagttccatttaaaatctcaaggaaacttgacacaagcaatggtttaataaatgcattcaaggttagggaaaatattttccagcattactgttgatctcttggtttactacggagaaattaggaatcactaacttcataaaatggttaaaagttctttgtggatgctcataaaatagttcctctgttgcccttcaattcttacattcctagagctccggttaaaatggaagaatggaaaggtaaactaataatgtctctctctctctctttttctctttctgcttttctttttcttaatctctcaaacgaatagatatgcaacacatacacaaatacatctgtgtatagctgtatttttttaaaaaaggatcttaagactcttccaaaaatatcaaacagatacaaaaaagtggatcttgtattaatctaaaactctagagattttacctctaatttatgta

SEQ ID NO: 227266 - DNA, 372 bp, Homo sapiens
agggcaagcaagatgatatatagcaaccaatgctttccttgttgggagaacaataagagtgatggcacctctggcaaactgaagaagacatgccccgtccggagggcacaggtatttctcaggtaaagtaggtgattgccaagtggcaatgtggtcccagtgttgtcagaacttctgttctgctagaagtgagacatttgacttcgtactagaaactttctaatttaaaaatattttctcaaaattgtttaaagactctatgtggtggctcacccttttaatcccagcactttgggaggccaaggcaagaggattgcatgagctcgggagctcaagaccagcctgtgcaacatagtgagattgcatctctac

SEQ ID NO: 227267 - DNA, 517 bp, Homo sapiens
agcagcctctttatttgaccatctagagtgaattcaagtatatatccataaaagatatatgttagttgtctctttatttgaccctttattaggaatatgcagatatagtgaatacatttttaagagcctatccctaatgacaccaaaaattagaatatgcctgtgtttatttctttttgcattttctaagaggtaatgtttcatccttaatacctagtatacatctaatcaaggataacattcatcatacaaccacaataagattttccagttctttatatttctttcttactttaagtcctttttctgactttccttcacaatatcctacttttttctccacagtattttattttattgtcatcacctacctttgattttattttcctcattcattcccagatgttttatagacccatctatgtgagctattttgtcagtctctacattaaagggacataaaaaatgaagcccaactgagaacatcttcataagccaatagcaatttcacccccta

SEQ ID NO: 227268 - DNA, 479 bp, Homo sapiens
tgtatacaagaggagggtaagaaagggaatacaaagcagtaggaagaaacttctagggatgatggatataatcataatcttgatggtttcatggatattaagatatgccaaagtgcaccaaattgtatcataaagggtcaacatatcaaattaaaaagtaaattgcaaaaggatgagtacttgtgtttttaaggacacacaagactgttaacagtaatttcctctgggaagtgactggaaagattgagggcagaaggaaagaggcttttacttttccttaaaccctctgtactgtattttttgccacaagaagtgcttttatagtttaaaaaaaatttttttttagttaagagtgttgaaggtgttgctacctgtagaatttaaaatcaatgcaatttctgatggaataccatgcatttatttcttaaatacagtaagtctacacatattctacgtgaaaagatgtctacaataataag

SEQ ID NO: 227269 - DNA, 462 bp, Homo sapiens
aaaccatggggcagcagagggcagaggagacatgtacagtacactcctttgagctctgtcttttctccttacagaatacccacttggaaaagagaagaagtacataccccttcatcttaggtcatgtctttttctgaggtcctatttcagtagtacagacgcctctgagctgaagagaggtaaagaaaagaacatgctgtctcgcacacaaaatctttgactgaccaccagccacctcccagtatctggagaaattctggcctcacgaactgtccgcaaagtaaaatgtttaagggatcttaacaatattgtaatgatcagttgcttaactgtgtgacagaaatactaatagtaatttgagtaacatgacaaaacatacaacgcatttacctaaatacagctctcaatctttataacttgtgacatgtataaggcagatattttgccttgtttaaatgatga

SEQ ID NO: 227270 - DNA, 371 bp, Homo sapiens
aaggcatggatatgactgcatttttttggagtttaatgtgatgtgggattattatgaatctctaccaaacttattatgtttaatacttttctaaaatatttgcatatctctggcctcatctggaagaacatttctgagttaaaattaataaaaggtgtttttccatcagctatgacaaataaatcaaaagagctggctataccctttgttgaacatgtatgtccaaagaagatcaattttgagaaagttgttgacagatttttagaaggtaaggctgaaaatagcaaatattattatttcttactatagcataccattatatatgttattccctttgtttataattttattaaatatattaatataatcaa

SEQ ID NO: 227271 - DNA, 513 bp, Homo sapiens
atccaattttatttttttattttttggacagagtctcactctgtcacccaggttggagtgcggtgacgcgatcttggctcactgcaacctctgcctcctgggttcaaagtgattctcctgcctcagcctcccgaatagctgggattacaggtgtccgccaccacacccggctaatttttgtatttttagtagagtcggggtttcactgtgttagccaggctggtctagaactcctgacctcaagtgatcttcccaccttggcttcccaaagtgctgggattacaggtgtgagccaccacacgtggccagaatccagttttagatatgttggtttgagatacctgttagatttccaactggaaattttggcagtttggttatacagatctgccaaaatgctgtggagtatttagatgatatttaaagcaatgagactgtatcaaataacagaaagaaaatatagaaaagggaagagggcccaagaagtatctggtgtcctttccagtgtgagtg

SEQ ID NO: 227272 - DNA, 350 bp, Homo sapiens
ttggttttagtgaaatgagttaagtagattacacacaggcaataagtactaaattgatcgggccgggtactgtcgctcgcacccagcactttgggtcacatcccagcactttgggaggctgaggcgggtagattacctgaggtcaggagttcaagaccaacctggccaacatagtgaaaccctgtctctactaaaaatacaaaaattagccaggcaggcgcctgtaatcccagctactcaggaggctgaggcaggataatcccttgaacctgggaggcaaaggttgcagtgagccgagatcgtgccactgtgctccagcctgggcaacagggtgactccctctcagaaaa

SEQ ID NO: 227273 - DNA, 187 bp, Homo sapiens
tatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatg

SEQ ID NO: 227274 - DNA, 179 bp, Homo sapiens
tctgcaagaaaatgggaggcagaggggaagagcatgcagtcagcacttggtgatccctgagccaaactccacagcctcctgccttctggccggtgacaggtatgccttgagcacagttttggttaatgctggggggttattcctgcagactaggcttagcttcaacagcacgtggttac

SEQ ID NO: 227275 - DNA, 460 bp, Homo sapiens
cagcggggaggagcctggtccctcctcttcctaggtggaacctggagttcaatctgccaggcaggaagcactctaggagggactctggccttgtggagagtccctgtttccttctttttctttcacccaataaaccctgccctcttcactcttcaaattgtctgccagcctagttttttgtggtcttgtgataaggacccagtcttgagctcaactaaggaaaaagtcgcacaacattattatctggtacagtgtctgcctttcaagaaaaataaaaataaaacacgcaaaaaggcaagtgaaacacagtgttaagaatcaaaggaagaatcagaaccagactcagatacaacatagatattggagttgtaagatagacaatataaaataactgtgactaaaatgttaaggatactaaagggaaaaaaaggtaacacaaaagaacagtgatggaagcact

SEQ ID NO: 227276 - DNA, 662 bp, Homo sapiens
ggaaaaaatcgatgaactggataagaaaatagaatcaaatggcatgctcaactgagctgaaggctgtttctttggggaaaatgaataaaattgacacctccctggcaagactagccagaggaaaaacggagggcacagaaacatgaaaaggggcacagcagcgccactcatttagggaaaggccatttcaggccacagtgcaatgccactgcatgactactagagaggctaaaactaaagtaacagtgacaagaccaggtggtaataagaattcagagattcaaacccttgaagcaacagagcaagaccctgtctctaaaaacaaacaaaaaacaattgagcagtaacataagatgtatcgcattgcctttctcttctctacaagaaaatattacatatgaagaggcagctaaagattagacagtcaaaaaatatacaagaagtcttatagaggtggatcaggcagttaataaaaagactatgctttttccctggattctataatatttattgaatgcagccactttcttaaatgtataatttattgtaattttttctcatgctaaatattcattttgattttttaaaattatttttctttttaaaataaatagagagagggtctcactatgttgcccaggctagtttcaaactcctgagct

SEQ ID NO: 227277 - DNA, 661 bp, Homo sapiens
ggaagaacgcatgtggaatacttgacatagagtaagcattcaataattgttagctattaacagtgatacttattaatagctaacacagtgacatatgtgtattcagattctaagccggtgcacccagtcctcccttcacaagaggaaagtgtcagcattgccagaaacattgtatgtcctcagtgctggtggctccagctacctgtcctccccttagcaatttggtattgtccaaacatttaggttttctgaacatgcctgaggcttattttatgctccaaatttgaggcttgagacttgaaccctgccaatgttaaagtctccacttgcaatatgaagttgaataattgcattcctcctctgctccctacaaagaatcccaagatgcctctaaaaggttcctagagcctcagatataattaatagcctagaacttcagagagcagaagtctgaaaggtctctccctgcccacttcttccgtatctcgttcagtatgcaccgctgaaaccttctggactaggcctggtcctgagacagcaccacctctttcctggagggtgagaaatgtgccaaaggtttaacctgctatccactggcccaggcaacaggatctcagactttttgaaaattgtgaggcccctgaggagctgattcagcata

SEQ ID NO: 227278 - DNA, 476 bp, Homo sapiens
aatgtggctatttaaattgaaatttaaatcagttaacataaaactgaaaaaaacttcagcccttcagtctcagtagccacatttcaagtgctcaatagttacatgtgcccagtggctgctggactgggtggtgtagctatagaacttgcccatcattgccaagcctactggtcagcaacttccacgtggagactgaattcctgaaagaactttcaataattggaataaaggttatccaattaaattgcttttgagtggaggttttaagcagatttagatcagttaacaggaaacaaaaaaaaccccccttctttaacatgtgggcatcttcatacagtcctgtaaatttgcaaatatggttctgtaactttaaataattgaattatttgtttttccctgcagagtggcttttgttgtattacttttcctttcttgaatgtcttagggaattataataatgattacctctcctttga

SEQ ID NO: 227279 - DNA, 495 bp, Homo sapiens
tatcactcttttcctttccagagttgccacatgctagaatttggctgatgtccatttgagtgtctctgatgggtgagagaaagtgtgtcaagtctgctaactttgtctttcaatacagagtgtggctgcaaggccccgaggtacactcctctgattgattaacgtgggagcaaggaggcccaagacttgtttatttcttaagccaaataaatgacaaagtaatttgaagtaatgtctagcaactgaaaataacccagattatgtccagatagagagaaaaggctgttttaactggcagttatactggggttgtaaatgtagagaaatacacaaggttatatctggtttcagctgtatctacttgttggttactatcagcagccctagtgagtgggattggaatttatagtacctgatagatggatgcagttggaggttgggtcaaaggtgttgctaccattaaaattcctgaaatccaagaacaaaaagaatctt

SEQ ID NO: 227280 - DNA, 669 bp, Homo sapiens
caatgtcaaatgttcaggtatctaataactaagagatacgaaaaacatgctaagggaaacatatatgaacaaataaaagcaactctaggagaacaatgaataacatctcagctcaaaggaaaattagaattaattactaaattgaaaagacatattaaaataacaccagagccttttaaatgtaggcagagatgacaatgtttgttataacccagcaaatgcagaataacaggtgctctgcgtgatttgcaacatgttcattaaaaaaacaaaaaccagccaggcacagtggctcacacctgtagtcccagcactttgagaagccaaggagggtggatcacttgagcccagcctgggcaacatggtgaaaccccgtctctacaaaaaattaaaaaatcagccaggtatggtggctcacacctgtagttccagatactcgggaggctgaggtgggatgatcacttgagcccagggaggtggaagctgcagtgagctgggatagcaccactgtactccagcctgggcgacagagtgagactctgtctcaaaacaaaaataaaaacttgtcttctttagatgaaaatttaagcaattatttctagaaaattgaagtgcacatgtctaattattagtatatatgtgaggaaaagaagaacatatttgcaatct

SEQ ID NO: 227281 - DNA, 298 bp, Homo sapiens
cgtaagaagttggctagggtattagtgttctgattgagatccagctgacaagctgacaagcatttcctcggggcctgctctgtgccaagcactgtgttgggcagtggggatacgaaaatgactaaggcccagtttctgccctgaaagggttcacagtctggtggaggagagaatacagagaggcgaacatcaatataatgtagacagtgggttctagattctacaggagtagaacctgcctgaggggtcaggaaagtgaaggctgagctggtctcgaaggacaaattggaatttgtgt

SEQ ID NO: 227282 - DNA, 304 bp, Homo sapiens
aaacaatggaatattagttcatagtggctatgaaagcattagtgctgttaatctttgcaaatagaaccactggccttttgtttgtcataatggccctgctattattttccacctggactaatagtctgtgatttttttaaaaaatgtacttaaaaaaaatgtattcagggccaggggtgtggctcaggcctgtaatcctggcagtttcgggggctgattcaggagatggcttgaggccaggagttcaagaccagcctgggcaacatagtgagaccctgtctctacaaaaaacaagaaataattt

SEQ ID NO: 227283 - DNA, 546 bp, Homo sapiens
agagctaccaagtagaaaggttagctttcctgaaacatatccaagtcttcactctatacttatttttaaggtagaactcacaaaactaactctaattctaacccagaacaaaattcactggttcaagaattttaaaatagggtctctacaaaacaacaaagtagctattctagtctattactcagaaatcaaaaccaataccctcctttcattttttagagatcataaaaggaatacaaaaaaattaataaaacaaaataaatggtcattacagaaaaattagaaaatatagtaagggacaaagataaaaatgaagaacactcacaattccaccactctgtgattactactactattttcttccagctttttttctacatacataatttttaaagttttcaaatttgatattagactatatagtttgaattctccccttctcacttaacattatatcatgaaaatatctgtataagtcaaggttccaccaaagaaacagaagcagcagatatagtcagccctcgctatccatgggttccatagccc

SEQ ID NO: 227284 - DNA, 500 bp, Homo sapiens
ctggaattgcgtaatagatgttggttgttggtggatgcagttaacacttacagtccagttactttcttaatattcattcaggtgagtcattcttatgtgaaaaaacaatttgcattttagttgatcatcataaaaaaattatgcagcccacaatgcttgccaagagtgtaggacactgttttcttatttagtttaattgacaaaacaactggagttctgggctttacgggttctcggagtaagggggttagattatttttatagtttagctttccacctggcatgtctcgtttttccattgctctcccctcaacacccctgacccaaatgaaacaattctagtcatcaatttcaaagatgagtttcataaattaaagtttggcatctatcatctacttttatgatattctcttacatttggggggagaattggagatttagttatcagatataatggtcaaatcaagtcagataaaaatgggaaattgtatactattgtg

SEQ ID NO: 227285 - DNA, 405 bp, Homo sapiens
ctgggtgaggaaggcgcgggacccgggtgcgaggactgcgtagcgtccccggctcccgcttccgcccgctttccacgcccacttctgcaagtcccctccggcacctcggcgtccaccggactcctaggggcgagccctcatttccgaggaatgggaccgccttcgtgcccccggggctgccagtccctagactagccctaggggcttctcgtcccggcggagccgggcggtgcctcctgcctgcgcctcgcacctccccgcctggcacggcccacccgggcacggcgccgccacgcgtgaaggcccgcatcggctccctacgtgggggacgtgcaggatgatgcggggtcgggggggatttcgctgcgtcgcccgccccctttccggcgcaggagggagcggccg

SEQ ID NO: 227286 - DNA, 502 bp, Homo sapiens
ctgtttgcagattcagctcccaaatcatcatccttccctgagtgctcggcctgtgctccctcgcctgcctgcctgctgattggctcttgctctcatgtgcacacatgctgtgttacacttaccctaccactgttacccaccagctttccacagcttccctccatcaccacgtgcagcataacccaggccagcctgaggagagttgctgatctctttctctttggtcactggccatccttggaacaagtagctctcacctgttccacaggctggatgtggtttctgtgctttgagagggtcccagcctgggcaacatggtgaaaccctgtctctactaaaaatagaaaaattagccaggcgtggtggcatgtgcctgtagtcccagctactcaggaggctgaggtgggaggatcacctgagcccagggaggtcgaggctgcagtgagctgagatcatgccactgcactccagcctgggtgacagagtaagaccctgtctcaga

SEQ ID NO: 227287 - DNA, 376 bp, Homo sapiens
atgatgctaatgtgcacagtagctcttattatttttgtgtttgcttacttttaaaaaatgctttcccttcgacagacgaactgtaacaggctattatttctcatccttttatttatccctgatggtcagacctgctctctttagcttgtcacaccaatataaagtggtttggaaaatcggatcactgacttattttagaattgtatatttaaaaagaataataatctcagcatagtgatagagaccaaagactgctttttaattttgtgggggagggggtggaattgtttgttatttgtttgttttatgagttattttgctttctttggttttcttgtaagctgatcccatatagatgacttaatcatcagaacag

SEQ ID NO: 227288 - DNA, 453 bp, Homo sapiens
ggccactgggagcccagctccatggattggaggtgaaggagttccaaataaaaaaagaggtaagataattatgacttgaacagacataccaaatgtttctactatatcttatccctctgttactcaatgtgagtgcatactttacattgcctactaaaattcatgttatatagactggctgcggtggctcatgcctgtaatcccagtactttgggaggctgaggcgggtggatcacgaggtcaggagatcaagaccatcctgcctaacacagtgaaaccccgtctctactaaaaatacaaaaatttagccggctgtagtggcaggtgcctgtagcctcagctacttgggaggctgaggcaggagaatgcatgaacccgggaggcggagcttgcagtgagcagagatcacgccactgcactccagcctgggtgacagagcaagactccgtctca

SEQ ID NO: 227289 - DNA, 254 bp, Homo sapiens
cgctgtccgattgcttttaaaaccttaaaccgggtggagagcggtggctcacacctgtaatcccagcactgtgcgagactgaggcaggaggctcacttgagctcagaagttcaataccagcctcatctctactaaataacaaaatatggctcacacctgtaatcccagcactttgggagcccaaggcagggcggatcacgaggttaggagatcgagaccatcctggctaatagggtgaaaccccatctctacta

SEQ ID NO: 227290 - DNA, 474 bp, Homo sapiens
ccccatggccagggtttgtctttccacagctaatggattgttctctccaagtttcttacattaccttttgaagcttatgcccttcctttctcttatctattaatatagatcatttagaaaattggcctgcgtgattctggcattcaaatagattctgtgatttttctttctgacaaagttaagtgattgtaagtactgctgagaagttgcttcatggacgtgccattagtcagagaaataatacctgagtctccataaatgttcggagaagtaatatctgagcttaattgccaaggaggctctccattccatcacgtgagatgcatctgaaaacataatcatccaaaatctggtataacaatagaccttggaaagcctcaataccagtggacatatggctgtctgtacatatttttacattctcagaatattcagacatttggaattagtcaatggaataaacatttaaattca

SEQ ID NO: 227291 - DNA, 1206 bp, Homo sapiens
  misc_feature (1139)..(1140): n is a, c, g, or t
aagatgtctttatggttgaaatactctacttcttcagtgtaattctgtgtataggcagtattgaaattatttgtcccttcagtgttactatatttactcaaatatgtgtgcagtgagggaagtagattgttatttgaaaaagataaaacattggtataaggcaggggctggcaaaatactgcctgtggccaaatcctgcccaccaccggtttttgtaaataaacttctcttggaatatagccacatccattaatttatgtgttttctggccgcattcacaatacaacatcagagctgaaacagagcccttatgtcccgtgaagccaattttctctctggacctttacagaaaaagtgctgaccccagagataaggtaaccttataaattgttgattacacacacacacacacacacacacacacacacacacacacacacacacacacaatttaacaaactaccctgactttttataccttctggttacatttccaggtgatattgtgattcaagagagtgcattcattttctttactaagtctccaaagcactgtggtctaggagcagcaataaggaatgcatagagagttgagacggttgattttgttgttaagtgtgggttatttaaatgtgaatgtgaatttacatgtgtggcaatcagtaagctgcagatagacttctatgcagtctatgatgtcttttggagaccctgttgtgagctgtagcggtaataagagagccaggcatggtagtgtttttgctcctgaaactgctatgtgatctttaagtacatagtagtaagagcctatcaaactgagcttagactgttggtttattattttgtttgtacaacttccttttttataacgaagcagttgacactttagttcttttaagtgttctaagtgtaatgttgaaaatggaaattgagtaaagacaggtggctgtgtatttagaaagtaataagtctccatctctcatcatacacaaaaataacttaagaatatattttaaaaatctaagtatatattttaaaaaatcttctggaaagtgtaagacatcataacccagttaaaaagacaagtgatggccgggcactgcagctcacgcctataatcccagcactttgggaggccnnggtgggaagattgcttgagcccaggagtttgagaccagcctggacaacatagtgagaccctgtctc

SEQ ID NO: 227292 - DNA, 802 bp, Homo sapiens
aggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacata

SEQ ID NO: 227293 - DNA, 409 bp, Homo sapiens
cctccccgagctcggggactgagtggcagcgcgcttgggaaccccaggagccgccgggattggacccgttccccgccaccgttattgcgctcccacgcgcgctccaaaccccggggtgggagggggctggagaaaggacgcgaggaaacccgaagaacattcattttctctttcccagggaacctgggtctgggcaggtcggcaccctaggaaagggggcggagtggggcaatggaaaggaatttcttgggaatttcacgactccaccgccgccccccccggccccgccccaccccaccccaccctacaaggcgcgacccggctgatccctgccctgcaggaacccggtttctcgccagcgaactgctctcagaggctaccgagcgttcccgcctcgccgcaggaactc

SEQ ID NO: 227294 - DNA, 368 bp, Homo sapiens
tctagttcaggcgcgggagtttcccgggtaagggatgtttcgcgcgtcacctcggcgtaggtggctaaaccgcgccctcagagccgagatcccaggctccagcggctcctctccctcagtcctaattcccgagccggggcgagtcgccctcggggggccgcggatggggtcccagactcgcaagggcgcgccctctccgcctcgggcgggcactcggagccgctggaccgctctcctcgcgccacgctgtgcggtggcccaacttctggatggaggagacgcctctctgaccacgaaaccccgcggggaaaagtgacccaagacagtgagtgtgaaattagcgcgggaaggaggagagggcgccccgg

SEQ ID NO: 227295 - DNA, 423 bp, Homo sapiens
atgcagccatgcagcacaaacaagatagaacgttttttgtttggaacctattgaaaaaacaaatgggtagcatttttaaacactcattgattatggcagggtggcatgccccaaatggtctctattgctgaagagtagttttaaactttggccctttaagtatcatagtcaaccaaagaatagtgcccccagaaagaaaagatcgctggccgatcaattcccagatcgtctctttctgagaattaatgtttgcctttttctcccatgatgttgggatagcaaagagaaagattccgatatatgataggccaggtattttagcttaaaattttgcttcttctggggaagaattataacttttcatgtgaaatgaaaagatgatttacttgtatgtaactggatggttgctgagtgtgttaatta

SEQ ID NO: 227296 - DNA, 146 bp, Homo sapiens
gctttgcttgagacagggatcccagttgcactagtcttcaaacacttataatcatggcagcaggctgggtatgcatcttcgggttcctggcagcatataccacctctggtggtagtgagtatgagtgagcttctccttaggcctcc

SEQ ID NO: 227297 - DNA, 443 bp, Homo sapiens
ctttgtgcatgcaaagagacgtacatgctacttcttcatcaagcgtgtacactgtaaaacagaaaggcttttttattttcaaagtttgggtatttacacagaggcccttgcatatgcgtgatcatttcagtggctcatttgtttgtcttgctgtgtataatagtaagacacaagcccctcctgaagccatcggcagtctcctcactgctttgaaagttgatttcctttgtcatccttacttcctaagggttagcctgagtcatccagcatcaggatgccagctttgcgttagaagttaattattcttctttatcatattgaggacacttaatttttttagtgatttactctgctttgtaattatagatgtggtgattagaatgtcttatatttgacattacagatttttaaaaacatgatttattcccaccactgatttaaaa

SEQ ID NO: 227298 - DNA, 416 bp, Homo sapiens
ctcaaagagctcaccttctagctggggagacagcttatgcacacatgcaggcatcggatggctcacggacggcaccatatgcctgccatcatcattattgttggagctcaagtacccaggactgggtaacaagaaaggctttctggaggaggaaaaacttgagctgggcttcagaagaccaagcgtctcagactggaaggggccttggcgatcgtttattccagcagttttcaaattttgtagcctcaggactctttcttcaaagaagctctgtgtggaaaaacaatatataaaacagttttttattattgagacctacttcctactccaagtagcccatgagaagtggagcagaaaccgaaaagagacatgggagttgtggaagagacagaaggcaataggcaggtacggcagga

SEQ ID NO: 227299 - DNA, 497 bp, Homo sapiens
gaaagaacagttcacgggagggtggaggggacactgtgaggaggggactctgacctcaccatgtgcacatgaggggatccagattctcaatgagggagaccctcgcagggcaatgaccttcccctgggtttcaaacccatcaatctcctccatggtggtggcagagaggaactatgcacagtgcagagaatgtcccagctatgagtcatattcccagcagcttttcctgaccattaaatgggtaattctgatggaagagggcaaaatatgctctataaaggtaagcaggcagacagtgcaaaaactgcatttccagaccagcctggtcaacgtggtgaaaccgcgtctctactaaaaatacaaaaaatagccaggtgtggcggcacaccatgggaggctgaggcaggagaattgtttgaacccaggcagggggaggctgcagtgagctgggatcgcgccattgtactccaggctgggcgacagagcaagactctgtc

SEQ ID NO: 227300 - DNA, 583 bp, Homo sapiens
agacacacccaggaatgatactttgcatccttcaagccaatcaagttgacacagtactaatcatcacacctgcatatactgttattttctgtggttgcagtactatagacttttctgaggatcctaattagaatttttaaaaattttacttcatcggaggtgggaacgtggattctggcccttccttgaacaaagaaggaaacggccagaaagaggaagggatgtggggacttactcctctagaggtgatttatcagtttgatcatgttgatctttcatttcttgctgtatctctttttttttttcttttttaactgttgttggagactcacgtttgcctgtctgtaattacaaaccaggctggagtagggacagtcattggccaacctcatagtgggatgaggagagctggtcttcaagccaggggcctggacatatgaagggtaatggtctctgggaatcagtgagcctccttgatccgtctgcagaaaccccttccttctggttccctgctgctgctgggcatcaggatgctctcccaccattcgagctccttgcaaacctcatcctaaccctaaccctg

SEQ ID NO: 227301 - DNA, 405 bp, Homo sapiens
cagcatgtgtcttgtggatcagcagcattagcaccacatagaagcttattagaaatgtggaattgcaggccgtatcccagacctcctgatttcatatgcctttttgtttgaaaaagccctactctaaagcacaatatacattttgatgcttttctcatgatgtaataattttctagtatgtttgtgactaaatgcagtcaagaaagccctcaatttcttatttttctatgttcccttattttaaaataataaataatgaagagagtcttcattgcctgttagaaaacaatcacttatttacaacaatagctttacaagtccagcaattcatctaaatgcccaatttgccctgtagctctacagcatgcccacagagccaacctaggtaagctatattctttatgg

SEQ ID NO: 227302 - DNA, 498 bp, Homo sapiens
aacatatcttttaaagtcaataagaggctgtatgaagtataccgaactgccgaaggctttgttctgactaatatattggaagagtatcttttgtaatctttttgggaaaactctacagttccgtctttcattttttgaaaatgccccatattatgagtacatgaaaaaagtgcatgagtactcaaagatatttcttcattagattagccgtcaaattagtatgttgatgttaagcatatataaacatactatattctgactgaagtggacttactcttcatactaatataaacatactatattctgattgaagtggacttactactcttcactggtttgtaatttgctaaattatggcctagaaaccaatcagtttgcttaatacagtatatgtgtaatcaaagcagtatcagatacactaggcttaacgagaagtggagataagccaggtaaaatacttggcagtgatgctaataaaacctaatttggatttttaaa

SEQ ID NO: 227303 - DNA, 305 bp, Homo sapiens
caaagatgtagatacatagacatttattataatactttttttagtaggagaaaacttaaaaaaacagttttccattcatagacaacatagttggaacatttacaacagtagtaaactataaagccataaaggaagaatgaagtagttttgttgtagctctaaaatatattgttaagtgactagaaaaaaaatcctaaacattatatatggtatgtgccttttatgtaaaacaaaatgcggcatgtttgtttcagtagactcaagaatgaaaagataactgctcaataaatgttcaagtagaaaac

SEQ ID NO: 227304 - DNA, 251 bp, Homo sapiens
tcatatgtgattgttgggtcaatgatgaaattaagtggaaaaaaacccaattttctgaaacacatgaaaatagagacataacataccaaaacctctgggatacagcaacggcagtgccaagaggcaagtttttaaaggattaaatgcctgcataaaaacatagaaagatctcaaattaacaacctaaccttatacctagaaaaacaagaacaaactagaaaaacaagaacaaaccacacccagagctagca

SEQ ID NO: 227305 - DNA, 441 bp, Homo sapiens
aatcattatctggactgactcagttttattgaccagtaagtttagaaaaataatggaattcagaaattaggttaacctttgtacttggagctgagaatagggacctagatgtaaaagatctcttttattctaccttagaacagccaaataaggctcagagctatggtgagcttgtcccaggagtcaaagcccttcaggtgaacagattatcaaatctgggaattagaaggtcttctgttgtcaagtagtcaaactcttcctttcttattaaggcaaagaacattatacactttctgagctagaaaaaaattcattaaaataaaaacaagaatttatttatttatttatttattgagacaaggtctctgttgcccaggcttattaaggcaaagaacattatacacttgctgagctagaaaaaaaattcattaaaataaagac

SEQ ID NO: 227306 - DNA, 467 bp, Homo sapiens
atggaggcttctaaaccccttggaattccctgactgataggggcaagaggaaatcttttgttattcctaacgagcccctttcatccatgcctgtgtttatgctaatgaggtgactcctggaggatgagggctggttgccaggggaatcaactttgccttgcaactttcagctccagtccgtgacttccagggaaagaacaggggctggagattgagtttaatcgccaatgaccagtgatttgatcattcatgcttaaataatggaaccataagaaacctaaagaaaaggtttggagagctgctgggttcaggagcacattcgtgtgctgggagggtgttgtgcctggtgaaggtgtggaagcgctgactctgcctcgcataccttgtcctgtctgtgtctttcatctggctgttgctgagttgtgctgtttataataataaactggtaacaggaagtaaagcaaaaa

SEQ ID NO: 227307 - DNA, 447 bp, Homo sapiens
gaagtgatgcagttctagaagcttctggtggtgaactccacatgcctggaggatggtacatgtcaaactccgtgggaacagaagcccctgaaatcaggccctttcccaacctaggcacctcttcatcgggatgcttgtctatatcctttatgtattatatcctttcgaataagctggtaattaatagtaagtaaagtgtcccttgagtgctgtgagctgtcatagcaaattatccaacctgaggaggggaaccctcgatttgtagccaacttggacagaagcgtggtaacctgagggcccactacttgagactggcatctgaagtggggggcagtcttgtgggatggggccctaaccctgggggggcctgcactaactctgagtagctagtgtcaggatcgaattaaattgtgggacatccagttggtgtccacagagaactggttg

SEQ ID NO: 227308 - DNA, 266 bp, Homo sapiens
tctggctggattaagaaaaaaagggacatagaaacaactgtaaaacatggataaatgctaattaattttaaaaacagagaatgaccataacatcagaatatttgagaggagacactaaatgggaaagtagactgaaatgtaatcatgagtcaacatataatatctctcctaactaagatcctatcagtaaaaaaactgtgtacaatatatcaggtaattagtatttttaaactagatttgtgattgtgcctggaaaaagaagagaa

SEQ ID NO: 227309 - DNA, 156 bp, Homo sapiens
catgaagcccacagaagggagactcatcatcattttcaatgtcgtcattaccaaaagcctttcttatgcgattcattgtgcaaggctgtgtacagaaactgttgaaggatccttttgctttcttgtgacttaaaatccatgacatttcacaatgct

SEQ ID NO: 227310 - DNA, 465 bp, Homo sapiens
tggacaccagtggctactgagcactcgaactgtggctggtgcaaccaaggaaccgaatttttttttacttaatttttattttacttaattttttttacttaatttttattttactttattctaattagctaaagcttaatttttagtagctagtggctgccatcagagtccagcatactttaacatttatattgtcttaatcttttctctttttttttttttaaaatatacacagagacagtgtctccctttgttgcccattcttggcttgaactcctgggctagagcagtcctcttgcctcagcctcccaaagatgggattacgggtgcgagccaccacactctgccacttacagtatcttcttgttttacatgttttctccagatcttgatcctcaaaattgaaaatcagttgtgagtattgcattattatgcctgtaaaaattatccttaacttcacaagca

SEQ ID NO: 227311 - DNA, 875 bp, Homo sapiens
catgacatccatgttattgacttacgaacttactctagcaaggcagtacccaggcaacccacagccattgtagaggtgtggttgtttcctgaaatggcccaatctcatgctcttcctgtgttgacatcaagcaccgacagctttttatgaaagtctctttagccaggaaggctgaagtagtgacacagcagcattgttcagttcggaatagttaacagtggtttcagagtttggctggaatcttgggtcttgatgaaacacattgtacccattcctgtctcaagccaggccctagcagaattagtgacctaaagctttcatttaagtagtattttaatgtttccagacatagccaagctaaagactttaaagcaacctaaagaaccagaggagatgggaggagtacagttcaggagtcggatggctctgagtttaaagccaggccatgctactgtgcagctggtgattttgaataaagcggtgtacttctctgatccttgggttcttagtagagctacctctgagactaatcttgtgagttaagctctgtaaagcacttggcaccttgtatgtcacaaagaaggccttcacggatgcagtggctcacgcctgtaatcccagcagtttgggaggccgaggtaggtggatcacctgaggtgaggagtttgagaccagtctggccaacatggtgaaaccccatctttattaaaaatgtaaaaattagccaggcaacgtggcatgtacttgtaatcccagctactctggaggctgaggcagaagaatcacttgaacctgggaggtggaggttgcagtgagctgagatcacaccactctactccagcctgggcaacagagcgagactacgtctccaaaaa

SEQ ID NO: 227312 - DNA, 478 bp, Homo sapiens
tcgaactccaggctcaagcgatcttcccgccttggcctcccaaagtgctgggattacaggcatgagctatagagcccggccaattctttctatttttattggtttcaataggtaatacacttacacagggtgcaataatcaaaacaacatagagaggaaaagtgggccacattgcaaagtcaccctcccacctgtgtctgcccactgcactcaggggccagcatggttcgtgcttcctgggtgcagtgcgagcgtcgtcctgtgcagcggggagcacacatcagtatgatctagtcctgctcctgtggggctagttcttctccgcagatccacacacctgctctgtgccctggggactgtgccacctggctcttttgccctctggctttcagaggttcagccagttggggggatgggcaggagacgggagagcaggtggcgtgagaggtgggggcccccgtttgatgggagcttctcc

SEQ ID NO: 227313 - DNA, 529 bp, Homo sapiens
cctttcagagaatttctgctgggatttaaatgtatgtctagctggctttagacattagaagactgtaatatgtaccttaataagttgcctttcccatggtgtttgttatcctcagaagacccccatagtgactctaggagacaattctcatatcttctgaactgtgcatgttcatagtttttctgagcagggtttgcatctagcagcgatggaggtataggaggtcacaggcaacactgcgtgcctcacacaacattgtagatcaagacacagttaaatgggctggcaattctgagtttctgagtccagtcccatgactagtatagctgtcagaactagaggggccaaccctgggaatcttggagatgctttatgaatatatgagatttcaggcatccaagctcttctatttgtttacatgtattctcaatgtctatctcccattatcaaatctattccaaaagtattttttcaacacttgctggagactcttggataaagctagtaaacgtgcttttattaagctcca

SEQ ID NO: 227314 - DNA, 199 bp, Homo sapiens
tagttgactggcagaaacagagaaataaaaagacacaggcataacatatatcttctgtcattgccacatggattttacatgaaatagccagattaagaggatgtaaccttgtaggccttcaagaacagtaaagaagttttcccttttctgcactgagctattcttttccccactgccttttatctcttttttttttttt

SEQ ID NO: 227315 - DNA, 256 bp, Homo sapiens
tcatatccatccagcttttcaaacagactgaaccttaggaaaaataatgcagacccagtgggccatcttaaggttcagcggggctctaagggggaggtggcacagagagcggctgattatttgcagggtagggtgggaagctttttgtggtctgtccacacaagagcagcccacttggttcacagtcaccaattcctataggatttggcaggttccatgacttttttttttttttttttgagacagagtctcactc

SEQ ID NO: 227316 - DNA, 293 bp, Homo sapiens
tcttcatctacaaagagagaagctgaaaccctttatatagtgtctgcagatgagagagcttcaaggttttccacagaacctgtttctcttcttcatcccactcaatagactatgtaactctgatgtacttctgtttgtttatgtaagtgggagaagcgttctagtgaccatctattttcaaaaatgaccagatactaaaattgatttgggtatcaccataagtctagaatctctatgctgtactctgtacacaattcttcctagtacttaatagatttaaataaacttttgtt

SEQ ID NO: 227317 - DNA, 462 bp, Homo sapiens
tgtatgatggttttcacggatccattatcttttttgataagaaggctctctctttcccatgttccctgaagattgtgaatgctgtagtcagttatataaagggcatatgatagtaaccctggggccccgaggaggaaggggcaagtatggactctaccagaaaccgggtgctttagtgagttctattttattgactaaagaggtgctacatcaatgcttggggcagctgggaagggtgagaagtaagctaacagtcttgcttagtattcaagaaaatccaaactgtgtctgtttccttccagcactaacaatgtccattgctggatctagcgacattctctaacattcccatttaggtgaaataaatatcaaaaggagaaaaaaatgcctttaaaaatttctcaaagccccaacatataagatctgtgcagaataaatgccaacaactggtcataccgtcag

SEQ ID NO: 227318 - DNA, 447 bp, Homo sapiens
aaataaaaatcttgcataactcactcagactgcctcctaggcccagctcatagaggcctcaacccatattccgcgtgcaggtcatgaggtcagcgttttccctgctccatgggacacagcactgtctgacgtgtaatgcggtttgtgtgtttactttcttgaatgtaggccccgggaggcagggggtttggtgagtcctggtcacttttgtatcctcaatacctagaacagggcctggctcagtataaatgcccaatagttactgaatgagtgaatgaataaatgaatgggttaagatgacacaccaggttgttgcagaattaaatgagataagaccctggaagtaattagcacacagcacccagttggctcctgacatccttaatctacaccttatggcctgagtacaatgttctgattggccagccctgggtcacatgacatcct

SEQ ID NO: 227319 - DNA, 918 bp, Homo sapiens
tccttactggaaaaaccaactgctggggagtgccaagagtccctagcaacaccctgcagcgtttgaaatctgaggggaaaagactgtagtcagcccttagtggatgagagcgcctatgctccagaaacagcaggctcccaggatggacaccccgccccctgaagaacgcttagagaagcaaaatgaaaaactgaacaaccaggaagaggagacggagtttaaggaactggacggtctgagggaagccttggcaaacctccggggactgtcagaggaggagaggagcgagaaggctatgcttcgctcccgcattgaagagcagtcccagctcatctgcatcctgaagcggaggtcagatgaggccctggagcgctgccagatcctagagctgctcaatgcagagctggaggagaagatgatgcaggaggctgagaagctcaaggcccagggtgagtacagtcggaaactagaggaacgctttatgaccctagcagccaaccacgagttgatgctccgcttcaaggatgaatacaagagtgagaacatcaagctgagggaggagaatgagaagctgaggctggagaatagcagcctcttcagccaggctctgaaggatgaggaggcgaaagtattacagctcacagtccggtgtgaggccctcactggggagctagaaacgctgaaggagaggtgtgctcaggatgcctgccaggcacaggcgcgcgagaaggagctgctggagctacagagccagcaggcctgcacccacaccaaggagacagaacagctgcgcagccagctgcagaccctcaagcagcagcaccagcaggctgtggagcagatagctaaggcagaggagacacacagcagcctgagccaggagctgcaggccaggctgcagaccgtcactagagagaa

SEQ ID NO: 227320 - DNA, 446 bp, Homo sapiens
cacctgagcagaacgtggaaggtggatcccccactgtctctactggggaccatcagccagaaaaagtacccatgctggagagaattggagttaagtcaatctggaagttattttctacttatctatctaagagattcaaaaactagtgtttcctcgagaatggtgtcatcaagcacaagataatgaggaagattgcctaattcaggaaaaaatatggagaaataaaaccccacattgcaatcacatgtaattgggtgaaagcaaaggctcctattctctgctgatccactgacagatctctcgtttagatgctctgcttacattacctcatttaaaacctgctacagtaaaataaggtaccatgtatgtagtaagcatttactaaatgccaggtacattgctaaatgctttctgtgaataaacttacttttaattttcacaacaaa

SEQ ID NO: 227321 - DNA, 669 bp, Homo sapiens
acagaactgaaagctactataaaccaggatgtgtgttgatagatgagtgaaaagtggagaaaagaggataaagctccttttacctccattccttattcaggtgaagacaacatcccaaactctaaataaatgttctttcaaagggcacagaaagccttcctaaaacagtcctgataaggaccagttatcacactataggcgtaactccaaggatccctgtccttgaaggcgcatgacatagcctactcagaggccaaaggctcctgggcttctgctaagtcatagctctagtgtctgttgtctctcattctctgtagacgtggatttttcactgttcctctgtctttggcctgttgcagtggaacaacaaacaggaccacaggatgagagccttaaaatacaggccaggcagtggctcatgcttgtaatgccagtactttcagaggctgaggcaggaggattgcttgagcccaggaggttgagacaagcctaggcaacatagcaaaaccctagctctacaaaaaaattagccgggcagagcagcctatagtcccagcaccttgggaggctggggtgggaggattgcatgagctcaggagttcaaggctgcagtgtgccatgattatgccactgcacttcagcctaggcaacagagcaagactctgttta

SEQ ID NO: 227322 - DNA, 556 bp, Homo sapiens
tgagtgaaaatttaagaaggtaaagtatgttttcattgtctcatagcacttccactcatatggtttattaattgcaaagagaaaaagtggtaacttaacagtagagaaacccagcaggtcctcccttaatgagctgaacaaagttaacaacaccaggaaataggacaaatgggtgccaagtgtctcttgatgtgatacactgagaacacagcattgcttctgtagcattccggtccctggaggaaacatcagacaaacacagatggagggaccttcaaggactgacctgaactgttcttcggtgtcaaccccatgatagacaaaaagaggcagaggaactgttccagattaagggagactaaaaaggtgtgacagctggatcaggggaaacgtgccttaaagggcattattgggactgttggcgaaattttaagtgaactgtatattagacaattatcaaggactacacgattgtatggcatcaacctcaaattccccgaacttgagcactagagtcttcttgttctgatggaatatgttctgaatgggttttaag

SEQ ID NO: 227323 - DNA, 512 bp, Homo sapiens
aaaaattgccatagtgaattcacttccaactcagagtgtgatcttaaactcacggggattctcacttctttatgaaagtttggggttggatgacccctaaggctccttcttagcacttttattctttgcttccaaagtagaatcttcaactcagagagtgctgctgatgagtcgatagtactcattttgggctgggtgggggaggagagtgaaatgtctaggagaagtgggatgtgtcaaagccaggaagagagcctcctgctgtattcagcattaactacatactacgtgaaaaatctaatacggttttggtccccctaattttaaaaaagaatgtgaaaaaatcagtaactgctacctggagtgtgaagggaagtctggtggacagggtgagggaattatttatcatcctgctctttgaagtaagcaccatattaatgtcatgtattacctattaaaaatatataaaatgagaaatacatgaagatattagtgaagaaagaggggaaaaa

SEQ ID NO: 227324 - DNA, 667 bp, Homo sapiens
ccagccttcctccaagaaattgagatgcaataggtctgaaatgagagccaggaattcctaagccttgtccacaaagtggatatcacctggcagctggttagaattgcaggatcccagccccacaaagaccaactaaaatagaatcatctgcatcataaccgagtcccagtggtgtgtgtgcattgcagtatttgtgagacactgttggaatcaaagatgctgtaaagtgggtgcaactctgaggctgatttcaccaaagggggaaggagatgagaaatggtgtcagttggcgggtttctgaagcaaaccctacttctcactggatccacagctgcattggaagaaagattccttttaagaagtagttaatgggccgggcgcggtggctcatgcccgtaatcctagcactttgcgaggcctaggtaggtggatcacctgaggtcaggagttccagaccagcctggccaacatggcgaaacctcttctctactaaatacaaaaaattagctgggcgtgatggcatatgcctgtaatcccagctacttgggaggctgaggcagaagaatcacttgaacccgggaggcggaggttgcagtgagccgagattgcggcgccatcgcactccagcctgggcaacaagagcaaaactccatctcaggaaaaaaaa

SEQ ID NO: 227325 - DNA, 982 bp, Homo sapiens
agctgatgttccagtttgatggccgtgcagctggagactctgctgggagctgatgttgcaatttgagggccattgcagctggagacctggcgggaagctgatgttccagtttgagggccgtgcagctggtgacctggcggggagctgatgttccagtttgagggccgtgcacctggagacccggcggggagctgatgttccagtttgagggccgtgcagctggagacccagcggggagctgatgttccagttcgagggccatgaagctggacacccggggggaaactgatgttgcagtttgagggccatgcagctggatacctggctgggagctgatgttccagtttgagggccgtgcatctggagacctggcggggagctgatgttccagtttgagggccgtgcagctggagaccctggctgggagctgatgtttgagggccgtgcatctggagaaccggtggggagccagtgttgccggttgagggtcgtggagctggagacccgggtgggtaggagctaatgttccaggttgaggtccgtgctgctggagacccagcagggagctgatgttgcagtttgaggtggtgcagctggagacccaggggggaactgatgttgcaatttgagggccgtgcagctggagaccctgtggggagctgatgttcctgtttgagggcctaggagctgatgttccagtttaaggccatgcagctggagacccggtggggagccagtgttccagtttgagggctgtgcatctggagacccagtggggagctaatgttgcaggttgagggccgtggagctggagacctgggcggggagctgatgttccagtttgaaggccgtgaagctggagacctggcggggagctaatgttgcagtttgagggccgtggagctggagacccgggggggagctgatgttgcagtttgagggccatgcagctggatacctggctgggagctgatattgcagt

SEQ ID NO: 227326 - DNA, 371 bp, Homo sapiens
taaatactatttaatcttggggaaaaatgtctgtcaaaatttacttgatttgtcctctgaggatatttaaatgatctaccactggtctaagtaaatctaaaaatggggtacatgcagatcaatttatttttttttaaaaaatcttttaaaatttcatttggggttacattttaaacttatcattaaatatacacatattgttataaatagaagttatagtagttcagctttgaaaacactagtgcaggccaggcgctgtggctcacgcctgtaatcccagcgctttgggaggccgaggcgggcgatcacgaggtcaggagatcgagaccatcctggctaagacggtgaaaccccgtctctactaaaaatcc

SEQ ID NO: 227327 - DNA, 330 bp, Homo sapiens
gggaagtgctgcgtagagaagggcgtggtccctgcttagggctccacccccacgaacactaggtgaggacaggcatttcctgcccaaatgttgcatttcccaagaccaccctggcctgccatgcctccatcctatgcctataaaaacccaagaccctagcaaggcagagacagaagcctctgtgtggggagaggaacacactggtggaagaagacaagctgctggacatcccgagaatgttgcctgactccaggggaaaaccatctcccctctggctcccccatctgctgagagctacttccactcaataaaaccttgcactcattctcc

SEQ ID NO: 227328 - DNA, 559 bp, Homo sapiens
actcaaagttatctttcatatgtgaaggtagtagagagacattttcagatatgaaaacacttataccacaggcacacttcccatatttttaaaaagaaattttaaaaatttcttgatgaggtcagttcagctgactgatagatgaattaaaattagcaattaaaaatgaagaattaaaaaggcattggaaacaattagacgtagtgaaatctaaatcattattgtcaattttattgtcaaactaaaggtagaagtgtccatttagttttgatagaatttaacagcaccatggatctgcagcttcaggttatattaatgcctgaaataggtggagaggcaggagcatataggagatcctaaataatagtttttcttcaagaagatttaaaaaataccaacttctggtgagagtgatatttcgtattccattgccttcacttactatcagtgtactgttaactcctcaaacatctgtctctgctgagaaaagtctcctaagttctagacccactggccaagtggatagctctcttgggatggcccattagcagctccattt

SEQ ID NO: 227329 - DNA, 404 bp, Homo sapiens
atggcatcagcctgtgctgctctccgctggcaagggtgggctcagcccctctggtcagcctgacctgagcacctcagcgctccccactggccgctgccctgcaatggaagagggcagggatgggctgccactctgcattaggggaagagggacctttcaattgggcccatcacaaggaatgagggagaaggctcagcctggaccacacacacccaaagggccttgaggtttaactctctccaaaggagacagacgagtttgaaaggagccctcatcatccaatttcaaacttgggtcccatttctggaccacactgcctgaagcatgccatgaactaaggttcttcttttataaacactgtaattaccttgggaatggcacaattatatttctgtgtgtccgtt

SEQ ID NO: 227330 - DNA, 377 bp, Homo sapiens
atagactaaacaaaaatcttgagagaaagtactgggaatgagatgctttggggaatatgggctttgaaaagcttcaacatatttctgagaatttgcaaactgtgtatgtcaaggctgtgtgcatgttcagtaaaaacctgggaaatttctaccttccctgcacaagcagaaagtgtaggccaaggcagagttgtaaactgtctggctgagtgttgaaagcagggcccaacacatacacaaagcccctctgcaagttccaaacacatatggaaatctttgtcaaattattagctgacttctaagctaatggaaaaaatattttaatcgacataggtgacaaaaaatagagaccacaaagtttattcagaaaagatact

SEQ ID NO: 227331 - DNA, 481 bp, Homo sapiens
aagaagaaactcaggcagctgatctccacacagaagtgagaggcaggccttcttgtcagctccagacgagagggtaccttctttagccacacttgctgagaggtctggggcatctgtttagaagcaggaagggagtgccttgttcatgttcaggaatgctggagagtttgcacgtactggcagatcaccccatggccaggtggaagatagggaagccagtggttggttacacaggcgaagtgggctctgaccagctctggtggagttccctgcatcactgccctcagggagcccaacatctctccccctcctcacacctggagagagttctgcaaaccctacagaaaccccgcctctctaggtagaggaagaaaatcttaagaactgcacgatgattggaacctcacctccagagctgggaagacaacagtcctttaagacagtggtttctaaggaacacactgttgaaagatatgctacc

SEQ ID NO: 227332 - DNA, 449 bp, Homo sapiens
gaagcccaagatcatctaagatggaccaagaagtttatccttcaccagtcagactgacatatcaaaattagatgtacgcatatagcagcaacccagaggcattgacaacagggtggggagaaaaatcaaaggcgagaccttgatccccaacattggttgtgggagcaaaaagaagcaaaacacatgctccccagtggcttccaaaaattcctgttccacgatgtcaaagagctggaagtgctgctgatgtgcaacaaatcttactgtgctgagattgctcaacatgcttctccaagaacggttaaagccactgtggagagagtaacccgacagcccagcagagtcactagtcccaatgccaggctgcacagcaagaaaaattaatagacagctcatgtacacattttatttgtgttaaataaaaccataaatactctgtcatctggcat

SEQ ID NO: 227333 - DNA, 485 bp, Homo sapiens
agccaaactcccttcattccaacttccaccaaaaccacttctctggatccatccctggagttgacacaacagggatcttcagccccaggtgccaggtttctcagtgatccattacacagatttaacagggaaatgggggcagtatcaaaaacacccagtataaaccattgaattaccccagcccttgtctctgcccatgaacaactgcctggggccagagaattaggcatccctgctcttctttccctcagaaagcccttgagacgttctccttgaagctcccctaggtgggagtagaagttcatctcctgacactccacgttttattcatgagtcctgagttatgacacagaggacacagttgtgctccccttactatggactagcagataaagcaccttaaccactcagccaccatgcaaacccttcttatatttgattcaatatacttttccgcaagcaaaataaaagttctgaccaaggag

SEQ ID NO: 227334 - DNA, 442 bp, Homo sapiens
gagtcttgctcagtagtctgcactgctccgattcggaggacaggtgtgaagttcctgtttgtgttcgtggacttgcgctcttctgacccttattctttaactaaagtgctcatttgatctctgcaaaccttgacccacctgtggtggccgttgccccagaattgctgagttgactgtcatcatcctgtggcttattggttctcattcacatgcaagggaagggactgtggctctttaatgcttaaagcacgttttgctgggatttgtccattgtcccaaggactctcaaatgtactgaacacctcccaacccagatctttggcccttctaggtgactgtcacagggaaggagcaacattaaagtaatcataaaataatataattgtatacttgtaatttccagagagacttgcaatttataaataaatatataatttaataa

SEQ ID NO: 227335 - DNA, 465 bp, Homo sapiens
tagtcattgatacttgtgtgtcttttaaaaattttagctgtcctagtgggtgtgaagtggtttttttcctgtggttttgattgcatttccctgaggactaatgatgttaaacatctttttatgtgcctatggcaatttgcataccttctttggagaaagtctattcaaatcctttgttcaattttaaactggaaattttatctgtctgttgttgacttgtaagaattctttatgcttgctctaattgttttagatcttaatgttattaattttattttttccagggtcaattctgctcatgtttcattttatgttttaaaatttatttttctcctgtaatttgttctttttatatgtcaattctcatttatgtcatcctgttgtcttatatttatgccagggaattcattttttctgtaatttctatgagcaacaattgtgtggattaaaatacactttggggga

SEQ ID NO: 227336 - DNA, 792 bp, Homo sapiens
gaaatgctctgtatccaaatgccagctgagatcattagccacgctgaaattcgttgactcgtactgtgctaaggttgctgctagacgttgttaacagagttagtggtctttggttatggtggttagcagccccacttatctgttccatactaccagtgaatagtttaaaattcatgttgcacctataatttatcccacataaataattcaggctatttattttggcattcaattgatttttttctcactttaaaaaactgaggtatggagactggtgctagcaacacgggattggctaacgcatcctcttgctgttcccggtgtttgggccttgcctgtgacagtgggaaaaaaaatggccttgctgtgctacaaccggagctgcggtcagcgcttcgatcctgagaccaattccgacgatgcttgcacatatcacccaggcgttccagtctttcacgatgcattaaagggttggtcttgctgtaagagaagaacaactgatttttctgatttcttaagcattgtaggctgtacaaaaggtagacataatagtgagaagccacctgagccagtcaaacctgaggtcaagactactgagaagaaggaactatctgaattaaaaccaaaatttcaggaacacattcaagcccctaagacagtagacgcgataaaaagaccaagcccagatgaaccaatgacaaatttggaattaaaaatatctgcctccctaaaacaagcacttgataaacttaaactgtcatcagggaatgaagaaaataagaaaagaagaca

SEQ ID NO: 227337 - DNA, 340 bp, Homo sapiens
ctgttatgctgtccttttggaatataaatttacaaatgcattcttttgatgaattacttgactgacccagaacaagaatagggtttaccttattaaattgttatagtatagtccaaaggttgttctttttggtgaatgttcatgataggtgaccatggccaagtatataatgactattgtctttaaatgttggtttcaggttctgactttcactctgtggtatacactgtgagaatgcttaatagaaagaaaaagaaaaaatcatagtctcttctctagccagacagtactaggcatgatgatgtttgtggtagtgtgggtactgaaaactatcagaaaa

SEQ ID NO: 227338 - DNA, 359 bp, Homo sapiens
cagtgaatacatgaatctatacatgagtgtgttaaaactcataaaagtatataccaaaaagttttttacagctgggcgtggtggcttgcgcctgtaatcttagcactttgagaggcagaggcggatggtggatcacctgaggtcaggagtttgagaccagcctggccaacacggtgaaaccccatctctactaaaaatacaaaaattcgtcgggcatggtggcagccacctataatcccagctacttgggagggtgaggcaggagaatcgcttgaacacgggaggtgcagattacactgaactgagatcatgccattgcactttagcctgggcaacaagagcaaaactccatctcaaaa

SEQ ID NO: 227339 - DNA, 207 bp, Homo sapiens
tgactgtggacacccagagaggggcaggaccaggaatatgcacctggcctccacccaccagccccaacaaagtggccctggcctggggacctgtatcacaggatggacacctaccctggccctgcccctgccccaaggcttagctttcagtggagttgtgatggcaggtgtacctggagtctcaggtgtgactgaagcacactgatg

SEQ ID NO: 227340 - DNA, 110 bp, Homo sapiens
ggtcagaattgaaagaaagatgaatgacgctgattttctgttttctagtcaagttcagctaaatgggtagatgaggaaatagcagagttctgatgtaacttaggaaacat

SEQ ID NO: 227341 - DNA, 399 bp, Homo sapiens
aggaaggtgtgaaaatttgaaatgttatctattctcatttaatttcctactttccgtggagagtattccatacccagattaaatgtcatttccaattgttgctcacacttaccaaagggaaggtctctgctcagttttgagcagaggctccctgtgtaggagtatgacagtcctcagtaaagttttgtcacctatgtttggcaaaacatcctgggcagatgagcgattcatgtggcaagagcactgccaattgaaaaggtgcattagtatgaatattagcacctctaagtgtttgtgaaatagcaaaggtagaaggactagaatattgacaaagcattttcaaaaaattatactacttctaatagcttaacatgttgatagaaaagacgattcagtgta

SEQ ID NO: 227342 - DNA, 603 bp, Homo sapiens
aaaggagagagagcctaacttttagcatggaatcttaatggaaatatgattttgcagaaaggattgtatgtaaaaaaaaatctgtatttgaaaattgggagattaatctcaatttctgggttgtctgtcacacgtgacaaaaatttactgaagtaatagtgtgtgtgattgatataagttgtaatggagaaccacaaaagtgtatgagaagagcagaaaaatcgtctttcacagcagaggtgatatattggaaaatataaaatcaaaatattatagtttaaaaatagatggaaatgtaaaaagttaagtacttcatcatgctttatactaaatgcattggtactttatcattgatcaaggctcttgccaatgtttgagggtaagattgcagtcagtttgtgagtttttctcttgaatactatccctacagcaggaagttgctaaacagatctattattacctgagttcagggaagcaagcttaacggaagggtctgatgacacaacatcctcctttgtctgcagtataaaagggaaagaaagtcaactttgaactgccttaagctataagttattttgtagttggtaatggctttcctaactg

SEQ ID NO: 227343 - DNA, 926 bp, Homo sapiens
gtcgctcctccccacctcgggcaccctcacctccccccagcggcctccagggcgtcccgcgtttctctctccgagcgctcgcggtttcccgtcggtctctcccggtgcccgttgctcactcacactcttgggtctggttagtccagacctgcagcttgtctttgacttcccaagtgggaaacgtttgcagttccaaggcaagccaagagctaaggtttagaacaaagtctgccttggaccctttcagaagatgacaggattttttaaaaaaataattgcgcccccccgccccgtgccttggagatagtaagaattggagcagagcactgggacttcaattcacgcatggaaagagatctttgttagttggaggaaggagaacttgcctgagcttcgggcctttgttttgtttttgtgagagggacgtgtctcctaaatgaatgtttgctccagcgttgcacctcaaataagtcacctaaatatccacgccctctttatccaccccctctttactcgtgtgactagaatagttttcatttttcttctcaagggaatggctaaacagctcctatctgggcgtttgatagactgtcattcaagaatgagtgaagttgaggtgcctataagcaactcagaaattgttgtggccacgcttgggggaaatagagccctacactcaggtgatgagaggagacctcagaggtgaccgatccagggccttgctccctgcgccaccccagctcgtacctccagtggaacttggctgggcttatcaagagctcctttcattcattgcaacttcatttgttagaaagcttctctgtgtatttagtaggcattgtctccaacatgtaccactggtctggcttttgttaggcccattaatagtgtacatgtgacagcctttcaagtataggtgctccccg

SEQ ID NO: 227344 - DNA, 1138 bp, Homo sapiens
accaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccatatttgaaaacctcacattcggagcaggccactttatattcgtgagtgatcccaagctcactgaccaacagaaaagatgctaaaaaaatgtgtcctatcatgtgcctgctccaactgatgggtaatgtctgcctttaagccccagaatggattctccaggcacagtgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagaccatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttt

SEQ ID NO: 227345 - DNA, 946 bp, Homo sapiens
gagggcgggagaggcagatgagtaaatggatccttacactaagtgtgatgagcagaaacccaggcgctctggggcatgagcagggatacctaacccagccctgggggctcaatctctccccacccctgcaggagaggcttggggtgagttttgggaataaggaccatccagccacatgacgaaggggaaggaaaatccccatcaaggcaaaaacacagtccaaggctctgaggcccaaattccggggagaggggtgaaggttgtttgtcgcacctgggttaaagggtgggggtggagagtaggagaagaggctacacaggtgagaaggtgtcagatcacaaagggccttgtatgccaaactaagaagactgaacttgaccatgaagttaggcagaccctctggagagttttaaagcaaggagtcgtgtggatgaacaaacctgtgatgggctggggttaccaaggagggcttcctggaggaggtcagacttgagctgagggaaggataggatttggagagctgacattctgatgagcggcttcggttaaagctcacaaaaacccttccctcccccatgccctttgaaatcatttgaatcaaagattgcgtgtgttaaagacgtgtttgtctgttatctgaaagctgtggtttctctttaacagattcagggcctcatcctttgactcggaaccaggaaggaattaggagcgagtcctcctgcccagagagctaattactgaaattcagtggcctcaccagggcgagtggcgtcaccggcctgcatcccccaacagctcctaatttctaactggtcaaagttagacatttcagtacatttttatgggctgcccaaagccagctggaagctttttttccataaactctccctgagacaagtagccaggtttcacatattaaaatgaaaacgtcaaaagcgttaacagg

SEQ ID NO: 227346 - DNA, 344 bp, Homo sapiens
gtctgagacagagtctcactctgtcgcccaggctgcaatgcaatggccctaactcagctcactgcaacctctgcctctgggttcaagcgatttatcctgcctcagcctcccgagtagctggaattataggcacccgccatcatgcccagctaatttttgtagagatggggtttcataatgttggctggtctcgaactcctgacctcaggtgatccacccaccttggcctcccagagtgttgggattacaggcgtgagccaccacactgggcccctttgcccatttttgaattgtctttttgttgttgagttgtagaatctctatctctttctattcctttatat

SEQ ID NO: 227347 - DNA, 414 bp, Homo sapiens
tgtaaataaacggctgtggctatgtaccagtaaaactttgtttacaaaatacgtggtcaatctaaggattatagttcgatagcctctgctctaaaggttgtatttaaagaagcaacaaaaaacagattgagagacaggaagccataggtactatgaaaacaaatgtaaagaaagtacacaataaaacaatgttacataaatttataaattgagtgagagagatttagaatttgggttttctttattttagtcaagggagaaagggagatacagatattaattaactttaggtcttgttaagttgctaaaaatttatttgtgtaataaaaatacaaggataaccagtgaaaggatagaaatatcaagtataaattctaaactgtagtgagagaaatagactaagaaggatacacc

SEQ ID NO: 227348 - DNA, 245 bp, Homo sapiens
aagaagtagtaagggccatgcaaggccttgcaagccatcataagatgggagccttgaagagttttgagaagataaattggcctgaattacattttattgaagccattctggcttgggtgctgacaatagattttgggaggcaagagtagaacctgacggactagataggaggctattaggctaattcagttaagagatagtagtggcttggaccagggtaatggaggtagatgggaaagtgattg

SEQ ID NO: 227349 - DNA, 5434 bp, Homo sapiens
ttcgcctctctcatgatcccaggaagactaacaggctctttgtgacactggcactgcgctgtcggatccagctgttgtcattgtgaaggggtgttctcttcctcatttcctgaaggattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227350 - DNA, 4505 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227351 - DNA, 4782 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtttattaccttcctcggtgccataattttgactttatcttcaaataaaatccttcattaattgtgacatttctatgcaagtgttacatttttttgagagtacatgaagattactgtaacagaataatgtcctcatatcctaactaactttattttgctcaatttagctggttgaaattcttgttcagaaatcaagagtgcttatttaaaatgccttgatctaaaaacattggtcccaattaatttcttcatctggaagaaaaaaaggagttgtgataat

SEQ ID NO: 227352 - DNA, 5074 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgttaaaaaaaaaaaaaaaaaaaaaaaaaaaaaaaaaaaaaaaaaaaaaaaaaaaaaaaaagggggagccgaccgacacataaagaattatcccccaacagggagagcacccagataattaagcagcacacacaccgaagatgtttagtagacaaaaaaggggggccccacaaaaagggaacggcaccgataatatcaacacggccgaggagcggggccagccgccgtttaaacaacgactcagacgaggtggaaaaacaaacgttgtacagcggaggacaactttgtttgggagagagaacaccacataacattttcggggggggtgaaaacattattggggaaccacctcccctccagagaatatttacgagctccagcagaggacaagtaataaaattttacgacgggtaaaacggtggtgaaacacccagtcagatattgcgcgcggtcaaagaaatttgtcacccacaggatcattactttacagaaattttacccggccgggataaatcatcatagctatatatacattaatataactgcctactaacaatcacgagttgatatata

SEQ ID NO: 227353 - DNA, 5288 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgacacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227354 - DNA, 5280 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227355 - DNA, 4365 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacataagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227356 - DNA, 4166 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagttacctaaatggctgtttaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgtttggggatgtattatggagctaaaactctaacctcttaatagtttaatagaacttaaaaatttttaatacaattacccaattggtgatatgatcttaagcttttgtgtcagattatttagtatgatgacttcatgcttaattatgcctgattatggatgacgtattactgtggtg

SEQ ID NO: 227357 - DNA, 1637 bp, Homo sapiens
caaagtccaggttagcacaggtttttggtctcatttaagatttggttctggaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227358 - DNA, 1523 bp, Homo sapiens
gggcaggaagttggagaaacagaaggcaccgagacagaatgtgcaggcagacacaggaaaggagacactgaacgggtcaaaagcacgtctgaaaggaccctggccaagaactaccccaaatggctaaaagacaccagggaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227359 - DNA, 956 bp, Homo sapiens
gagcggccgcccgggcaggtacgcgggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 227360 - DNA, 1239 bp, Homo sapiens
cacagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttggtaattatttttttctttagttaataaaatctaattttgtgattatgattttctagaaagtaattttgaagtaaaaagagataggaatatgttggtaccagtttgggactagatcttactatcttt

SEQ ID NO: 227361 - DNA, 435 bp, Homo sapiens
gtaattctgctttcattcctgtcattttagtgttctgttgttgaccactggctttttatttttagtggtgaatttgaggggaaatggaatgggttcagattattagagtgttctttcagtcttaattttttgttttaaatgagtagtcttttgcattttagggaaataacatttcaggaccttttctttatgataaaaacttttagactaattttactgatttaaaatggaatctaatggacatcttaatattttttgcagattaatgcgctaatgcacgcattgactgacttaagaaagaagaatcccaacataaaaagtttggttgtttctcagtttacaacattcctgtctttaatagaaataccacttaagtaagttccacagtgtttttcactttcagtaaaaggattttatataatcatattgatttgg

SEQ ID NO: 227362 - DNA, 499 bp, Homo sapiens
atcaagagttcaggattaaatgtagaattgtagaatagcagtcattcaataaaatgacacttctcagagatacttgtagtattttatagtgtaaatcatttaataattccctaataatgcagtgggggaaagcattttctaactaaatgaaatactcatttttcattaatatacagtacacttttgtgaccttgaatgatatttgatattcgattacttgattttaaaatgggaacgtttttctggtgaactgggtttcacaatctgaccatttatctttttaaaacatttttaagggtaaaactcttacggccattgcagtaatccttaccaacttccatgatggcagacctcttcctattgaaagagttaaaaagaatctactgaagaaggtaaagtagtagtaagtgcgctttatgtgaaacctccagtttattgtgaaatctttaaatttcatcattaaaaaaaactaccaagaaattgtgttttcagaaatgcg

SEQ ID NO: 227363 - DNA, 398 bp, Homo sapiens
caccgtgttggtcgggctgatcttgaagtcctggtctcaggtgatccacctgtcttggcctcccaaagtgctgggattacaggtatgagccactgcttcctgctgatgttataattttaaagaacatcagtgtatttgcagtcactgaccgaaatattgtgtggtgcatgactgtacttgggttaaagtacctagtttagttattaagtatgttgtattaattttatgttccctcctgttatcaaaaggttatttatgaacattaataactgctaactagttaacactggggtgtcaggatctcctcaaaaagaatagtaatctgacttcgaactctaagaagaatctatctttctctttgtgcatgcccaaaataaatgacaaatacattcttatta

SEQ ID NO: 227364 - DNA, 536 bp, Homo sapiens
ggtaatttgttttagtgatggaaaactcatacagcagcagaagctttttgacacagatagtccagatgtttattatatgtttaaatctcagctttcatttttaaatttccaagcgctgtttctcatacaaagaagtttctttgtttcaaatcatactagtcttgtttagtgtataaaataagagtcagatggaaatggcatactacttttaatttgctttgaagaaagtaactctcatcttaggattcaacattgagggtggaaaaaagagggaaggaagagggaaagaagaaaaacaaaagtaaagaccagttgtttgtataaatgcccctcaatttggatctttatgatgttttacaattagtcctaattgtatcacattacgaggtgtacaatatcagtttgttccattattggtgatgttggctatggtggcatccttcaaattttaatatgataaagttactatctttaactctttgtaattgataagtaatttatgagacagtaaagattttcttttctattcatccact

SEQ ID NO: 227365 - DNA, 418 bp, Homo sapiens
gctactgcctacaagaagaagtgtgtcaaggatatttcatccccattttcaagaatttttgcctataggactcccaggagcacaggagcccactacaaggaaggttatacaaagaagtctctctgtgataagagcaacagctgcaaagatggcggctcactacctccatagtgtggtcggttcatgcaaccccagacgctaaccgagagtgcctgcctttcccatgggaaggatgtgaagacggtcccaggaggcacgccctctacatttccgggagtcaggctttcagaggggactggaagaacgtttttcacagtttggcaaaagattgtcttaagcactgttgattgattgtctctgcccccatcaatgttgtgattatccaagagatataataaagggctctctttatcacagt

SEQ ID NO: 227366 - DNA, 791 bp, Homo sapiens
gcagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtgactgaccttgatgatgaagttggatctccagcagaagagtttaaagcgtttgcagcagacacagggatgaacaggagccaatcagagtactgcaatgtgggcaccaagacatatctgaccaatcacccggctaaaaagttcgtttttgacttcatgcgggtcttaatcatagacaacctctgtctcactcctgccagcaagcaaactccactaattgatcttttgttggaggtaaagaaaaagaaacgcatttacatctcttttgcattactttttaaattagaacattagtaaccaaacaagttctataacaaggatttctaattcctcttgtttatgtgtaggcagaacatgttataggctgtggaaagttcttaatcccacatgtgctttaaaccctatcagtttgttcttttccttccctcaaggatgtctctaattcagtcctttatcatcctttctctaagag

SEQ ID NO: 227367 - DNA, 519 bp, Homo sapiens
gtcagagtctaatgtgattaccgtatctttccacttgattttactaggtgactgaccttgatgatgaagttggatctccagcagaagagtttaaagcgtttgcagcagacacagggatgaacaggagccaatcagagtactgcaatgtgggcaccaagacatatctgaccaatcacccggctaaaaagttcgtttttgacttcatgcgggtcttaatcatagacaacctctgtctcactcctgccagcaagcaaactccactaattgatcttttgttggaggtaaagaaaaagaaacgcatttacatctcttttgcattactttttaaattagaacattagtaaccaaacaagttctataacaaggatttctaattcctcttgtttatgtgtaggcagaacatgttataggctgtggaaagttcttaatcccacatgtgctttaaaccctatcagtttgttcttttccttccctcaaggatgtctctaattcagtcctttatcatcctttctctaagag

SEQ ID NO: 227368 - DNA, 474 bp, Homo sapiens
ctgcagagtcccatacgtctccttaaatagctaagaaacttgccatattcatccattttgcattgctacgaaggaatacctgaggctgggtacttcataaacaaagtttatttggctcacgttctgcagtctatacaagaagcatggcacccgcatctgcttctggtgaggccctcggggagcttttactcatggcagaaggcaaggggagctggcgtgccacatggcaagagggggcaagagggggaaaaggggaggtcccagcctctttaacaaccagatctcccacgaactcattaccatagggtgggcacaaaggcattcctgaaggatccacccccatgacccaaacaccacccactaggcccacctccaacattagggatcacatctcaacatgaaattggaagaggacaaacttctaaactgtatcattgtcctaacacaaagaaccagtcagatcatcaaaatcac

SEQ ID NO: 227369 - DNA, 1358 bp, Homo sapiens
ggcggtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaaaaaaaaaaaaaaaaagaaaaaaaagaaaaaaaaaaaaaaagaaaaaaaaaaaaagaaaaaagagagggggcggcgcgcacaaaaaatctaccccggagggggcggcacacaaggcagcgagcacccgccgatttttagtaacaaaagggcgccgccccacaaaagggggacgcctactatacaacggcaccgaagaggggcggcagcgctcgatattacaccacgcaggctgcgggaggaggaggagaagcaccacgccgccatcgtggagatatctttggcagaagaggagcagaccacccacatcgggggagggggcggaagacgaccacaggcggggagaacaaaccgccccaccgaaagcggagatattatattacgccccgcccgcgggggggagactaactataagcacttcgagcgagggtgatttaggtggtggtcctacaccccacccgcgctcttatagttgccgcccggcgtgaagaaaaatcattgctggcaccgcgggagtgataatgcgcgcaaaaattttaccccgggg

SEQ ID NO: 227370 - DNA, 1463 bp, Homo sapiens
ctcactagtatgtaagaagataacactttggaaagcttaaggattttaggagctgtgtgcttattatatcacaatattatattcccacatagagaactgccgtgtccctagatttatcatgggctgcttctaatttctccatgtaggactttccgataggatttattcctaattatctctgactttatagccctagtccctgtagttttcagccctctattctacgtttttgtgggcgaaagattacctaggtgccgaggcaagagactgaaggcacaaactgtttcagtataataaagaaaatagttaaaataagaatagttataatacaaattagatatagagatgatcatggacaattatcaatcattattataaacattaatcattagcttttaatattactctttgttgctttactaatataacctaggaataaccggtgggtatagggtcaggtgttgacgggatattgtgagaagtgacctagaaggcaagaggtgagccttctgtcacgcccacataagggccgcttgagggctctttggtcaagtggtaacgccagtgtctgtgaaggcacctgttacttagcagaccgcgaaagggagtctcctttccttggaggagtcagggaacactctgctccaccagcttcttgtggaaggctggatattatctaggcctgcccgcagtcatctggaggcctaaacccctccctgtggtgctgtgcttcagtggtcactctccttgtccactttcatgttcctcccgtactcctggttcctctttgaagttcgtagtagatagcagtagaagaaatagtgaaagtcttaaagtatttgatctttcttataagtgcatagaagaaaacgctgacatatgctgccttctctatctctgcggtggctacctaaaagggaagggccccctgtcccatgatcatgtgacttgcttcaccttatcacttagaagattcatcctccttaccctgcgccccctcgtcttgtatgcaataaatatcagcacgcccagtcgtttgaggccactgccggtctccgcgtcttggtggtagtggtcccccgggcccagctattgtctctttatctctttgtcttgtgtctttatttattacaatctcttgtctctgcacacagggagaacacctgctaagccccgtaggactggaccctacacgttttcctctgtttgaaggcagtccaatgtactgtctacattcatttcagttcagttcaatatatatttacatcagattactgagcactattatgtcttaatgatgggtaaacaattatgaatgcaataccatggactttacaatgtggttggggacacacatacttaaacatgattttcaagttgtgggtgagaactaaggtggtggtatacatagggaatggccagtcactgaacaaacttctgtattaaaggcagttataagatac

SEQ ID NO: 227371 - DNA, 1505 bp, Homo sapiens
ctcactagtatgtaagaagataacactttggaaagcttaaggattttaggagctgtgtgcttattatatcacaatattatattcccacatagagaactgccgtgtccctagatttatcatgggctgcttctaatttctccatgtaggactttccgataggatttattcctaattatctctgactttatagccctagtccctgtagttttcagccctctattctacgtttttgtgggcgaaagattacctaggtgccgaggcaagagactgaaggcacaaactgtttcagtataataaagaaaatagttaaaataagaatagttataatacaaattagatatagagatgatcatggacaattatcaatcattattataaacattaatcattagcttttaatattactctttgttgctttactaatataacctaggaataaccggtgggtatagggtcaggtgttgacgggatattgtgagaagtgacctagaaggcaagaggtgagccttctgtcacgcccacataagggccgcttgagggctctttggtcaagtggtaacgccagtgtctgtgaaggcacctgttacttagcagaccgcgaaagggagtctcctttccttggaggagtcagggaacactctgctccaccagcttcttgtggaaggctggatattatctaggcctgcccgcagtcatctggaggcctaaacccctccctgtggtgctgtgcttcagtggtcactctccttgtccactttcatgttcctcccgtactcctggttcctctttgaagttcgtagtagatagcagtagaagaaatagtgaaagtcttaaagtatttgatctttcttataagtgcatagaagaaaacgctgacatatgctgccttctctatctctgcggtggctacctaaaagggaagggccccctgtcccatgatcatgtgacttgcttcaccttatcacttagaagattcatcctccttaccctgcgccccctcgtcttgtatgcaataaatatcagcacgcccagtcgtttgaggccactgccggtctccgcgtcttggtggtagtggtcccccgggcccagctattgtctctttatctctttgtcttgtgtctttatttattacaatctcttgtctctgcacacagggagaacacctgctaagccccgtaggactggaccctacacgttttcctctgtttgaaggcagtccaatgtactgtctacattcatttcagttcagttcaatatatatttacatcagattactgagcactattatgtcttaatgatgggtaaacaattatgaatgcaataccatggactttacaatgtggttggggacacacatacttaaacatgattttcaagttgtgggtgagaactaaggtggtggtatacatagggaatggccagtcactgaacaaacttctgtattaaaggcagttataagatacgtcgacgcggccgcgaatttagtagtagtagtaggcggccgc

SEQ ID NO: 227372 - DNA, 465 bp, Homo sapiens
aggggcttcaactaaccacacccattccctggcgcccaaccacatatgtgactaaaataatacgtgaggtttttgtgttttgtttttatttttgcctatatcaaacagacatttaggtgaatacattttggaaatatcctagtttatattaatacttttccattactatggttcagttttttggtaagcagctctgtccaggattagctctttttttttttttttaatcaaatgggaccagctaatgaaaataaaccttgataaccagaggaaaaaaaatacacaaaggatttaacattattatcctgctttcttggtccatgagacaaagtaactgaaatctctcttttagatcgtattattaacaatcagctatcgattttcaggtttacattgttttgggtcatttgttatatttctctccagaaaactgcttgatggtaataaagaaaatattctataaaa

SEQ ID NO: 227373 - DNA, 189 bp, Homo sapiens
aatttgctttatagatgtactcgcaaaattatgtcaagattatgtaccagagttttttgcagcacaattttaaacaagaaaaacaaccttaattctgtcaatgaaataccatgccggccgcgcacagtggctcacgcctgcaatctcagcactttgggaggccgaggcaaatggatcagctaaggtcag

SEQ ID NO: 227374 - DNA, 446 bp, Homo sapiens
gtatgtttcccaaactctgtgccatggaacactggcttccagtgacccaggagctccctgagagcagggaccatggccacctcactcagcagagatgcctaaggcctgacacatacagtaggtcctgtccttccctgaagcctccccacatcataggtgctggagaagcatttgctgaatgaatgaacatggagtgactctgactggtgctgcatgatgaaacactcctgtgtcagaaacacttgggaaatgcccagttaggcaaacgcgacgccttaagaagtcttgtgttaacacggattgtgaacctctcagagaaggatacgattttcggggtcccctaaactgaccccccaactcctctacttctaagcaggtggcccacagaacacactcagagagtccctgtaatgcatcctctcgtttcccccaaaacacacgcccag

SEQ ID NO: 227375 - DNA, 446 bp, Homo sapiens
gagaaaaggagaaaataaatacacgacctgatcattatgatcatggaaacattgccacaatgatgagccaatactgctttaatatatttccagagggcttaaatagcctgttccatctagttctatgaagaaatcagtatcctcagaaagaaagtgctactgatcacatgatcagagaaagaggttgccaagtatttagacattctgatttagccttctgattttagagatgagacaactaaagcagagtaaatgattattcagttataaactttgattagcattgatatttttcctactctttacttcatctcataatatctatatctatatttaggatcacatacacttgaatctctatatccatgggttccgtatacatgaattcaactggattgaaaatatttcagtaaaaaaatggatggctgcacctgtactgaacatta

SEQ ID NO: 227376 - DNA, 257 bp, Homo sapiens
ccaggtacagaggaaggctgtagagagaggtgaaaagaaggggaatgagtctcttctcctacgtgttcctgaatgctagtggctgggtttaaatcactccagccaggagattagaaaattattctctggagcaatggaaccatccacaggaagatgtatatagtctaaccattgggagtgcccagaaaaaaaatctgtttagccactcacttgtgtccccgccagtgaagccagttgtggcaaggcatgcacacaga

SEQ ID NO: 227377 - DNA, 1504 bp, Homo sapiens
ggcaaaacaaaacaaaacaaaaacaaaaacaccatgttatttggggcccaaaactccccaaacctggggaagaaaatgggtattcagactcaaggaagccaatgaatcctaatgaggatagaccaaaataagtccatattcagacatgttatgttcaaattgttgaaaaccaaggagaagaaagcagccaagacgcaagctactcatcacatacaagggagtccccaaaatactttacaaagcaggagagagtgaaataacatattcaaagtactgaaagaaaacaactgccaaccaagaatactgtgtgtgtgtgtggtaggggggaggggggagcagtacatcgtactattaaaaatggtatacaattttttatttctggaattttccatttaatattttcagaccatagttgactaggtgttactgaaactgtggaaagcaaaaccatggataaaggggactactacatatccagaaaaaccatccttcaaaaatgaataaagattttttcagaataaaagccaagggagttaatcatcactagaactgcctcacaagaaatgctaaagtgactccaagttaaatgaaaggatgctacctagcaatgcaaaagcatatgaaaatataaagcttgctgataaaggtaaatatatagacaaaatcagaatactgtaacactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaactgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattg

SEQ ID NO: 227378 - DNA, 534 bp, Homo sapiens
cattgtcactcctattttatacaaactaaggcacataagttaaaataacttgccctacctcagttgtctggcccatagtctaaatgcttttcaaaaattattattattattattattagtatttttagagacagggtctcactctgttacccaggctggagtgcagtggcacaatcataactcactgcagcctcaaactcctgggctcaagcgatcttcctgcgttggcctcccctgtagtcccagctactcgggaggctgaggcaggagaatggtgtgaacccaggaggcggagcttgcacatcacgccaccgcactccagcctgggcgacagagcgagactccgtctcaagacaaaaaaaagaaaaatgaccaaatttaaaagatatcctttaggccttggctgaacacaggatctctttaaaaagaaaaaaaagataccattttaggctaagtgcgttaaaattcctacagtcagatttacaatattaaagagatggaaatcacataccaaggggacaaaattaactttag

SEQ ID NO: 227379 - DNA, 1437 bp, Homo sapiens
gaatgagaccctcttgtgtttttagttataattgttttaatattttgagattatacatttttgttttaatgataaaatatttcaagcattcagagaatataaacacccatgtaaatatcacccacagattaaacagatacgaaaattttgcttgtttttcaggtttttattcaaaaatatttcagaaacagttgaaacatcctcgtgtataccgttccccactcttctttcccagacatatctaaatatcctgaagctgatgtgcatcttccctttcttggttttagatgttcatttcatttgtatccataaatgatacatagtagtgcttattatgtgtttataatttacataaatattacctgtatccttctgtaatttttttcattcagaagtctgcttttcaggtttattcctacagatatgtgttcatttagttcattcattataactgtggcatataccacaactacttatccattctcctgcagttggatatttaggttgtttccaatttttcattattatcagtgctgaaattaatatcctaatatctatttttgcaaatgtacagagtttgtttggcatgtatacttagtggaattactgagttgtatgttatatgcattttcaagtttaactggatcttgccaaattgttttccacagtggttggaccaattttcactcccccagcagtgtgtgtgagttccccatttccccacatcctcacctcacagtcacacattaacttttgccagcttgatgggtattaagtgtcatttttgtattacatctgttttctagtgttattcagcatctttttgtatgtttattgaccattgatgatttgcctgtttgtgtcctttgttgttctattgaatcatttttcttatagctttttgtgttcattatatactctagatactaattctttgctagctatatgcattgcaaatattttctcccagtctgtggcttattttaaaattttatttgtggtgtctttttgtcttgcaaaagttttgattttaaaatagtcagatttatcagtctttttctttatgacttctgctttttatgtctttttaaaacagttcttctctatgcagagattataaagattttcttctatattttcttctaaaagtttttaaattttgcttttacttgtttaggaccttaatcaaactgatatatattgttatgtataatgggaaatgggcttctaatgtctttttcccatgtgaacaagtgaccctgctatatttccccccatcgatttgtaatggctatttctgctttatatgcatggatctgtttggatactctcaattcttttccattgttcttttggtttttcctgcattggcagtaaattgtcttaattacaattactttcactctaaaataattcctgatacctggtatggtgagc

SEQ ID NO: 227380 - DNA, 392 bp, Homo sapiens
aaatatagaaattagaattttagagagtttatggtaagtgaaccatattaaattattattttttaagacagagcctcactgtcacccaggctggagtacagtgtcacaatctgggctcactgcaacctacatcttccaggttcaagcagttctgcctcagcctcccaaatagcggggattgtaggcgcccgccatcatgcctggctaatttttgtgtttttgtagaggcggagtttcgccatgttggccaggctggtctcaaaactcctcgtgatccgccagcctcggcctcccagggtgctgggattacaggcgtgagccaccgcgcccagcaaagaaaactaatttgtatgaaagaataaaagagcccaaatagtcaaggcaacgtcaga

SEQ ID NO: 227381 - DNA, 354 bp, Homo sapiens
tgaacgaggaagtgaggtggggaggaaacactttatctatagcataaaggcctgggagttaggcaagggtatctgaatgaggggaaaatgtttgggaaaatgtttggaaaaagctgttccatgcagggcagccctatgtgcattggcttggagatgtgaatggctcaggctgagggaatgggcaggtggagggaatgtggctaagggtaggcatgtgaggctaagatatctgtggggccacaatggcgagcagatcaggctggatagtacttgagcattagattgtggaaggcctgcggaccatgcttaggagtcaggactctattctgtatccagcagagatttccttttatg

SEQ ID NO: 227382 - DNA, 456 bp, Homo sapiens
gtgattaagtgttatgtaagaggcatgtacatagtatccattggttttaatgctattgggcagagtagaaacaggagtagtaacttggtttccttttattacattccttattgggtacttttggcgacagagtgagaaccttaaagttcaattaataattgatgtaataactgaagagaaaaattaatgaacaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaattttcctgacttgaagacaaatacttgagtatttaagttattgcttaaaagaaaaaaaaaat

SEQ ID NO: 227383 - DNA, 598 bp, Homo sapiens
gtagtgcacgcctgtagtcccagctacttgggaggttgaggtgggaggatcacctgagcccaggaagtcaaggctgcagtgagccatgatcatgccactgcactccagcctgagtgacagagcaagaccccctcaatagatagagaaaaagtattgtacacaaattacttgtgaagtatgaaagagaagggtacatttttaatgaggaaatctgaagtacacttccttcaccaagtgatcaaactttagcaccaataataatggtacaaaatgctaatatgtacccctggatgtgatacaatgggaaaggcacattatacctatgtagtatttctaccaaaatgcttaatctgaatttaatcatgagaaagtagtcagataaatctaggctgttagacccattctataagacatctggcccgtattctaaaacacacacacccacagacacagattgaaagagagaatgcacaagagcccagatatggcacaattttatcaattattcaattggtgaatctaggtgaatggttgttcattctatcattttttcaacttttctgtaagtttgaaatttttaaaaataaaatctttagag

SEQ ID NO: 227384 - DNA, 1692 bp, Homo sapiens
gaggtgggaagggttgtgtgtgcaggtggtgggtagtgcccctgccacacgtacagatccagggcatctcctctggacccctcccagggactgtaaaactttactatgggaacagactcagtagtattttggggcagcgggaatggttctttactaatgcctaagatcacttaacagggcagaagccataattgggcagaccttacgggccaagaatcttttgcactttatctgatttaatctgcaccctgtgaggtaggtggcattacccgctttcatgtgttaggaaatgtgtgtaaagatcagtaacttgcccagggtcacccaactagtagctaaagtggctaaagtcccaggtctgtcactctaaccacccagagtggccttaccctgtacattctcaccctgtacattctcacccttaccctgtacattctcaccctgctgcccctctgaaatagtcactgctggcttccctagctgaggacactgggcacaaaggctgggcttctggattgcaagtctgtgcttgcagcctgaggcccactctaagggaaggcagatggcctgcctctcctttctgcaaaaccccctgccacctgctgcgtgctgccagcctgactcactgactccagctacctctgggcctctggcccttctaggatgggcttgttttccaggaaagggtttggagattaagataagccagctgcctccagtgaaaggccctgctgccttggaaagggccgggaaggctgccattccagctccttggtttgctcgcttctctccgtggctggggctgcctcgcctttcatccgtccctgcctatcgttgggcatgaataatgaggctctttggagacaggcataggactccctgcagagcgagggatttgtaaaatgggtgcccaagctccctctggggctccggctccctcatgtctctgtctgttcttcctggggaagctgctgcttgtatttagataatgaagaactagaaaacagacctggcctcctttcaacctgccgcttcctccagcctgggtaggatccaaagctctggccttcctaagcagtgcttgttcctgacttacacatggatggttttctaaactaagttcattttctgaagcagagaatgaataactcactctactacctcctccccttcatggcaaaattttttcttttgtctgtattttcacggctgctggattctaaaatcaaggtgcaagttgctttggggcttactaaagtcccgtggccttcccaggccctgtggaaaggttagatgcaccccagataaccagggttggttattccctgtgagagagtcagaggggtgcaggctggaagcatagcgctcctccacccctgcgctggtcatcatgtggagcgtgtgctttctaagaagtgccagcctgtgtccagagcctgctgggcagatgttaagccagctgtggacttagtcacagtgactctgctaccaacaacagcaacatggacatttagggaggagcaaatgagaggaaggaagaaataggcaagataacaaggcttgacatctgatctctgggcatttccaatggagggatttggtttgtttatgtttccaccaccaagaattaacagtggttaacagctgttcatatctgtctgctttacatttttaaataaacattacagataa

SEQ ID NO: 227385 - DNA, 238 bp, Homo sapiens
tgacgaagccgaaaacagccatattcagaggccatgaccactcgccagaggagtaaaccagcaggccgtcagaagactctagcccacggctcggaagccatcctgaccactaagtctttgcagctgaggccccagacatcaaggaccagagacaagccatccttgccctgtccttggctacccagacccactgaatccacaagcctaataaaatggttgctatttttcaactaagaag

SEQ ID NO: 227386 - DNA, 434 bp, Homo sapiens
aggctgtttagtaagtttctgaacagaaattcatgtgaaatttccccttttaagaactgtttgttgcttttctctgatatctgattaactttgtgttgagatagcatttagacaaatattagtttaccttcatatcttttttataactgttttactttccaatttctctgtgagatgtgtctttaaaaccaagtttcactatgccttcttattttttcatcaagggttggtttctcatttgtatagtttctttcctagagaagtcccatttcattcatttctatccttattcttcttaaatcctgtgatggagaactcactgccttataagatatctcactgaaatctcagaaagttctaatcattcagagttttaaaattaattaattaattgatttttgcttctgttgagttaaaatctgcctcccagtagt

SEQ ID NO: 227387 - DNA, 597 bp, Homo sapiens
actgaatgtctgggcactccatgacccagtcaagttgaagcataaattagacatcatagttggagtcaacaataatccagacagcagacctccaccctctttgcctccacccctggcaactgggagcccatctccttttctacgttttgcacaggcagctcagctgtagggtctactctgctctgttggcggccttccttccagaggggaatgctgtcaggaacacagccctactgcagtaataaaaacacttcaacattcactgcctgagcctgtgtaaggaccgaatgagagagtgcgtgggaacacactgtgtatgctgttgagttctacagaggtgaaaggctgtcattattctactattttcctgtggattagcagcattcacattatctttatgttttctaggcagaaataaaaaaaatagcatatctgaaaagctaagctcctgtgaattcaaaagaaaggatggctgggattgcctgcatcaaagaaaagaatagcaactcgcatttctgtgctgctcttggcacacaagccactttctaatgtattatctcatgtgatctttacaaaatcttgtacaatggagtgtgc

SEQ ID NO: 227388 - DNA, 417 bp, Homo sapiens
agcatgctccatccacttcattcaccttttctctccatggtcacgagagatgaacttgctttatgcttaagtctagtcttcagtattactggggacttctggtccatttctcctttcagttggccagcagtttagagaatgaggagatttattcttttcagtttaaatctggaaaatactatataaatgtaagccctggtatgttctcatgaggaggcacttactgaggaagtgcataagcccaagggtcaagctgcctggactctagcatttcagttctgtcgtatgtcagttctatgaaactgggcaaattacttaactgcttttaaggtttcttcatctgaaagagggtaaaaatagggcagaaatacagtgttgttgtgagtataaaatgagataaatcatataaaacttacg

SEQ ID NO: 227389 - DNA, 615 bp, Homo sapiens
gagcctgcggggtggctcacgcctgtaatcccagagacgcaggagtctgaggcaggaggatgacttgagcccaggagttcaaggctgcagtgagccgtgatcgcgccaccgcactccagtctgggggacaaagcgagatcccatctctttaaaaaaaaaaaaaaaaaagtagagctccgctcccacttgccccccattctctctctctctctctttctctctctctctctctccctcttgctctactctcgcccgtctgcgttctacattggttctgcggccgtgtccctttcgtgtgtgtctgccctgtgtttctccgtcgtctccgtgtggatctcggtctttgtctcgccctctagctctctcgtgcgcctgtgtttaatcgtgcgcttctctcaatctctctgtccctccctttgccccctacacgcgtgttctcgtcaacagatctccagaggtggtacagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgc

SEQ ID NO: 227390 - DNA, 541 bp, Homo sapiens
tagctagtgtttattaagaatttaatacgagccaggcatttttctaagaacattacatagatgcacaaacacagttaattctcacaactttaggaggtttatcagtgaggaaatggaggaagagaaggggaaagtaactagaaaatagtggagagagggttgagacccaaggattctgattctggaggcagtgctataaatgaccatacaatataatttcccaggagtaatggtgtatgcataggtggtaaggaaaaagtcatttaaaactgcttctttggggtgattgctgaattttaaaatgtttaggcatttgtttaaattaaaggcttttaaatccccaaactttataagcaaggatgaaatgacaggtcataagatcaataggtcataagggtgtttatttagtagcaaatatatgttgaatcctttagctctctctcctcattttgcagaaatcctgaatgtttgttaaacagggtaagatttcttaaggtaacttaagaaatgtagaggatagaattaaccactggattttctg

SEQ ID NO: 227391 - DNA, 572 bp, Homo sapiens
taaattaattgtatagatgatggctgtaattcagtataaggagaaatctttttttgcacagggaattctgggactcttctaacaaaataagatcagatccaatctgtgttagtcttcgggcaaagaggagaaagaaaaagcatttctggcaggtggagtgaaatacaaatttgaggctgagtgaaaatacaaagttgaggaaatacaagtgtttagaagttaacaagtaaactggtttttgtataggctcaggaaggttagtagtttaaattggaatggcaggagaagccattccagattcctggagcactttaaatgccagactggtagactgtctcagccaggagtggcccagaagaaagcagggtttgtagcaatgaactgtggcctgtagtttccaaaccatgcatctgcatctgcttctgaatttaagtaacagtcattgtctgcttaatgccaatccattcttaatagtattctgggtctaattatatagctcatctgtcagctatagttctgactcatatcatgattttactgctctagaattgtttaaccatggaatatttgcc

SEQ ID NO: 227392 - DNA, 605 bp, Homo sapiens
aaaggaatctagaataaactaggattagctagcaaaagtgttttagcaagatataaggtaaaacgtgaaggatttagtccactgaaaaattagagaaatacaagttctggtacaggtgatggtagatgtgaagattttgctgggtaaacttgaggtcatgaaagaatgggttgggtgaagcatagagagcaggtaatggaaaaggagaaagagaacataaaatgaggtaaattccatcccactgattgattcagttggagaaaaatactacttcagtacttttactcttgttgatgcctgaaagaactagatattcctattaagctatcagtactaaaacctttaaacatccaaagtaaatgatcataccacccctcccagcattctattacaggagcaccttgttttattgcacattgctttgatgcactttgtaaatgctaggttttttgcacattgaaagtttttggcaaccctgcctcaagcaaatctgtcagtgccattttttgaatagcatgggcttatttcctgtctctgtcacattttgttaatttttaaacgatttcaaaccttttcattattattataatatctgttatagtgat

SEQ ID NO: 227393 - DNA, 513 bp, Homo sapiens
atttatggttaaatagatatagataacaaacagaatacgcctgtttaaaactgttaaaatgacattggttctaattatacttttatttaaattgaaagacaaggcatttatatggtatctctaaccatcacaacttttgtgtgacaaaaagaaattatcaccaaaatacacctccttaagtaagtgtctgatttcacacttccagaaaaagtgctctttctggtcaagccagcaagaattgagaaagattaagaaagtgcttcaaagatgtttattaaaaagttgtcataaaaatgtgaagtagatgtagcatcaagcataccaaataaagtaaaactgtcatcaagaagattcaacagctatgaaaagagttcttcaaaatatgatatgtttttctagatgataataaaatttatcaattccaaatgtccacattagtctttcataaagacaccaatgagtcacaggaaaaaaaattaaaaataaaaaaaccctatctcagggaatcatgct

SEQ ID NO: 227394 - DNA, 497 bp, Homo sapiens
gggcaggtgtttcgggcgttagcaggctccacctccgaccagcccatctccctcccatcttctgcctttccctggagaaacaaagcaaagcagggatcatgaggggctgtgaaggaggacagtggggattcggagagaagctcttgaagctgggcacatgtgggcgcttcggtgtgtttttctggggaggaggcaccaggtttcatcagattcccagaggggccatgaggcaagacaagccaggaaccacctagccagaggcgcaaaccccgaacagttctccatccgtgcggcttgcttgcctccagggatggggcgctcagccctcaggaggtggttgttccagcctgcaacgctcaggccttccctctggtgtcttctgttctgccccacccccactctgccccatcagctcccctgacacgtgaactcagacacgcggtttccagacttttcttattcattattctgctgtgaccatggggcttggcggccgc

SEQ ID NO: 227395 - DNA, 495 bp, Homo sapiens
agacaaagtctcactctgtcaccaggctggagtgcagtggcacgatctcagctcgctgcaacctccgcctcccgggttcaagcgattctcctgcctcagcctcccaagtagctgggactacaggcacatgacaccaaacccagctaattttttttttgtttgtgtaattttagtagagacggggtttcaccatgttggccaggatggtcttgatctcttgacctcgtgatccacccgcctcagcctcccaaaatgctgggattacaggcatgagccaccacgcccagcctcaggtgttatctttatagcagtgtgataacagactaatagagtaaattggtaccaacgtagtgggacatttttataagctacctgagaatgtggaagtgactttggaactgggtaatgggcagaggttggaacagcttgaagggcgcagaagaagacaggaagatgttggaaagtttggaacttcctagaaatgtgttgaatggc

SEQ ID NO: 227396 - DNA, 503 bp, Homo sapiens
tttttttcagtagagatggggtttcactatgttgcccaggcttgtctccaactcatgagttcaagcaatctgcccatcttggcctccaaaagtgctgagatttacagataacaaaatcctggaaaagagatgccaagtaacttttccaagatcaatgatctagtaactggcagagctgggtgcaaaccaaagtggtctgactttggaactaatatatgaaatataaatcatcttttaagtggagtggcccaagaacactttatatatgacctatagaaagaacactcaactctttcctgaaaaacagtaccaagttgaaggctgaagagggagtgaataaatggaaaagtatttttttcttaggtaagaagactatattgcacatgtacacaaattatgttatgtaccatttgttacacaaacattttcaatagcaatgactgagaataccctgagattccatctgtaaatggacagtataaataaatgtggtatattcatat

SEQ ID NO: 227397 - DNA, 145 bp, Homo sapiens
tgaaacagatgaaagttataatagtttacataccttaccttaaagtatggtttttaaatacttaagatgtgatatgacatatagtgtgtatatatatcttatgctaaggaaaaagggacattaaaaaagcttatgttaaaagata

SEQ ID NO: 227398 - DNA, 272 bp, Homo sapiens
accaaattgctttagtgaacatgtatgtaaaaaggcggatgtaagcttattataaccgcacagttccacatatttccttcacttcctgcttatgtttcttaaacaatattgcaaacagaagataatccaaaaactcccaatattatatggtttttccttaatctgaatatgtttggaacagcttgggtcatataaccagttccactgaggaagctggaaattctacacacatatgattttgagggtcttacctttgggagcaggaattgaca

SEQ ID NO: 227399 - DNA, 428 bp, Homo sapiens
cagtggcccagaaacagctctttccttcttgactccccagctgcctcacctacctccctgctcccctaagctccttcctgtttaggctctctgggattagtgcttcagaagctatgcttccctgaagtcaaatgagaccagtttagtatgcgtatatgggattccagtttgtgcctcttcaaccatccaaagccacatctgtctacataccctacaaggtgtgacctctgcaaggccaaaatcagcacagataactaaaaggcagctgtctacagaagagaattaataatggtgtctgctgagggaggatacactgatgccaaatcagaccctcaaagatcttctaaacctatgcttcccctatcagatcttactattactgctgttaatgataataattaaagctcattcttgcataatgctttaca

SEQ ID NO: 227400 - DNA, 551 bp, Homo sapiens
  misc_feature (347)..(347): n is a, c, g, or t
tatacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtggggaaagcccaagaatgaccttgctgaggcctggattgggtggcacagtggccacatttggaggaagttcacatttcntggcatgcagacccaaaactgggttcttggctcctgcctgctgggatcggttatctctggtggggctggcagtcataattccaatttaagccacccagggtttcttcccaattgttccaagaaccattcttcagtgggggcaggtttggcccttccccttaagttagaatgtggtggtcagacccttgaaggaataagttttaa

SEQ ID NO: 227401 - DNA, 391 bp, Homo sapiens
agactccgtctcaaaattaattaatgaattaattaaaagccagtagcaataaaatttaattatacaatttttaagaatatgaaataaaaaaacagcaaaattaaacttcgaagataaaaactaagtgaaaaaaagaaacagaaaattaaaaatccaaaatattaaaaacaaaggcacataaccttcgcacctttccaaactaggattcgtacagatgccacctaaatgaaaaacactgctcgctttccccagcctctgcctctgccaagactcttaagtcatagcgacttctgggccaccattgtcctcatccagaatccgctttctcccttttccaaaaaattccactagccctacaaacgtggcctctttgggaaagctttcattttgg

SEQ ID NO: 227402 - DNA, 646 bp, Homo sapiens
ctggattcaacacctctctatttctataaatcatctactgcgttaaaaagtgtctcactaacaaccttatttgtgccataattttctcatttttgatgggaaaatatttctcctgttctctttcttggtcaagatatattgctcaagtatttttttcttttgtgtttttgtagtgaactgtatcaattctattgacttcctgctgctttctcatcaggtatagacttaaatctcccaaggggattttttttaaaactacaataagatgtttttggtcatatgcttttccttttccggtgctccatgttacatcctttgttcattttcagttctttctcacactttgtgttcttagaaattccatctgaaatttagaaatagtctcccattcgctaaaatgaactgctgaaattaggactttgcaacccaaaaagatattttaattgggctaggataacgatcttgaacttttaatctatactaggttattgcatgttttcagctcctgttacttatttgactctactgtgtaaacactgtcattcattaacaagttgatgcctgattagtgctactaactttttttatgctggcatactcaagtgtttcttgtttagcttgtaaagaatggccataagataccatc

SEQ ID NO: 227403 - DNA, 249 bp, Homo sapiens
taatctttttagttattttcttagtggttgccctgagaattttaataagcattttaatttataacaatctagtttaatagcaacttagtttcaatagtatataaaaactttgtttcactgtagctgttctgtttagtaattttgtcacaaattgcatctgtatgcattgtgtgcccattaatgtagatgtgtaatcatttatgcttttgtctttaaattatgtagtaataaaagagaagttataaacca

SEQ ID NO: 227404 - DNA, 518 bp, Homo sapiens
atcacttatttacttggtaggagtagaataaaagaatgtttttactggcactgaatgttaaagttgaaagaatcccacgacactacgatttggaaaggtcttggttctgtgtttgttggcatagaatgtgaccatgagtgtcagtagtttgtagaggcttgtctgttaaataagttaaagaaattattgaatttgtggccacctgaaacctagattcaaatgcaatcagagctccacatgtatttgttgtctccacagcagtagctaatataaaataccaaccatttgttatttggcctccccagtaaacaaagggagctggtagtgtgctctcctatgatcagactacaaaagagaaggagaagtgactcagagcaatgtttaccaaaccagaaagaactattgaagaagtcgaaatttagtaaacaatggggaaaaaaatccaatcatgtttttaaaaatagagcaccaggttttttctataatgtaaaattaaaatgtcttgtggtttgatgtat

SEQ ID NO: 227405 - DNA, 364 bp, Homo sapiens
caatccagcctgggtactgagcgggaaactctgtatcaaaaaaacaaaacaaaaaaaaaaaaacaactttattcagcaaaataacatcttctatatgcaaaacactgtgaggtgctagagttacaacattttcaaagtagacagcctacccaaactactctgaatgacaagggactcaattattaatatataatgataatagttctcaagaagatacaaaaaagtatatgcataatagctagctgtgctgatttctgaagatccattgcattggagagaattcatgtacatagccttaatatatgactatatgtgccaatgtaaaactgctacagaaatactttagactgcagcttaagtaaaa

SEQ ID NO: 227406 - DNA, 315 bp, Homo sapiens
gtcacaacctcactgctccccagaacctctacctagagagaagtagctttctcaaggtctttaacatgaattggtaagtacagtgagtatagagaaccctcctctgggaagctggaaacttgtactatcttagcactgacataaacagcatgacaccggacagtccttagctctgttttaccttaaaacttgaagttttttttgagacgggagccttgctctgtcgcccaggctggaggttgcggtgagctgaggttgcgccattgtactccagcctgggggacaagagcgagactccatcacaaaaaaaaaaaa

SEQ ID NO: 227407 - DNA, 118 bp, Homo sapiens
gaaggttagaatgacaaagtacactgcatgaaatgcctttgccaagaactaacttccttggagaaaggggagaggttggttggtatatattcagagtggggatagctgttactggcca

SEQ ID NO: 227408 - DNA, 349 bp, Homo sapiens
ggaggaaaaactacaatcaaaatgtttgtttaaacctatataaatttgatggctattttatacagattgatactttaccaaaggtttgcattctaggtaaggttttgcttaaactctataaaattattaatagatacaaagaagacaggttttcccttttatcatttttcagttaaaccaaactgtgagaggcagttataggtggttggagcagaagagataaggtggagaggggaactgacattttttaagtgcctgtttcattctgtacttgtgcctgtacatatgttattccatttaatcttcttagtaaacttaggagggttttaagagcctagtgggaatgttg

SEQ ID NO: 227409 - DNA, 531 bp, Homo sapiens
gcaaaaaaaaattatactctatgaaacccatatatggcatgatacatagtatgattgtatatatggtataaatatatggtatgatcccatgatatgcatatacgtacatatgaaaattagagtaaataaccaattagttatatctctattttagtaacccatagggatactcctgatctttttacctgctaagcaaaaagtaaacacaaaagcagcaggtaaatatatgtattatgattctactttggtaaaaacaattgaatccccacatatgtgcatctaaccttgcataggtttgcacgagcaaggtaaaagctgtggaaagacacacaggctgttattagctacctcaggatactgagattgagggttgaggtagagaaaaaggggataattaacttcatacatatttgtatcatttcacacattaaaacagcaagtctatacttcaaaagtcatcaaataaagaaaacattatatatcaataacattatctttagcagtctagtaatgtacttctttgtggggaaa

SEQ ID NO: 227410 - DNA, 420 bp, Homo sapiens
aggagtttgagaccagcctgggcaacatagtgagacctcgtctctacagaaaataaaaacaaaattagtggaatggtggtgtgcacctgtaattctagctactcagaaggctgaggtgggaggatcgcttaagcccaggaggtcaaggctgcagtgagccgtgatcacaccactgtactccatcctgggtgacagagcaagaccctgtctcaaataataatacttacttctttagttttttggggggattgaggactaactatataaatttagaacagtatctagcacatggttaagtgcaactgttattgtttcattgtagtcatttttagaagcatttttaatagaagtgttactttaaaaataatgttttcagttatgaaataaaacactcctattctcaataaaaattttacaaga

SEQ ID NO: 227411 - DNA, 448 bp, Homo sapiens
gctcgcctcaggagtcctactgaatcctgggtctccagtgcctcccaggcccctgtcggtgtgcaaagtcatgctccttcttgtaaagaacagtaggaatgagccccaaaaggagtgcatagaggagctagtttgggtgaaccattaaaataaattttttttaaggccgggtgaggtggctcacacctgtaatcccagcactttgagaggctgaggcagccagatcacttgaggtcaggagtttgaaatgagcctggccaacatggtgaaatgctgtctctactaaaaatacaaaaattagccaggcatggtgacacatgcctgtaatcccagctactccggaggctgaggaaggagaattgcttgaacccgagaggtggaagttgcagtgagctgagattgcgccactgcactccagcctgggcagcaagagtgaaactccatctca

SEQ ID NO: 227412 - DNA, 278 bp, Homo sapiens
tctgccataggatgatgcaacagaaaagccgtcaccagataccagcaccttaatgttggacttctcagcctccagaactgagacctcaaggcacaaagcaaaagaagaatgaatttcatcatgggaatatacaaagcaaggcattaacatctatagttaaataagtcagcatcaaacttcttgctgtaccacccaccatttcacacagttcagctagctgactcgttcatactttaaggctaatcagaataaattaatgattcatcactaataaagat

SEQ ID NO: 227413 - DNA, 395 bp, Homo sapiens
tggattatagcattagctgcagaaatggtctcccacctccacacttgtgccctctcccatcccatagtttcttgtcaaaagagcagctggagtcctcctttaaaaatatgagtcaggcgcggtggctcacacctgtaatcccagcactttgggaggccgaggagggcagatcacgaggtcaggagatcaagaccatcctggttaacatggtgacaccctgtctctactaaaaatacaaaaaaaaattagccgggtgtggtggcaggcgcctgtagtcccagctacttgggaggctgaggcaggagaatggagtgaacccaggaggcggagcttgcagtgagccgagatcgcgccactgcactccagcctgggtgacagagtgagactccatctca

SEQ ID NO: 227414 - DNA, 471 bp, Homo sapiens
ggttggcatgtttgcctctgtaagccattttcatgactgctgggtttatttaacactcattcaaaaagttttggagaacctactatgtgccaggcacgtgatgtatgttctggaaggggtgaggagaggcagagcgtgagaggggtggtaccactcctgaactagagacctgggtgccccttccaggtgggaggtcttgcaaagtctcaacagaatagcattcacttatctttttaaagtgggtattgcctaatgagggccctttctagcccatcttttggattaaaatacatttcaagaactgtgacatttgaagtgcactggttttgtgcgtaacattctgtgagagttttacaccatagcagaaaaaatgcagtcctcgcctctcattgcttctatctaggcattttctgcctaggaaacctcaaggaaatttaaataatacacttcccaaatcatacctcaataaag

SEQ ID NO: 227415 - DNA, 456 bp, Homo sapiens
aggtgacctagaagccaaatgaagaaagtgttttaaggaagagagagtgatcactgctactgattatcgaataatatgaggactcagaattgatcattgggtttagcagcattgggtcattggtgacctgacaagaagagttttcaccaattgtaatgaaagcctgattggaatgggtttaagagagagtgggaagacactaatggcagttcctttgaagagttttactgcaaaggcgagaaaaatatttgagtgtatctgggggagtttcttttaaaagctgggaaaatgacaagtttgttaaatgatgagaatgatcaagtagagatgtaaaaatggatgatgtaggagaaaggggacacttgttagagtgatgtcctttggtataagtgaagggatttgctttatatcatgtggttttaacacatgtccacccacaagcctaaaataaaagtt

SEQ ID NO: 227416 - DNA, 412 bp, Homo sapiens
cctcagctccagggagggggctgtgctcagtcgctcacagtgacctcagcctgagcactcatgttcttgggagaatcctagggtggggaggcacatattcaggaccccagtaataactttattacttagtaactttactattagaaagcacccaaatccatagctgtgtgccaggcactgtgctaagtatcctacaggttttatgtgatttattttatttattaatttaatttaatttttttgagacgaagtctcgctctgtcacccaagctggagtgcagtggcgtgatctcagctcactgtaacctccacctcctgggttcaagagattctcctgcctcaggcctcccaagtagctgggactacaggcgcataccaccatgcccagcttttttgtatttttagtagagac

SEQ ID NO: 227417 - DNA, 454 bp, Homo sapiens
tgttatgtgaggggctaatcagtggaattgtgatcaaagtatggtttttggtggcaaatatagatattggccctagatagctcctgtatccccaacaaatatttttcaaattgaagtttgggtggatccaatacagtttcatagacctcagcagtgggagttcagagaccttcttctccccagcatgatttgtccttaatgcagtttagctccaaccagcatattggctttgggtaatttatttaacctttctgaattttgatttgctcatctgtaaaatgggaacaataatacctacttcatcagatagttaagaggattcagtgagaagaatataatttaagtgctttacataatatctagcacctagcaagcacctaataagtgttacctttcctgccatttatgaccatggtatttcttactttgaaaagaggtgaatgtagtttgagga

SEQ ID NO: 227418 - DNA, 597 bp, Homo sapiens
aaatcgcgggggcacagggagagcggtcagatgtcctgcaggcagaaccccaggggaaccactcccaggggtgaaaccgtgctgactcggaggtagtgtgccacttggaagcagtgggaccgtctggtggtagatgcttcacttcttcatttatgactccacattcgtggaagagagcaaaggtctgtctggctttctcatgttcccagttttacaaattttctttttgcagaacaacagagcaggaatgtgtttcgaggagccaacaaatccaaacccctctgcagacaagaaatgaacgacaattttatgtctaaaatgaaaagagctaccaatcatcttttagattaaaaaaaaaacttatagaaggaacaacaaatgctggatgatagttattttacctaaaccaaactgtaccccaaaatataacttttgtacaagtatattagctttccttaagcattgataacagatcatgcaatctcataatctcattttttatgctaatggacccttatcaattgcctgactgtatatttattctttaatgataacagttattcagaaggtaaatattttggaaagaagtaaaatttt

SEQ ID NO: 227419 - DNA, 437 bp, Homo sapiens
ctccgcctcccagtttcaagcaattcttgtgcctcagcctcccgagtagctgggatcacaagtgtgcaccacatctggctaatttttgtatttttagtagagatcgggtttcaccatgttggccaggcttgtctcgaattcctggcctcaagtgatctgcccgcctcagcctcccaaagtgctgggattacgggcgtgagccaccgtgcctggccctttggattacagaatttgacgataatgggttcaaagctgtctggaggcataacctccggggcagctgaacaagattataggaaaggaataataaaatattctgaagtctgtctatgcaaacaaacacagatgtctactctggaagaataaaatgtaccctagaattgcttttttttttttctagtatgattgagatgttatggtaatattaaaaatgaaaa

SEQ ID NO: 227420 - DNA, 781 bp, Homo sapiens
  misc_feature (665)..(665): n is a, c, g, or t
cggataccccaagcccgagatcggacaaactttttttttattctgggaagcggcccattgggtggggaccggaaatggccctttagcccggcttaggccagggaattgaactgaatttattttcacaggctttaaaaaaaacaacaactttgtatcttacttattttaacattcctgtttcgttcccattgtgctcctaaaaagtgtagaatataggagcaattttttaaatggttttgctttctgactcatttttggagtcaaatatttcatttattatttggcatgttagaccccctagcaattttacctgaacccaaagagaatagacagagacttctgagctttgaaaaattatgcattcgagccgggcacagtggctcacacctgtaatcccagtactttgggaggctgcagtgcatggattacttgaggtcaagagttaaagaccagcctggccaacatgatgaagccctgtctctactaaaaatacaaaaatttagctaggcgtggtggcatgcacctgtaagcccagttactcgggaggctgaggcaggagaattgcttgaatgcagaaggcagaggttgcagtgagccaagattgtgccactgcactccagcctgggtgacagagcgagaatccacctaagaaaaaaaaaatccanaaacaaaaattgccgccgaattcgggctcacttggccaatttgcccttttggggggtcgattacaattcactgggccggcgtttacaacggtttgacttgggaaaccccttggcgt

SEQ ID NO: 227421 - DNA, 393 bp, Homo sapiens
gctgcagcatacccaaagaatacaacacactctagtcaatacagtgattcccaaatagatacaggtcagaatctgagaagggagggcaggtataaatttgaaaatgtcagggccaggcacagtggctcacgcctgtaatcccagcactttgagaggctgaggcgggcggatcacctgaggtcaggagttcaagaccagcctggccaacatggtgaaaccccatctctactaaaaatccaaaaatcagccatgtgtggtggcaagcgcctgtaatcctagctactcaggaggctgaggcaggagaatcacttgaacctgggaggcggaggttgcggtgagctgaggttgcaccattgcactccagcctgggcaacaagagcaaaactctatctt

SEQ ID NO: 227422 - DNA, 695 bp, Homo sapiens
gggtgaagtggctcatgcctgtaaccccagcactttgggagaggccaaggcaggcagatcacttgctgtcaagagtttgagaccagcctgtccaacatggtgaaaccccgtctctactaaaaatataaaaattagtcgggcatggtggcacacacctgtaatcccagctactcaggaggctgaggccggagaattgcttgaacccaggaggcagaggttgcagtgagctgaggtcacaccactgcactccagcctggggtacaaagcaaggctctgtctctaaattcttataattcttattcttaaatgtatggactggccacccatactttcaatatatcctgagatgctacgcatgagtaaatttaacttaattatgttagggaccaaaaaacgttttatgactccaaaatttttggcttctgacgttgggtaatcaaaaagatagaaatcaaagggaatggcaagagtatatatgattactattgctgtaacagttataaatgcttactatgtgctaggcactgtgtactttgacgtgccttagttcatttcaatcttacgactatccattttatagatgagaaaattaaagcacagagagatgaagtaagctgcccaacatcacacctatgagcagtgaagctgagtcgaagcttaaggaagaggtatgaaaacagcagaagacagagtcg

SEQ ID NO: 227423 - DNA, 285 bp, Homo sapiens
atttgagattgtgatgcttagaataaagaatgagatgatgagtgaatctccatgtccttacaccacctctgagtaccttgtagaattcactgtgcaagtgctcctgtcagcccaaagatcagtaaagtcaccatgacccattttactctgtgctgtgtccagcagctggtatctgttttaacggttggtatttggattacggtatttctaagagcccagggacaatcttacattgaaacagttctgtaacaattactagaaacctaactactgcataagtatttg

SEQ ID NO: 227424 - DNA, 532 bp, Homo sapiens
catcagaggcattgttcatttctgttaccatgttgatttctggcatttccctttggttctttcttagagttttcatctctccatttacatttacccatctgttcttgcatgttgtccactttttccattaaatcctttgacatattgatcataatcattttaaattccaagtctgacaatttcaaaatctgtgccatatcttgagtgtggtcctggtgcttgctttgtctcttcagactgtgttttttgctttttagcatgtttataatattttgctgatagctagacatgatatatcaggtaaaaggaaatgagataaatgatcctttaatgtgaggttttatgtttatctgtctaggagttaccgtttgtagctgtaggtgtcaaaggctaaaatttcctttagtgtcctgtttttgtctctcttgttgtctctgggtttccctagagactgctttttaataagaatctgagggacctctttcaactataacgcccaggatcctgactaatgtagtggtaaggtaagggg

SEQ ID NO: 227425 - DNA, 1091 bp, Homo sapiens
tatacttcatttctttgctgagtgctgtaacttccctgaggaccagaaatttcacatctagggtcagatcgaatggcatcccgctgaggaagtacctaaggcagttaaactgccagttttggtcccaccaagtcatctagtgcatcctgtaagatgcagacagatgctttttgagagatcgtagcagatttttgagatgatagctgttgggtccccagctaattcagcatagggtcccaagagatgagatacttgtttgggaaggaggttcagtagttgtgatcccaaattttggctctttatattgtctgtaatagacccttttgggagcaccttcatccacgtgacaattctaatgttcccagtgtggatttcttttctagtaggactttagataatcactctaagtaggatttgtatgaaacttttgacggtcattcctcaaattacctactctctgtgggttccactgggtatattgttatcagaggaactaagcaagcacaatcagatgtaaaaacacaccctgaaaaaaagttgttttggtccctcccagatctgagcctagaaatttttagctgtcttgtctctacgtaatattctagtgctgataaaaggtgttgggtcaagataacattgacagccttagtgtacgctgacttgaaaagaaagagtgcattcatgcattgtaaaatagcatatacagcctgtgctaaggtcagactcagtgataagatatgaacgttagcatacattgcatttttccttggcagtacttttattggttcacatgatcaaatgagtaattaagattgaagtcttattctggaaacaagtttaacaacagtgaaagtcttccctcagactcctaccttgacaggcatgactgaggatgagaagtacagtctccttttgttcctctccttggtctttctgctgagctcatcttccagagggcccattagtttgtctgattggtaacagcataaatgacttcactttcagacccactgcttattattgggatgacccagagttcattttaattacataatgccaacatgatgataatgatacttgctttaaaaaaa

SEQ ID NO: 227426 - DNA, 304 bp, Homo sapiens
ctctaatatgtatcaataaaaataaataattaaatatataaatatttaaaattaatcaatgcaatccatcatattaatagtctaacaaaaaacacaattttattagttgacagaaaaaaactttgacaaattcagaatgtgtgcattgatttttaataaacatacacagttaatttaatggagaaaggatagctttttaacaaatgttattgtaaaaattggacgtttatataaaaatgttaacctttgacttaaacttcacatctatgctaattaacacaaaagagaccaagacctaaaggta

SEQ ID NO: 227427 - DNA, 1112 bp, Homo sapiens
  misc_feature (1064)..(1064): n is a, c, g, or t
  misc_feature (1108)..(1108): n is a, c, g, or t
gaacttgggaggcggacgctgcagtgagccaagatcacaccactgcactccagcctaggcgacagggcgagactactccgtctcaaaaaaaaaaaaaaaaaaaaaagtaagggttctgaggccgggtgcagtggctcacgcctgtaatcccagcactttgggaggaccaggcgggcggatcacctgaggtcaggagttcaagacaagactggttgatatggtgaaaccctgtctctactaaaaatacaaaaattagctgtgcacagtggcaagcgcctgtaattccaactactcaggaggctgaggcagaagaactgcttgaacctgggagatggaggttgcagttgagctgagatcgcaccactgcactccagcctgggcaacagagcaagactctgtctcaaaaaaaagtacaggttctggagctaaactgccaggttgaaatcttgcctccttcatttctcagctgtgtgggaatgttacagaactactctgtacttcagtttccacaactctaaaattgtaaaactattaaaatttggatgtttacataatgtagtaactactttaccgggatttagaaaaaacttggctaaggccaggtgtggtggctcacgcctgtaatcccagcactctgggaggcttaggtgggcagatcacttgaggtcgggagtttgagaccagcctgaccaacatggagaaaccctgtctctgctaaaagtacaaaattagcccggcatggtggcacatgcctgtaatcccagctactcgggaggctgaggcaggagaatcgcttgaacttgggaggtggaggttgcggtgagctgagatcgcaccactgcactccaagcggggcaacgagactctgtctcaaaaacaaaacaaaaaagaaaaaacttgactttcaagttatccagccactcctcttcttaaaaattaaacctaaactctggcatctataagacaaaaagctgaattcctatgaatgcctatctattgcatctgaagtataaaacgtattttataagcaaattagaagttggatgtctacatactatagtaantacttgacaggatacctaccttataggtttcttgtaaaaattanatgg

SEQ ID NO: 227428 - DNA, 1103 bp, Homo sapiens
  misc_feature (733)..(733): n is a, c, g, or t
  misc_feature (799)..(799): n is a, c, g, or t
  misc_feature (916)..(916): n is a, c, g, or t
cgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgcgctcaggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagctccatccgaanctctgtgtgcccagcccctgtggaaaatactataccctcaatggaagcagcttggatcagtaatgngggcctagcagacatcttcacggtctttgccaagacaccagttacagatccagccacaggagccgtgaaggagaagatcacagcttttgtggtggagaggggcttcgggggcattanccatgggcccctgggagaaatgggcctagcgtcaacaaagcgaaggtgtcttgggggaacagggcatccgggaacacgcggggggggggcaggcccagggtcgggagcccacacagaggtggtagtggccccggagacgaaagccctatacggatcgccacaccgcgcggaacactggtacccacgt

SEQ ID NO: 227429 - DNA, 1169 bp, Homo sapiens
  misc_feature (799)..(799): n is a, c, g, or t
  misc_feature (865)..(865): n is a, c, g, or t
  misc_feature (982)..(982): n is a, c, g, or t
cgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgcgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagctccatccgaanctctgtgtgcccagcccctgtggaaaatactataccctcaatggaagcagcttggatcagtaatgngggcctagcagacatcttcacggtctttgccaagacaccagttacagatccagccacaggagccgtgaaggagaagatcacagcttttgtggtggagaggggcttcgggggcattanccatgggcccctgggagaaatgggcctagcgtcaacaaagcgaaggtgtcttgggggaacagggcatccgggaacacgcggggggggggcaggcccagggtcgggagcccacacagaggtggtagtggccccggagacgaaagccctatacggatcgccacaccgcgcggaacactggtacccacgt

SEQ ID NO: 227430 - DNA, 557 bp, Homo sapiens
ccgcaagatccacccatctgcccctgtcagggggctgccacccgcactgccgattcgcggacagcgcccgcaggcgtgcagatctgtccctctgcactcaggttcacgccgtccttgggcgcgtggtctcggggtggggaacccggccccctggtcggctcttgaatctttatccttcccctccccagtattgagctcccactggtgcccagtcagacgctgggactaccctttttctattccactcagcaacgcgggctccatccagcagctccaagttgctctgcaacccaccctcccgccttccagcgcctctgcatccacccttccattcattctcccattcattcattcatccttttctcctcgtccctccttcattcattcatagccccccgccctgcccgcttcagcatttcattcattcattcattcattcatttcccggagctccgctagcgcacaccccttcagccgaaggccccagcgcgcaggcgcaggccgggagaggcaggcaccctccaatcgtcgggcgtccttcctcctccgggcggccg

SEQ ID NO: 227431 - DNA, 381 bp, Homo sapiens
aggtaggtagatggcttgcgtccaggagtttgaggtcagcctgagcaacatggcaagacctcgtctctacaaaaaaatttaaaaattagctgggtgtagtggcgcatgcctgtaatcccagaactgaggtgggaggactgtttgagcccgggagttcgaggctgcagtgagcctcgaaccccagcctgggcaacagagtaagaccctgtctcaaaaaataaaaaataaggtgtgagcagagctggatccttctggaggccccagggcttagggttagggtaccccccaacagtcaacagaacggcccccaccagagaatgatctggacccaaatgttcacagggcctgggggtcggggggaagagatgctgcattgtttgg

SEQ ID NO: 227432 - DNA, 460 bp, Homo sapiens
ttgcaggttcattagattgtttttcttcattctcttttctttctgttcagactgagtattttcaattgccttgtctacaggtttactgaatcttttttctgcctgctgtagtcggccattgaatcctcctagagtgaatttttaatttcagctgttataattttctgtcctggaattcctacttggttccttttaattatttctgtctctttatcagtattctctacttgttcatacatatgattatctttatttcttttatctcattgagcatatttaagacagttgatttaatgtctttgactagtaactctaaaatctgggcctcctcagggttaattcctaattctttcttcttccctgtgaattagtcatatttgcctgattctttatgtgatttgtagtttttcgttaggaattggacttttaagtactataatgtgataactctaaaatctgg

SEQ ID NO: 227433 - DNA, 1046 bp, Homo sapiens
gcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgacacaagaagagcaggctgctgctgagaaggcagtgaccaaggaaggaatttcagggtgaatggactgctcccgctcctgagttcactgctactcaagctgaaggttgcagactggtctgaaggtgtacaggtgccctctgtgcctattcagcagttcctactgaacaatggagcactcagcctgccacggaatactggtctgcagctcccactgctcaggccactgaatgggtaggagcaaccactgaatggtcttaagctgttcttgcatgggctcttaagcaacatggaaaaatggttgatggaaaataaacatcagtttctaaaaaataaaa

SEQ ID NO: 227434 - DNA, 423 bp, Homo sapiens
ggaacctgcaggcaaaaactgtgctgagactgattccccagtggtcagccccacagctggactgcaagctgctttccctgggcagactcagcctcctgcaggaggggtgtgggagggaaggagcagtatctgtgtgcagacctgggttcccccagaactgagatgctggatgaggtgcctgcatcccctgagctgcttggcgaggaggacggtccatgttttccatcacagctgggagtaagagcagatatgtgcaaggcaaggacgttgtttcaccttttgaaggaaggttgttaggaaaacgcctgcattttctaatcactggagaagcccttttaagcagaccagatttataagggttttgatgaaaacagtggtttgggagcagcaatgtctttaatagcaacaaagcccagagatggg

SEQ ID NO: 227435 - DNA, 721 bp, Homo sapiens
tgaaatcatacctggagcagcatgaaggtgcaggttagcacattgatgatacagggtcaaactctgcagcctgcacgtcttgggtgtgagccttgccactcctggtaaccagctttgtgaccttaggcaagttacttaaatatgtttgtttcttcatttggaaaataggattaatcgttatacttatttcatagagtagttgtgagcattaaatgatacaaggcatattaagggcttgcatattaatacggtgctttatataggtaactcaatacatgtttatattgctaactgaaaagtcttaccagaggtcatgccattgttgtcctttataaccagattgacagcaatcttcctaatcttttcctttccaattaataggcttttatatagcctagatcttcaaaagtccacctgctttagcccttttcctgagggagataagtggtatctctatttttcaattatgaaaaaaatttattgagcacttgggctaagcactgcagggtgagaggatgaggaagataagaagaggctcatagttttgtgggggagctccatgagcagataatataaggtaataagtgctgtgatagaggactgtacaaggtactgatctagtctggggcagaagagtggggagtcattgagggttttttttgtaggataagctgctgctgctgctgtcttttaaaaattgagatgagattgtcaaaacata

SEQ ID NO: 227436 - DNA, 484 bp, Homo sapiens
tctactaaaaatacaaaaattagcccagcgtggtggtgggcacctgtaatcccagctacttgggaggctgaggcaggagaattgcttgaaccctggaggcagaggttgcactgagccgagagtgggtatcatgccactgcactccagcctgggcaacagagcaaaactctgtctcaaaaaaaaaaaaatgaaaaccaaacagaaaaggacaaatattgtctgattccatttatgaggtacctagaataatcaaatccattgagatagtaaaacagaggttactcagactggagaaaagaggggatagggagttactgtttaacatgtacagagttttagtacaggatgatgaaaaaccctggagatgtatagtggccatgatcaatgtgaatgtactcaatgcctctgaactgtacacttaaccatgcttaaaatggtactttttatgttatgtatattttaccacaataaaaatcaattttaa

SEQ ID NO: 227437 - DNA, 283 bp, Homo sapiens
cacagaaattacgcaattcagaaactatcatctagttataacaagttttatgaaagaatcaatatatttgctgtaagatgaatcactaacatacttggctcaagagacttaaaccccaaataccaggaagctccacagactaaaacaggagacagcaagcccagtgccctcttcttcccctcaactctttaatttaggatcccaggggcatgactgaactagaagagatgcccttactttttaaccagaattatgaattaaacagaaaacaactgttgatgca

SEQ ID NO: 227438 - DNA, 502 bp, Homo sapiens
tccaaattattggctgatttatacatccctttgattaagaaaagacaacaataaacagtttaagcactgcaaagattagctaaattggaattatcctgttagtgaagtttgtgaacaaactttgtattcaggtcacactatcactaaaaccagtttacagaaaagcctccaaaaattattgatttatccaatttttgtcacataaaaagtaaattaggagaatgcctctacagattatgttaagaaaaaaaattattgggacttttattagattatttgtaaatacttgattaaaaatgcagaagtttgaaaaagctcagctgagttcattgatgaattaattcatgtagtaataaaaaaactcacacttgtacagtgtttttaacttttcaatgtgttctcacataacctgtcttgtttcaccttcaaaataatcttgctaggtaagaaggataggattattttctatgagaggaaactgaaggattaaatgatgtggcca

SEQ ID NO: 227439 - DNA, 237 bp, Homo sapiens
agaacataaatatacagcatggcaaaactacatctaaaacaagtattataggtctcatggtggaaaaattggacccacaagaaaagttgttaattatctctgatattctgaaccattgatatctgcaaaatgattactaggtatgtgcaatgaaggctattgatgttaccctgtatatctgcacactgtgtacaaatgctgttaaatgatgtaataaaaaattaaaaaggaaattaa

SEQ ID NO: 227440 - DNA, 409 bp, Homo sapiens
gaggcagaagataaattccaagatgtcattaacaaaatgagaagaaaaaggatatctacctgaacaagttttatggcagacaaaagtgacctattctggaaaaaaaaaaaaaaaagccacaaaaaggccaggcgcagtggctcacacctgtaatcccagcactttgggaggctgaggcgggtggatcacctgaggtcaggagttcaagaccagcctggccaacatggtgaaaccctgtctctactgaaaatataaaatttagctgggagtgatggcaggtgcctgtaatcccagctacttgggagactgaggcaggagaatcacttgaactcgggaggcagaggttgcagtgagccgagatcacgccactgcactccagcctaggagacagagtaagactcttgtctca

SEQ ID NO: 227441 - DNA, 382 bp, Homo sapiens
aaactcaaacgggtcagtaggctgcacagcataggcaggattcgtgtcccaccacagggaaggtctggtcctcgagtttcttctgtgaccgatctgacgccaaacattctttccatctgaatcactcacataaaagtcccagaaaaaagcacttctgactcctggctgaactaaggattcagccctgcagactaaagaccagaagtggaagtctgaagtcagggaacacccatcctttctagattctacacactagagaagtcctacaaaagggcgatgtggtcctagaaggtatgcgttgggggatgggagagtggtatgtgctccacaggaaaaaaaaataaaaagcataaacctatatattgttcaaaatattaataaa

SEQ ID NO: 227442 - DNA, 458 bp, Homo sapiens
ctgacacaagagtggattttctgagagctgtttgagcagagaaaacttgaaggagatacagtgagtagaacacaacctgtaggtggtttgaagacctgaggactccaatacctcccaactctcatattctctatagtttttctagaaaagcccatgtattggggcataacctataaagatgatagcaactaaaatggataaatcaatgacataaaatgtttatttcttctcttgattaaatgacagataccccaatctgcaggcatcatatgttatgactgcctccactctctgcattttgagaaagcctctacagaaattctcaaaggaatgggtaaagacatgagtatttttaactacatatactttaaatttattttttttttttgcatttaaaaggcttgagaggatttgggttgtatccaaactgaaaaaataaaaataggttaagtacatga

SEQ ID NO: 227443 - DNA, 324 bp, Homo sapiens
tcccatccctatcttcccactcacactcactggttcttctgctttggtttagcctccaatgatcacagaactcatcagtgaggcttttccatctgtggtagcttttctaatataaagaaagaaagatactgagaacattttaaggcttagcagccttctggcttagttgtttgtaaatgaaaatatgagtagaagaattaaacagccaaaaagataacccacaaaatgggagaaaatattgacaaatcatatatctgataaaggatttgtatctagaatataaaaataactctgataactcagcaataaaaagacaacttgatt

SEQ ID NO: 227444 - DNA, 877 bp, Homo sapiens
taagtcaatctccagttccttttgcctcctggagttcagcaggtgaggctgaaaagttccaagcctcaaaaaatgtggttggggccaggtgcggtggctcactcctgtaatcctagcagtttggaaggctgagcacatggaccacttgaggtcaagagtttgagaccagcctgaccaacatggtgaaaccccatttctactaaaaataacaacagttagctaggcgttgtggcacatccctataattccagctactcgggaggccgaggcaggagaattgcttgaacccgggaggtggaggttgtagtgagctgagattgtgccattgcactccagcctgggctacaagagccaaactccgttttaaaaaaaaaatgtggttgctttctctggcagctagccctcctcctgaagcagtctcggagcttgcagccaccctgttagctcaacagcatcccacatgcattcttaccatgctgcagatctgaaagaccttagaggcccttgtgtcaggaacctgggactaagactaaatatcaaaacagaaaatgctcctattacctctgtcacgaagggctttataagagctttggaagctttatgccaggaaccaggggcagagaccaaatgtatatttcttttcttatatcggagacagagtctcactctgccactgaggctggagtgcagtgatgtgatcatagctcactgcagccttgacctcctaggctaaagcaatcctcccaccttagcctctccagtagctggaactacaggcatgcatcaccatgtccagctgattttaattttgtaaaggcaggatcttccttttttccccaggctgatctctaactcttggcctcaagcaatccttcct

SEQ ID NO: 227445 - DNA, 761 bp, Homo sapiens
taaggcttttcgggctcttttattaaagaagaggcgtacagaatctcgccccctgcctaataagttaaatgcaaatcagggtggttttgaaaatggtgagattggtgaatctgaggagaataatccacttgatgtccactcaatttatattgtcccttttcaatgtccaaagtgtgaaaagtgttttgaatcagagcagattctcaatgaacacagctgttttgctgctagaagtggcaaaattccaagcaggttcaaaagaagctacaactataaaaccattgttaaaaaaatcttggccaagcttaagcgtgctaggagtaaaaaattagataactttcaatctgagaaaaaagtatttaaaaagagtttcttgagaaattgtgatcttatttctggtgagcagagctctgaacaaacccagagaacatttgtgggttctcttggcaaacatggaacatataaaacaattggcaatagaaagaagaaaacattgactttgccattttcttggcaaaatatgggaaaaaatttgaaaggcatccttacgacagaaaacatattaagcattgataattcagtgaataagaaagacttgtcaatctgtggttcatcaggtgaggaattctttaataactgtgaggtacttcagtgtggtttttcagttccaagggaaaacatacgtactagacataagatatgtccttgtgacaaatgtgagaaggtatttccttctatatccaaactaaaaagacactatt

SEQ ID NO: 227446 - DNA, 742 bp, Homo sapiens
taaggcttttcgggctcttttattaaagaagaggcgtacagaatctcgccccctgcctaataagttaaatgcaaatcagggtggttttgaaaatggtgagattggtgaatctgaggagaataatccacttgatgtccactcaatttatattgtcccttttcaatgtccaaagtgtgaaaagtgttttgaatcagagcagattctcaatgaacacagctgttttgctgctagaagtggcaaaattccaagcaggttcaaaagaagctacaactataaaaccattgttaaaaaaatcttggccaagcttaagcgtgctaggagtaaaaaattagataactttcaatctgagaaaaaagtatttaaaaagagtttcttgagaaattgtgatcttatttctggtgagcagagctctgaacaaacccagagaacatttgtgggttctcttggcaaacatggaacatataaaacaattggcaatagaaagaagaaaacattgactttgccattttcttggcaaaatatgggaaaaaatttgaaaggcatccttacgacagaaaacatattaagcattgataattcagtgaataagaaagacttgtcaatctgggggtcaccgtgagatccttaaactgtagtctcagttgtttcatcccgggcaaccatcgtcacacaaattgcgtgcaaggtatttcatacacagcattattggaagcctgtctggggactacacgcctaagagtgc

SEQ ID NO: 227447 - DNA, 423 bp, Homo sapiens
agtagcattggcaattgttgtccttagcagcagccgacaaggcggaattggaatggtgctgctcctgactacctctactccacgctaggcttaggggctggagtgacccaagccctcagggacctgcagcggctgaagtcctctcagcacctgcaatatcccagagggcaaagacagggccaaatactggattctggattctcttcattgttgtccccctgcaagtggagaggtatccaggctgggccttgtcctaagatatgacggaactgaattcttccagcaagcatgtgagcttggaagagaacaccatgcgccacacgagaatgcatactggccaacaccctgtgcaaagatccagagaagctgtgctcagactcctgactcatgaaaatagtgaacttataaatgtatattgtttta

SEQ ID NO: 227448 - DNA, 954 bp, Homo sapiens
agcggagctgactgcagatgttgagagaagaggtaactttgaccaaatgcagtcatgacctcaggtgtgggcaagtccttgttccctacctggacttggctaggcctgcaggtcatacaggaagaacagtccctctgaaggtgaccataatccacagggcagggtgtggaaagtgacagaggtgaatttattaaatgacttggtcaagtccccacagctggtcactggcagaagcagcagaaacaaataggcagcattatctattctcccagtcaacaaacagcctttgagcccagctatgcctggcactgtctctgcagtcaagccccagacttacaatactgattttaagtccaactatataattagctggactacattttaaatatgtgtactagggaaacaggagggaccctatagtcttttatatgctcaagtgttcagtgcttctgcaggaggcagagagctaaaagaagagagaagtttgatgggagaaaataatttcctggttgcaaaagataagaaaaggaattcactcaggaactcaagaccacaaggtagacacacacagtctctgctcaagttttgccaagctctgtacagaagaaaccatgttctttgttttttcaagttccttttaagtgggataaaaaagtggattggggccaggcgcggtggctcatgcctgtaatcccagcactttgggaggcctaggcaggcagatcatgaggtcaggagatcgagaccatcctggctaacatggtgaaaccccgtctctactaaaaatacacacaaaaaattagctgggcatggtggtgggcgcctgtggtcccagctacttgggaggctgaggcaggagaatggcatgaacccaggaggcggagcttgcagtgatccgagatctcaccactgcactacatcctgggtgacagagcgagactccatctcaaaaaa

SEQ ID NO: 227449 - DNA, 343 bp, Homo sapiens
tgataagtcgaagaactgcaattaaaacccaggtctgtttggctcccactcctgtgctctggaatgcttaagggattagaaatgtcccaaagagactaagaatccaaagcagtagtgggtatggaaggtaacagcagtgatttcctaaggacctgggttctagccccagagacatggttaaaattttatagcagttgcctgctttttgagtctgacaagcctccattttactgtcaaaaatgtgaaattcataattaggcaataatgtgctgaagcctgattttatttggttattttatttccattaaagtcatcaaaagtgatttattgattacaaaagaaa

SEQ ID NO: 227450 - DNA, 485 bp, Homo sapiens
caaaaaaaaaaaaaaaagaaaagaaaagaaaagaattgccatgtgtttctaagtacagtacatggatcagatgcctggtctccacctcagacatcctgaacctaatgctcatgggcatataacagagaagacagtttgagaagcagtgccttaatatatagtgttccagaaaaacaggcacagtggggtagagaaaagaacacagcagaggaagtgatgaataatgcagatgggaaaagagagaaactcttagaacaatttttactcaccctaaggtcagtcctggacacagagagcaattagagaccatggtagagactcttggggtgaagattattacaactaaggccaagagtgagttttctccctatagcaccaaagaaacagcatgttcctcttttaaatatccctcccttcagccactatgtcagaaaaatggagctgcaattgtcccttaggtcttttccagcttccacaacccatgc

SEQ ID NO: 227451 - DNA, 396 bp, Homo sapiens
cctcttgaggattgaggtcccctcagctggggatacaagatagcaagaggtgagtttaagacaatggataaaagcaatgctagaggcatatgggagcaccagattctgacagagtgggagagaagtcttccagactgaaaactgaagaataagcaggcaccaggatgtggatggaaaatgatcctgagcttacctttcattcataatttccttccttctttggctatctatttgattcataagatgtttccaaggtcatttcattttcttattattagagtttaattaaatgataatttaacctaaatataatttcattttaccacgatgtttctagggtatctcagagtaaatgcttcttttgattgataaataaattttagatcttaagcaaaa

SEQ ID NO: 227452 - DNA, 358 bp, Homo sapiens
gcaaaaaatttgaagtaccccatgcacgtgttccagctgaggttgtgtggttgaacagtgcgatgccctgccttcttgtttcagctctcaactgaagcaagtgggctgtctaatgccaaacttcttggattttgtgctttttgttggtgattttgctttggccccaaacgtggtgctgaagtgctgtctagtattcctgagcacagaaggtcatgatatgccttttggagaaaatacatgtgtgagataagctttatttgggcatgagttatagtgctgctgagtcaatattacctattaaataaggtgtctttaaacacacataaaacaaagttatatattaatcagctggcaaaaa

SEQ ID NO: 227453 - DNA, 460 bp, Homo sapiens
gttagcaaaattcaataatatttctaataaatacttctagagaaaataggacgaagtgatatttctttaatgttatgtaaactctctctctgtgtgtttgtgtgtgtgtgtatttgtaatcaaaaggcagcatgaggctggatgtggtggctcacacatgtaatcccagcacattggaaggccgaggcaggaggattgcttgagtctgggagtttgagagtagcctgggcaacatagcaacacagtgaaacctcatctctactaaaaaaaaataaaataaaataaaaaaaaaaaatagctgggcatggtggtgtgcacctgtagtcccagctgctcaggaagctgaggtagaaggattgcttgaacctggaaagtcaaggctaaagtgagggggggtcatgccactgcactccagcctgggtgacagagcaagaccctgtctcacacacacaaaaaggaa

SEQ ID NO: 227454 - DNA, 632 bp, Homo sapiens
aacccaccaaactgtttttcaaagtgttgtatcattttgtattcacatcagcaattaatgagagtgtctgttgttccacacagtaaacagcatttagtgttgttagtgttctggattgtggccattctaatagctgtgtggcagagaggtggtggtattgcattgttgtcttagtatatttatttatatatatataatttatagacttatttatgagcatttctacaaaacaatgaaaacattaaccaagatggtatattctctatcctagtttttgtttggactgagcaatttttgttgtctattatgttgtaaaattattacaaataaccatatttgttccaaatcaaattaactgttagtttcattctttgatacctgggtcagcaaaatagtccttgagttattaagccataaaccaatatgcccactcttcagaatagtagtgttagaaatatttataaaattgctaacctaagggtggtcatattcagtaatgacaattttttaataaaattaaacatctatattaattttgtattggttttgtattagtctgttttcacactgccaagaagacatgacctgagactgggtaatttataagcaaaagttaattgactcatagttcc

SEQ ID NO: 227455 - DNA, 558 bp, Homo sapiens
tagggcaatgcaagggagcagctaacaacacagctcaagtcagactgccagcttcctgctcaaattcttcctccaacatctcccagctgggtaatcttggacacattgattaatctccatctccacaactttaaaatggtgctaacaaatgcgtgcactaatgaatattattattagaatggtggttggatgagtatattacatacaaaatgtttaaagaatatgtggctcataaaaagcactgtaagtttagctaaatattgtttcctgtaaaatagggctaccttattaggataagaggagattatataagataggctatgttcatcctggttctgagaaaactctcaaaaatacattagtctgtgctctttatttgatgattaaaatcttgaaaaagtatttgtaaatcagtgcatatttcacatacactaggaggggctatttaaaggaaattatcagggtaatgcaattattgttgtaaatttagattccaataaagtatttttttctgtaaggcacacctataataaaggaatatgaataattaaaaaaaaa

SEQ ID NO: 227456 - DNA, 1159 bp, Homo sapiens
gctacagtgcatatagtctcttatgtataattaccttgtttggtaatactcactttgacatgtgttaattccattattttttcatgatgtttaatacacatttttagtacaggttttgtcttggtaagagtacaatttatgaaaaggagaatggagaaggaaagggccagtaacaatgaaagatactcttcattagcccatgaatgttaaacgtagatatgcagaacagtttggaaacatgaaaatcttttagagattctgagtaagcataaattattaagaaaatcagttctctttgcagggacctctatttgtgatacagaaactacaatgaatgttattaaatgaaacttgtttcttgtgaatgtttataagtcattaaaaacacatgttcttgcttcccacagagtttctttagagggtactagttgtgcacatgtttagttctgtgggagcaacatttatagtactgggatgagagtgttgtgcaaatgaatcaacatcacttcctttagtaaagtggaaactcctttttcatttttcttttttcctcccctttggacaaaattttagcataaggctatatcctggtgtcttttttccccttttatataataagggcaaagagatagggtattacttttatgtcactggtttttatctaaaaataaaaaattctcagccgattgtatgctttcttcactttgtgttatggctgggtggagataatccaggtaaagcagcattttaatgttttttcgtcctaacatttgtggaagtatatgtagccctcaatttgtgaaagcggatggaatgtttagagatgtgaatttatatagtttgataaagctccctgggtaattctgatagatttccttcaaattgagaaccattccattaattaattcttttctgctggttggacattctagtcctggatgtagaataattggtaacaattttgatatttattcagttagaagaaggtcttaagatgtaattacctaattaactttgatatttgcctcacacacacctgtcactccatttttaaagctaatattttgattccctttgagatcttgagcaaattacttaaccttttagagtcctagtttactaatttgcaataaagagataaataatacctcatttacaa

SEQ ID NO: 227457 - DNA, 556 bp, Homo sapiens
gtcctttcatgaatacattgatctacttgttttacatcccatgttttaatttttttgtaatttaatattttgtgttatatatttttgggaatgtcacatcacatcatttaattatgtgttgattttttagtttatattataattgtatataacaatatattttttagtttataattgtatgtaacaatatttaactgtacaatttaagacagtgaagagcaaaattaaatatgaaaaagccatgtatctattgccaatataattgtttctgtgtttctttgcctgtataaatattatccctgtagctttgtgtcacttgtatatttgttttgtaggtatggtgtaacaggtttttggttttggttttggttttggtttttttgagagggaatttcactcttgttatgcaggctgcagtacaatggtgggatctcagctcactgaaacctccaacttctaggttcatgccattctcctacctcagcctcctgagtagctgggattacaggaatgtgccaccacacccggctaattttgtacttttagtagagacagg

SEQ ID NO: 227458 - DNA, 537 bp, Homo sapiens
gtcattttgcatggatatttaataatatgggaaaatagtcatgatatagtgttaaaggaaaaatgaagcaggatatattttatgattcatatgtttagtaacacataaaattaactgtgtgccatgtgctgctctaaatcttttacacaggggactcatataggaagattaccaatgtatgaccttgagctagtaatttagccactctaggattaatttcctcatctgaaaaatgaagacagttatatttgtcttactgatgatgtgatcgaatgaattaatgcttgtaaagcatcaaaaacaaagcacgtgcttaaacaaatgttcctttattatgttctagactggccatcctatagtgcagtagtgaggatttttaggttggtgcaaaagttattgctatttttgccaacacttccaattaatattttgctcacttggtttgtttgtcatcaagtgatatgttagtaattattgaacagtagtacatgttttaggttcattagttaacagagatagttgcctaaatcattatgt

SEQ ID NO: 227459 - DNA, 428 bp, Homo sapiens
ggttgtattttggggcatagcttctggtatttcattcaatccctgaggtcttcaaaggcaaatctttagatacctgcaactatgaactcaatctggggattttacaaagcacatgaaagttttccccaagcataagttatttgaaataaacatgcaacaaatgagcaagaagattacttgcaattaggtagtgctttatcctggggcaatggaattatgattgtagggcaagtaatatatggaatatagaaacttctattaaagaaaaatgtacaaatctcaaatgccccaaagaaatgcacagtaaaatcagacactccaattgagaagagactctacttagccactttgtgaatttgttacaagttgtgactctcaaattgctggataattaaaaatgggattaaattgcatctatttctacacca

SEQ ID NO: 227460 - DNA, 321 bp, Homo sapiens
ttcaagtgattctcctgcctcaccctcccgagtagctgggattacaggtgcacgccatgacacctggctaatttttgtatttttagtagagaaggggtttcaccatgttggccaggctggtctcgaactcctgaccccaggtgattcgcccatctcagcctccgaaagtgctgggattacaggtgtgagccaccacacctggcctgaagtatgaccattataaagtgtacatttcttaagtacaaactcagtggattttacatatgtatccacccaaggaaccaccacctaggtcaagatacagaacattttccacaccct

SEQ ID NO: 227461 - DNA, 424 bp, Homo sapiens
accaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaat

SEQ ID NO: 227462 - DNA, 409 bp, Homo sapiens
ggagtcaaggccaaaaggtcttataaataagagtgaattttgagaaaggatgtgtgaaaatgactctgttcttttcttttatctcacttcagttacttgggatggaggaagcagaaactgggagtcagacatctaaaatatgaagttccaccctcatgttggccatttctttcagcctcctttccccattcctaggggccaatctgtttctccctctcctgctctttctctttgcctctgtcttcttctttcctgtggagacaatagcgtgtggtggaactgcctgagtgcttactgagaaggagaaaccaagcgcagattgtacagaagctgacgaatgagtcctctgattgtggacaagtgatggcgctttttgtaaaattgtgtatgtgtttacctcaagtagtga

SEQ ID NO: 227463 - DNA, 699 bp, Homo sapiens
tccacaatggttgaactaatttacactcccaccaacagtgtaaaagcattcctatttctccacatcctctccagcatctattgtttcctgactttttaatgatcgccattccaactggtgtgagagtctcattctcattttttatggcccctgtgaaactttactttcttgccagctcaacaacttattttgaaatattttaaaaaataatttattcagcatttgtacttatttttaagataaggattgtatattatactgcccaaaatggaattcattgtatttcttcttcatttatttatttatttatttatttttgttttcattaatttaaaccacaaaaaagcaggagaaaatggtgtgggctcttttttctaaagaagtaatcattggacttataaaaataacacttgatatttatctgtctgtatacacacacatacactcataaacacgtatcttcataaaatgggttaagcaagtattaattgaggttgtttcttagtgttttttgtaatttgcttcactttattttctataatgagtatatattgctttttcaataagagaaactaaaatcattgtgggaaaaaggacttttttggaataaaaatacaattgaaccaacacacagagtatgtgttgaacatgtaactatcataatatctcatgtatatatcatcaaacctagttaaataa

SEQ ID NO: 227464 - DNA, 553 bp, Homo sapiens
catcttatggtggaagcagtcgctatgatgattacagcagctcacgtgacggatatggtggaagtccagacagttactcaagcagccgaagtgatctctactcaaatggtggtgatcgggttggcagacaagaaagagggcttcccccttctatggaaagggggcaccctcctccacgtgattcctacagcagttcaagccgtggagcaccaagaggtggtggccgtggacgaagccgatctgatagagggggaggcagaagcagatactagaaacaaacaaaactttggaccaaaatcccagttcaaagaaacaaaaagtggaaactattctatcataactacccaaggactattaaaaggaaaaattgtgttactttttttaaattccctgttaagttcccctccataatttttatgttcttgtgaggaaaaaagtaaaacatgtttaattttatttgacttttgcattgcttttcaacaagcaaatgttaaatgtgttaagacttgtactagtgttgtaactttccaagtaaaagtatccctaaaggcca

SEQ ID NO: 227465 - DNA, 368 bp, Homo sapiens
cggcacgagggagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggcctcaggacatgagggaaggccagttacatgccaagcgtggttcctggcatgtagcaggcactcaatgttcatttctttcttttccaagatgaaggtgatttttcttctgtgacttttgatgttatctgcctcccttcctaccctccatggctcaaaggctctaataaatggttccctactaaaaaa

SEQ ID NO: 227466 - DNA, 547 bp, Homo sapiens
catagttacacaatgtaggaatgatatttgtgaagtgatccacatgcccaagaaatgcaaatgcaaatagtgttgttagcatttatattgaaatataaaatctaaagcagcttaaaataagctaagctaaacaaactgcaagaagctaaatgatttaaacatgttaaagttttaaagcactagctgtaaatattaatcttcagattttcaatttaacatgtattcacttacaaactgttctaataataacactaattattttccaagtcaccatttaaagttttatttacagttgacctaatccaattgaagttgatgaaagcttcaacttattttttaactctttctggtccacgatgcctggaggcaagtgaaatatatatgacaaataatagataaaccaatttattttctgttagtgtatgtttattttttaattattaataatgtatattgtgtgtatatatgacggtgtatgaaagttggcaatgaaagctaatacaatcatgttagtcggctggatataataaagaacaagaaaggaata

SEQ ID NO: 227467 - DNA, 455 bp, Homo sapiens
gagtaacatcacagaaggattgagtaggatactggtttaaccatgggcataacattttttttttcagtattgaagagtaaagctaaagtttgttcactaagatgtttaattcaagccccagtaacagagatacacaactgccaaagtcagctcttaggggtgttgtaccaggaggtggtgtaaacagatctggacccagagaattagaaagaaaaggcagaatgaagttcacaacagcagctgctacatttaaaaatgttagagctgttttacaattattttcacttccctagctttctgagcctgtaagtctctcttccctatttcaacattcatcctaaagagttttcaattagtatgtgaaaccaaaaggtcagagtgttttagtctgatacaaatcatccctaactaaaatgattccagtatgtgcttccatttcattaaaactgttctgt

SEQ ID NO: 227468 - DNA, 173 bp, Homo sapiens
gatcattaaggcttagctattatgctgaataggccagatattacctttaaactaaacattgatataagacctgccttggctcttctttaagagctgcacttggatattatccccttggtaaaggtagtaagaattaatacaatatttgggagattttcctcattgtaaagtcc

SEQ ID NO: 227469 - DNA, 555 bp, Homo sapiens
gcattgagaagcccatgttgtagtgagaaaaatagacaagattcagaatgctctgtaccagagaagagtcttgtgagacatgctacagaaactcaaatgacggactggctccccacatttagtctggggataaaggcagtgaactgttggagggtcacagaagagatcacattcaaatgggggtttgaagggtgaataggagttcaccagatacagaaaagtgggaaggaataatgctaatgaagtcatgcagagaaaagagcaagcagaaaggcgtagaggcctaaatagcctctaaaatagcccaaatttgtttattttggactccatttaaactacagactttcagggctggaatagatttttaagattgctggaccctctcatttataaccaaggtgtatttaaaagtaagcatttagggatatttttcttagccaacttctttttatacaatccattcttctctcattaaagatgttacattttctagaaaagaatagactcacataattttgctcatgttcattttgatcctgagtttcagcatgatac

SEQ ID NO: 227470 - DNA, 443 bp, Homo sapiens
ctacaagccttccttagaagcttagtaatttccagcttttgatttaaaatgatagacatgcaactaactctttcacttgaacacttggaggccattttagggttattaatttgcccgatttcaacgtgtttcaaggaatagggagggctgaggagaggtagggaaacagccagtcagtggagccgtcagagcacacacaacacttgattaagtttactgtcttatatgggcacaatttgtgacactctaaagcaattacaatggtaacatcaaagatcattggtcacaaatcaccatgacagatatgtaataatgaaaaagtttacaatatttcaagaattgccaaaatgtgacactgaatgctcatgctgtaggaaaaatgatgcttatagacttgctcacagcaagattgccacaaaccttcagtttgtttaaaaaaaaaa

SEQ ID NO: 227471 - DNA, 299 bp, Homo sapiens
gatggagatggggtcttactctgctgcgcaggccgaagagcggtgaccggatcacagctcactgcagcttcaacctcctgggctcaagggatcctcccacctcagcctgcagagtagctgggaccacagccgcgcgccaccacaccgcgccaatttttgtgttcttggtagagaccgggttttgccttgttgtctaggttgggctccaactgcagggctaaagcgatccaagagcatcagcctcccaaagtgctgggattacaggcttgagccaccatgcccgccttatttcttaattt

SEQ ID NO: 227472 - DNA, 359 bp, Homo sapiens
taaaaaaaaaaaaaaagtttaggcatttatagcactgtgttgcgcagggtttatcttcctaaaatacaaatccaaacttatcacttgcttaaataatcctttagtagtatccatgggttttaggatgaaatccaaattctttttatttttgagatggtgtctcgctctgtcacccaggctggtgtgcagtggcatgatctcggctcgctgcaagctctgcctcccaggttcacgccattctccggcctcagctactcaggaggctgaggaaggagaaatgcttgaacccaggaggtggaggttgtggtgagccaggctctcgccagtgcactctagcctgggagtctagtgcgaaacta

SEQ ID NO: 227473 - DNA, 1404 bp, Homo sapiens
ctacttctaaaatttttttcatagatgggattttcctatgttgcccaggtggtctccaacacacaggctcaagccaaactcctgcctcatactcctaaagtgctgggattacagacacaaggcatgacacccaaccgaggttctccttgtagagtaaggcctgttaagtggatttatcagtctccctagttcatgccaccgaaacaaagaaacaaatttaccgtgggcctaatctgttttaaactttttcctcaatacgtagcaatggattatcaactgctcgatgcaggattttgtcactttatttcttttgtgaaaggattacatatagtgagaaagttgtcttatttgtctagctagatatacattattggcctgtgtgatatgctgtggaaaacaatcttaaacactctggataagatgagaataaatgactccactgaaatagaagtctatgccttttaaagtgaattagtacaaaaacatttgctgtggatatgatcttaaaggattgttttaaccaagtttgtttctatttcattacagagctggagctagtggaagtgagatagcacttgtgctgttggggaaaacaaaggatatgtttaatccgaattagtggattactttctagtgtatttcatagtgttagagtctaaagggtatgtgatagtagtcaggagatcaggattatgaaactggggctgccacttgtgtgaccttgtgtgtgatacttgaatgctgtaggccttcatttcaaaagcgagggggttggaatagaaacctctcagaccctaaatgtgtaagactccaattctgtggctaggcctggtaaggtaaagagtagcagaatatatcaagaactggaagggattagagagacctattatctaaattgctgtccctcctttgccccttgccttcccttttttttttttttggtgaatttcatatgtaaatttaaaaaatgcagattagttataatcacactctgtttattataaatttggtcacatctaagtgccatggtggtagttactccttccatctctacttctgcatgggaaacattttgctcctttaactttgaaaatatgagggtgtaaatatacaatactataagaatggtgcttctgccaggtgcagtggctcatcctgtaatcctagctactcgggaggctgagacaggaggatctcttgaggccaggagtccgagaccagcttgggcaacataacgagaccatgcctctaaaaaaataaaaataaaaaaattagccggccatggtgatgcacacctgtcatgccagttacttggggggctaaggtgggaggattagtgagctgtgattctgccactgcattccagcctgggtgacagagtgagaccctctctcttaaaaaaaa

SEQ ID NO: 227474 - DNA, 393 bp, Homo sapiens
cagcttccttcctgcaagtaagctggatggagaagctgcaggtaagctggatggagtgaagtctggttgttacttctaatattaacatgctaatcttcctgaaaacaggaagcaacaaccagacttcacttgtatctttcattaggagtgtttaatacatcacaaaaacaaagatgcagatcggaagatttatgaatttgatttgagaagccagtttggcaactttcatggccttgttcagaacaaccacaccactgtgccttaatgaccaccactgccactcaaacccgtagaaagtacaggtgttttatccttaatacatgagtgttatgttgcaagttagtttgtttaatggctgtaaataaagttatttcggctcagtaaactgtcaga

SEQ ID NO: 227475 - DNA, 449 bp, Homo sapiens
gagcctcctgtgagccgaggctgagagggccgcctattaccctgtttccaaacaactcccctttctgcgccagcgccgctgcctctcccgtctgtttgcccctcgccgcctcctccctctgttggggctgccgctgatgatgaaatttggcttgcaacaacctcttcctccccttcctgcaggcctgggagaggattaagccgctggagtctgaaatcggaaagatcccagcttctgctccccagcacctcccctcgccccctccccctccccgcccatgcaaaactagaaaattaatctccccttctgcctgtgatatggcgggctgcattacaagctgggcgtcgagataaagcggggagccgcgggacggcggcccagcgccggggccccgggtggggccggccagggagataagggcctcccagccccatgaattattcaccggc

SEQ ID NO: 227476 - DNA, 415 bp, Homo sapiens
ctggccccattcttgattgaagtgtcactctctcaatgaagctgccttcagcttccctatttgactgaggcagggctaggaccagggtgaatgtacctgggagtgaggtcctttcttaaggcataaaacttaagagaggcagggtgaggtggctcacgcctgtaatctcagcactttgggaggccaaggagggcagattgcttgatcccagaagttcaagaccagcctgggtaacatggtgaaaccccaactctacaaaaaacaaacaaacaaaaattagccaggtgtggtggcgtgtgcctgttgtcccagccactcaggaggctgaggtgggaggattgctttagcccgggaggctgaggctgcagtgagccaaaatcacaccattgcactccagcgtgggtgacagagtgag

SEQ ID NO: 227477 - DNA, 210 bp, Homo sapiens
gtagcattgttgaggatcagtgatgactggcttgagcaggggtctcccacccgcctgagagcccgtggagcacaggaactagatcttgtgccctgtgtccccagggcctggcacttagtaggggatcagtaagtgagtgattaatagggagagtggggtggggtttgtgtgaagcaaagaactggtaaagctattctctctgaagaggcc

SEQ ID NO: 227478 - DNA, 541 bp, Homo sapiens
caaaaataaagttgcttttaggattattctccatacatttttcttgttcaatgttcctactacacatggagtaaactcccataagaaagtgctagtgtaattaatgtagttgtcttgcatatgttttctttatatatagatgcaagttgcccatagaaataggtaagatagaaatatagatatataggtacagatatagattttccccctcaacagaccacattcctgaatggttgtaggtgattgggcagggcctggtgacagttttgcaacaggatatagggataaagaacaagcatgcagggaactggagaccctcctttcacccaatagtatctgaaaaattaaaaagagtattggccagatgcaatggctgacacctgtaatcccagcacttttagaggcaaagatgggaggatcgcttgagttcaaatgtttgagaccagtctgggcaacatggcaagacctatgtctacaaaaaattacaaaaattagccaggcagggtggcttgaggttgcaattccatataaaaaaaaaaaa

SEQ ID NO: 227479 - DNA, 206 bp, Homo sapiens
tcaggagagggctgcggctcaggagcacctcaaaaaggaagccgtgatccggatcaggaaccaccaagaggtcaggatgaggcgtggcaagatcttgacaagtgcaggggcccagaagttgggctggagtgagttgagaagtgatgggtgtgaggaagtggaaacagcctgtgtagacatcttctcaagattgcatggctgtggag

SEQ ID NO: 227480 - DNA, 398 bp, Homo sapiens
tctctggcttccttttttttttttctggaaaaacataggtctcataagttcattttttatattcccacacttgaaagagccataagtacaaataaatgtttctttaggtgcaaagatatatgcttactggcactcagcatcactgttggaagcagtatggagtggtggcagctatggcaaacaggagcactcagacgctgcatcaagggagcagctaccactgctcagtttagctggttgttttgcctgcaagtatgggcccagtatggccagatctcctagtttttcaataaaagctagaaatctgactcttctttgtgaaatatcccaattttgaggtgttgacaataaataaataaaaataaacaaaaatatattagaaacttgaccaagtgaaa

SEQ ID NO: 227481 - DNA, 496 bp, Homo sapiens
ctcagctgcttcctagtttctaataagtcaaataaaattcatttccccaaatggtgtcagccaagcagatggggtaaaatgaaagaatacagtaagaaaaaattttcttactgtattttctaccttttattttaaccttttgaaaatacgacttttagccatttccaattgttatcagattattaatctgcctagaaaaaatttttacccaaagaaaaaggtatttatcatattttctacagaatgtttgattaaaattttggccaagcgtagtagttcatgcctgtaatcccaacattttgggaggccaaggtgggtggatcacctgaggtcaggagttcaagaccagcctgaccaatacagtgaaactccatctctactaaaaatacaaaaattagctgggagtggtcaacagagcccgggaggttgagattgcagtgagcagtgatcgtgccagtgcactctggcctggatggcagagtgaaacactgcctca

SEQ ID NO: 227482 - DNA, 395 bp, Homo sapiens
gggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggcaaaaaataaaaaaataaaaa

SEQ ID NO: 227483 - DNA, 926 bp, Homo sapiens
aggcaggggtattgcttacagccaagagttcgagaccagcctgggcaacatagcaagaccccagtctctgctaaaaatgcaaaaaaaaaaattagccacggtggtagtacatgcctgtggtaccagctactcaggaggctgaggcagaaggatcacttgagtccaggaggttgaggctgcagtgagccctgtttgcaccactgcactccagcctgggcaacagtgaggccctgtctcaaaaaagaaaagaaaaaaagtagatttgggtaagcaaacaggtgtagagagagcatgctaatgggcagtgccatggaggcgggaaatgcagttcgtacctggcagtagtaaagtgactgggtcagactaactcagggtttctcaagtactattcacgttgacagctggagaattctttgttgggcgtgggagggactgtcctgtgcactgaagggtgtttagcagtatcccttgttttccccactagacgccagtagcacccaccacaggcgcggcaatccaaatgcctccagacattgccaaatgtcccctggcagggagggaatcacccctgcttgagtatcactggtctagcttgaggggaaggtgagaagggtaaattcagagccaacttggatcagccatcagatctgcacttaacactgttaaagggttctgtgagtacgggctgacatgtaaccaaagtgaaaagcttcccccatccccttcagagagatgaaaatagcatagagtctggagtttagagcgacttgggtttgctttttttttaatatataaaatcttttaggccatgcacagtggctcacacctgtaatcctagcattttgggaggccaaggcaggaggatcacttgaggccaggagttcaagaccagcctgggcagcaaagtaagaccctgtctgtaacaa

SEQ ID NO: 227484 - DNA, 486 bp, Homo sapiens
ggtgcacagtcagcagcgggacgcggagactcggctgttctctcgcgcttcttgagcgggtgtttggccaattgtaaatttccatgtcgccacccgactccctggggtttcccagggctcagaatccaaatttggtttaggtacgtgggtgccgaatgcaaaacaaaacaagcaaaacaaaaaccagcaagtgaaagacgacctaggacccccctgggggccaccctggagacggtcgtcaggcctcggaaagagctccttcctaaatgatttggagtatgacttcaaggaagtctgcttttctgctactctgacagctcagaaagaaccccctcggatccctgtggtttcgtagtagcttgttatatgtgattaaattggaggccccttcctcagatggaactgggttactcgctctcggggtgcccctcgtcccagggttgctctgccctgaggagcgccaggctgtaagtgaccagccagcca

SEQ ID NO: 227485 - DNA, 339 bp, Homo sapiens
agcttcaggatgggggctggtcaaacatgacgccattatttgagggttagaaatttcagctcttgtccccaacctatggggaggaaagaggcagtggagattgaattcaatcaccaatggccaatgagttaatccatcaagccaacgtaatgaaaccttcgtaaaatctgaatgagagcttctgtgttggtgaacacatccatgtgccgggagggaggcatacctcaactccaaagaggcagaggctcttgtgctcaggacatttttggacctcatcttatgtacctcttcatctggctgttcattcccatcctttataataaaatatagttccaagta

SEQ ID NO: 227486 - DNA, 817 bp, Homo sapiens
gaataggctgagcctaggaaagctatgggagctgagctgcctgaggccttaggggtccaacccccacccagtgtgcccaggatgcagaatatggagtgaaaggaaattattctccaactttaagatttaatattgttctccctgttgggttttggacttgtttcagatgagttatccctcttttcttgcctatttccccattttagaatgggaatgtctcttctataccttcgcacattgtattttggaagcagatagcttattttgatttcacaggctcgtggttgcagaacatttgccttcaggatgaagtcacacccatatttgatttagataagtattacctagataactcgattaactagatttagataagtattaactaacagtattaagagttaatactggagtgacttttgagcctactaggatggaatgaatatattttgcattgtatgaaggatgtgaatttggcagagaggggagggtaggtgcagaatgctatggtttgaatgcctccaccaaaactcatgttgacatttaattgtgaatgtgacagttttaagaagtgggatctttaacaggtaattaggtatctctttaggcactttcattagacagggccctcatgaatggattaatgcagttatggagggagtgagtttgttattgcatgagtgggctccttattaaagggtgattttggctcagtttcctctctgtctcatgtgcttgctttcacttctacccttctgccacaggatgacccttagcagatgtcagtgccatgcacttgtacttcccagcctccagaact

SEQ ID NO: 227487 - DNA, 660 bp, Homo sapiens
tgtatttgctttccatattacttatggagatgtaccatcagggtaacttcctggaacttatacctggcatgtctaaaacagggcatcattttcccaaaactttttcactttcttttgccaatattgaatggcaccattatctgtcctattacttatgcagaaataaaggtatcatcatttcttctcataactagtttgtcagcaaatgcaaattatgtattagcctttcatttttttctatcttcattttcttatagatcttcttagttggtttattatactagcctcctaactagtctcatttctttcctaatactccctactgctactagatgtgtctttcataaagccaaaggtgtgttcatttcacccagaccttcctttgcccagacgttccatttcctggcctttgcctacttctctagcctaatctctaaccacttctaaccataccaaactacttgtagatttcccagacgtattctgtcctcttttgcactggaatgccttttttttaccttctacatttctttctttcttttttgtcttttttttaccctttttgtggagaatggggtcacgcttgagtctccaaggttgagtttgccgtgatcctgccactgcacttcaacctgcgcaacagaaagagaacctgtctct

SEQ ID NO: 227488 - DNA, 949 bp, Homo sapiens
atctgacttttttcttgtttttgtggacagagagagatctccataattttgagatactctatgttaaactattttttaagttctctttttacatcacgtctgaaatgcacgagagtggcggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatgtatgttttagggttgtgtttttcattactgtgaaaaaagaacactggaattttgacagggagtttattgaatctagagatcactttggataatatggcagtttcacaatacttattctttcagtagaaataaaatatttttaaatttatttgtgtcttctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgtttttttttatatataagattacatggtctaccaacggcaacgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggccccccaatgtgatagaatgccctctgggtttgtggtgaagaa

SEQ ID NO: 227489 - DNA, 716 bp, Homo sapiens
cattgtttcccacagttcctctgtgtaggctgatggtcctacggaggtaaatagttagattaatctgatctttggtatcactgtatcccaacagggaccaggaagatcatcatcatctatgtggcagactaaaaggctgttaaatatttgtatatagagagaattaagtatcatactaaaatacaaactttgtgattaatgagtgaccctctgatagctactttacaggagcatcctaaacatttctcagcattcatctcatcacactttcgttcattctatgtaactgcagccaatcttatattccacagtcctttacaacaactctttgttttgagctttattatagtggaggtagacttttatgagtattttgtcaagagcgagccagggaacttccatattatcctttcaagagaattggcttccaaagtgacttttcaagagaaccagaagggtcatcccatgccttagtagtagagctaaactatcccagaatagaggctacttcaaacctaccctaaacacgtttaaaaagaagccatgaaaggatcaaacaaatctgattttccagtaacttaactgtcttctaacgaagccattctttaagggaacatggcaaagttcagatacttaactcaatgtccaccagccaataaaaaattactagacatgccaagaagcaggaaaatgtgacccataacctagagtaaaaa

SEQ ID NO: 227490 - DNA, 457 bp, Homo sapiens
cataagaggtcacgaattctaaaaactaataatacttaaataaattacttaaaattacttaagtattaaataatacctaaatatatttacaataataatagtagtagtagaagtaatgccatttccttattaagtttcccattttaaaaaataccttaaaaactctgaaatttttcttctgaaataaataagaggatagatagaattattctcatttaccagacattaatttttaaattgcccgaaaaatgccttttctacaacttttttttcataactgctttgataagaagaatcacaatctgtttggaagtttgctttgctcaatgtcataagttggtttacaattcaatcgaatgccctggtttgtcacaggagctcaccaataagcaaaacagccaagccttttgaagactaattagaaaaagtacaataaaattaattcacacagcacatg

SEQ ID NO: 227491 - DNA, 429 bp, Homo sapiens
cttttcttcttttctcttctcttctctttttttttctctctctctttcattcacattatagcttgagtcagaacttcattcctttttaaggctgaaggaccacattttgcttgtttgttcatgtgatcgatgatgatggacacttaggttgtttccactttttagctatcgtaaacactgttgctaatggaatatgggtgtacaaatatttcttcaagatcttgctttcaattcttttgggtatatacccagaagtggaactgctgcatcatatggaatccattcccagggaaattctcaccacatagcacatgaacacaggtgccaggatgcagctgcaccttcctttgtggagcaaaaacttggaaatatccttaaaagtgattaagtaaatcagagtatgaactgtgctctggagtgcaagaccgc

SEQ ID NO: 227492 - DNA, 422 bp, Homo sapiens
ctaagactatttgctttttaaagttaatatgtgatgattacagatttatttttccattaattttcagctaggaatacagaagatatatttcgtcccacataatctgctaactctgtaggagattggtagggaaatatgcatgctacttactgtggcatttctgaaagaaccagctttcattattttcctaaccagtcttcgcctatcagctaccactttggctatatatatatatgtacaactgacttcttttacatttaattgtactcatgggagtctattagtgactctaactttaataagaaatttctaatccacagtagttgtttttttctgttttgtttgcttcgttaatcatattcagtatatataagctaattaaataaataaaatttctatacagtagttctaaagcttaaaaa

SEQ ID NO: 227493 - DNA, 382 bp, Homo sapiens
aaacagtatggcaatctcagggcagcattctttcttagatatggaaaacagaagctacaaggtctcttaaagcctggcttagaagtccccaacctcacttccaccacattctgttggtcaacgaatttattagaccagctcaggtccaagggctagcgaaacagactttgtgcattgatgagaggtgtggcaaactcacattgtaagagcgtgtggaaaggaagcaattgtggtggccatctttgcaaacaatttccatgagtaagaggcataatatttcaaagatccaattaagtatttgaaaaaaaaaatgacaagttagtcacggagaaagcattcaacaaatagcttcttgaccattttgactaatgtacataatgcg

SEQ ID NO: 227494 - DNA, 203 bp, Homo sapiens
gactctgactaccattctatgagaatctaccaaatgattccaaggaagtatttcaacatagaggaaaaggttccctttgctttctcatcttaaactctaaaaaaaaaaatttttgagacagtctcactctgtcgcccaggctggagtggtatgatctcgactcattggaacctccacctctggtgttcaagcaattctcctgc

SEQ ID NO: 227495 - DNA, 877 bp, Homo sapiens
agctatatatttatgcaacatagattgaaagcttacatgccaggcacatagtatcattgagctaactatactgagtcatctgtttatctatctttttctcctggaaggcaggggctacattcttttaatctttgtatttctaagaccaagaagaatgtctaatacataatagacattcaatgtttgtggaattaacatagatatgaggtaacattgctgtcccttgcagtctaccaaaaaagctggttttatgctgatgcatttgctgatgaatgcatcagtgacactacatttacatccatgcatttatatatgtatgcattctgcatttgtataatgctttaatgtttttggaaggcactatctcacattttgtattacgttgtcttcctaatatctacttgagcctgtgtgcccactgaagagatgaagaataaaagcctaagctctcatcaaaagttggtggaagagtcctttctagaacttgaatcgcctgacttttccaccactcactcttcctcggcagtatggtaatttcccatttagcaaaaaatatactgtgtgggaagcatcacatcgtctggtgtttttgaagctccagtaaaatgagtcactgcgccatcataggaaaaaccttgaaatctttcccttcaggactaagagtaaagcctcattatgtaacttcaaactctcccgagggatggttagtaagtcccagatgataggatcaaaacaggtaaaattatatcgatgatgctgatggaacaaaagcatgcaaggtaggcttctcaaggtctgatgtttaggccactaggatcacaccttcatccagtgtcaaatacagtcagtcatttatctgtctcattttttaggcaaa

SEQ ID NO: 227496 - DNA, 332 bp, Homo sapiens
aattcaaaaactcacagaccaatgccagggtcaaccagatctacatgtgattttaatgggttatttttaggacatcataaggaattcggaatccttgaaagtggaatgcgtgatgtccatcagtgacttcagggtttgtggagcaaacgctatggtagcaccgggaagaacagtgggtgagaggtgaccccaaagttcaggaatattgcttctgaccccacttcctcagctagcacgtctggtgtgtcacagcagagtccagcaaaggtaaccaacaacaaagggaaaactagacacagttgcctggaataaatacgaaaggtaagaacaaa

SEQ ID NO: 227497 - DNA, 370 bp, Homo sapiens
tcaccttcccatccttgctggcttttgcacgtgagtgggcgagaacgtgcagcccttgtagttgggaggcaagaggggagagaggagagaaaaggtgggaggaggaagggcagaaaaggagtgggtaaaggacataagttggatcatgggatccaggagtcacaaaagaaaggagaaacatgctcccagctttgcagagagcactaaaggaaatcaaaataagacttcccctcattgcagggcagcctgctagggtgatgggaatgtataatagtttgacctgggcagtggtgacacaggtgtacacatatgtgacaattcactgagctgtcaattcagatttctatattttactaattttaaaaatatc

SEQ ID NO: 227498 - DNA, 377 bp, Homo sapiens
atttagccatttcttttcttttcttttcttttttgagatggagtcttgctgtcacccaggctggagtgcagtggtgccatctcaactctctgcagcctctgcctcgtgggttcaagcaattctcctgcctcagcctcccgagtagctgggattacagatgcctgccaccacgcccagctaatttttgtaattttagtagagatggggttttaacatgttggccaggctggtcttgaactcctgacctctggtaatccacccaccttggcctcccaaagtgctgggattacaggcgtgagccaccacacccggcctatttagccatttgtatattgatggacagattgtttctagcttttgctattacaaacagtgct

SEQ ID NO: 227499 - DNA, 688 bp, Homo sapiens
tacttaacctctctgttcttcaatgtcctcgtctgtacaatgaggataataatagcacctatcagatagggctgtcgtgttgttgtgctataaagcacttcctgccagacaggaagtctctgtaattattagctgttgtgatttttcactggtgttatcattcctgggacccagtctaagttagtagccaagctaagtgccagcccaagattctgactccagtgcagcctttgtgatggtctttgtgtccctggcaaatgagcggtcactggctgggtggccaccacattcacagacaggtcaggtttcaggctgtggggaggagcagattcttacttggaaattaaggcctttgccttcccctatggatagaactggtgaataggttttattcccttagtgagctcaaagaaataagagtatagtcccagacttccactcttctggttttagaaaaaaaaaaacccaaaccctcagtgtctcctaattagcttgaggccatcaccccatgagaagcagggggattcaggacagtttaactctttactgccttactaaggagatcttgatctaggccagtgccctccaaacttctgtctttcatgtagctcatttgtgatttgtgtctacccccatgccaccttcattattattttcgtagggttttcttttcattagcttatctgtt

SEQ ID NO: 227500 - DNA, 405 bp, Homo sapiens
tgatatattgccttatgagtttaaatgaatataccttattattttaaactgctgcatagtatattaacatgaatatggatatatagatatactatatagtgtactgtatagtatctagcttatccatatgaatatattttaattcatttaacaacttcctgtctttagatttcctacctttccgaccaataagtagttatggactactgaatatttgattaaaaaaaacaacttgtaaccaatattaatcattcagaatggtgactaatatgtcaattgaaataacataatattaaagcaaataatccctgcccccaggttataaaatggaacattactagtttttagaaattttctttatgtttctttctgacataattccctcttcccttctgtcgtcttctc

SEQ ID NO: 227501 - DNA, 713 bp, Homo sapiens
actcagttctgaccaaggagctgagatgtgatggctggagactcaacaccattctggacgccaaaaagagctggccttggctggaaggttctggctaggaggagagggctaaagcatgcgaaggcacaacaatgatggaactgagcgaagaagatactctatcccacttcagtgaaaacatcatgaggcttgaagcatggaagttgcctcacccccgtgtttcctgccaggtggaacaaagtgctgagagaatcaaaccagcaagcaaagagaagaggagcaagagatggaaagtgacctctagcatgcacatccctaagccccagctgattatatcagccggcaaactcctcttgtgacctaggctagtatgagtggaatccctgtcacttgtgaccaaagcagtcctgacccagaaacgcagggactggctgagggcagcccaacattggtggctgagggtttagaccatcacactccagaaagtcagagtcacggaaaatctttgcccaggaaggcaacaggtatataaaaagatacttttagagagatctggctgcagtgagagcaatgggctggatggggccagggctggaggcacaggtcagagtcttttgaaatgtgctgacaacgcccagatctccatctccagcccttagggtcggtgcctggtagggatatttactggaatccgcattaaagctcagatgtca

SEQ ID NO: 227502 - DNA, 1368 bp, Homo sapiens
tattttactctatccctgcctgtaagaaaggcttcctagttcccacaggattttaaattgtgcaaatcggcaggaaagactctatccccaggcctaggaactgagggtggaaagaggctgcagaggccatggccatccattgtcatgaccaaacagttgccagcatctggctgccagtgggggatggatgcactggtccctgccctcaaggaaggcacagtctccttggaagatgacacacaaagaacagtttaacacattccaagctctagaaacatactgcttgtcctgccatctgctccctgtccctcccagcttggcagccggggcaagttaccccacctctttgtcctttggttttccctgtggaaaaatgagaaaagtcactgtggccaggagtgtcctggaaacagcttcatggagatgggaggaggacagatgtctggagaatcagggttggaccgtgaggataaaacttaaggacagggataggaagagtatttgggacatttgagctaagggacatttccttttgtcttttgaagccaaaaagagctggccttggctggaaggttctggctaggaggagagggctaaagcatgcgaaggcacaacaatggtatgttatgtattttatatacatccagcaaccccgccactccccaggaaagccacatcttcaccccaagcatgcgttctgaccccaccttcctgaccgtggccagctggcccaggaagggtgcctgtaccaagttggtccaatcagagttcttcctgggatttttctagatggaactgagcgaagaagatactctatcccacttcagtgaaaacatcatgaggcttgaagcatggaagttgcctcacccccgtgtttcctgccaggtggaacaaagtgctgagagaatcaaaccagcaagcaaagagaagaggagcaagagatggaaagtgacctctagcatgcacatccctaagccccagctgattatatcagccggcaaactcctcttgtgacctaggctagtatgagtggaatccctgtcacttgtgaccaaagcagtcctgacccagaaacgcagggactggctgagggcagcccaacattggtggctgagggtttagaccatcacactccagaaagtcagagtcacggaaaatctttgcccaggaaggcaacaggtatataaaaagatacttttagagagatctggctgcagtgagagcaatgggctggatggggccagggctggaggcacaggtcagagtcttttgaaatgtgctgacaacgcccagatctccatctccagcccttagggtcggtgcctggtagggatatttactggaatccgcattaaagctcagatgtca

SEQ ID NO: 227503 - DNA, 420 bp, Homo sapiens
gttttattgtggcttatctgattgtgatctggcatttttgccttctgagttggcgaggttgtgcaaagctgactctttcttcaggagtgctggaagtggttgaggattctatgtctaggaagctccagctataattcctgtgatacagttctccagctccaatttagccttccagtttcctttatcttgcaggttcactttgcccagggtgagatttttctttagtctttaaggtagttctataacattttaaccagaactgcccatgctttattgaggatatttcatagacacaatttcattaattccactggggtctcagcatcctgtctttccaactccttccataaaatgcagtagaccctccaaatcatcagatttcacatctgaggatttagccagccaaggataaaaagtatt

SEQ ID NO: 227504 - DNA, 849 bp, Homo sapiens
ccccaacaaactggggcattcccagttaaactgtttgttcctcagggttttcaaggacaacaacccctacagaaaataccaccacttcagggagtcagccaattacaacaatccaacagctgtcccgcgccacagcaggcagcaccgcagtagatttatgttccacccaaatggtctttttactccctggaaagcccccacaaaagattcctagaggggtatatggcccgctgccagaagggagggtaggcctttgagggagatcaagtctaaatttgaagggagtccaaattcatactggggtaatttattcagattataaagggggaattcagttagtgatcagctccactgttccccggagtgccaatccaggtgatagaattgctcaattactgcttttgccttatgttaaaattggggaaaacaaaaaggaaagaacaggagggtttggaagtaccaaccctgcaggaaaagctgcttattgggctaatcaggtctcagaggatagacccgtgtgtacagtcactattcagggaaagagtttgaaggattagtggatacccaggctgatgtttctgtcatcggcataggtactgcctcagaagtgtatcaaagtgccatgattttacattgtccaggatctgataatcaagaaagtacggttcagcctgtgatcacttcattccaatcaatttatggggccgagacttgttacaacaatggcatgcagagattactatcccagcctccctatacagccccaggaataaaaaaatcatgactaaaatgggatagctccctaaaaagggactaggaaagaagtcccaattgaggctgaaaaaaatc

SEQ ID NO: 227505 - DNA, 693 bp, Homo sapiens
atgcgtgcccaccccagcgtgtgggtgagcccagggctgtgcccagcccagctcttagagaaccactctgaggcctccctagacagagtcgcaggagccgtcctagaggggtgggggtggtgatgggatgagaagctctctgtgggcctctgatcccctcctttaataaaaggagctagaaggccccctcctcagcaccccaccccccagcctcagcacccaaagcatccattattccacccgatgccccctctagttctgcggggtgagtgcgctgagcacatcttacagagggcaaactgaggctggggaggagaaggggggttgcccaagggcagagctggtgaggtcagaagcagaattgcaagccggggcggtgggcccccaaacctgtgttctctcaggccgcccacccccatctgccgggctggggtgtggaccccgaagcgtgccccgggccccctccaccccagcacccaagggcctcccggacccaaagccacctggcggcgctcgagggggcgcgcgtgggagcgcgcacggtggcccgcgcctccggccaagatgttccctctccgcgtgattgacaggctcgagtgccgagaaacaaaattgtttatgcgctaatgaataaggccctgattgcaagatcctgtttggaaaattatagtgcggcggcggcggcggcggccg

SEQ ID NO: 227506 - DNA, 444 bp, Homo sapiens
gaaagggccccacgtggttcgaccggcaaacgcggggcggattttctggtccaccatgtttgcattgtgcggtgaaaaataggagtgtttctgggccgcgaagatgaaagcgtccactggggccgatttcggctctcgggctgggtgtccgcctccttcccctggcccagagttgctggccgcccgccagcgcgcttcgtcccaatgtgccgcgcgggatccgggtttcttgggtgtattcatgtccaccacgttaccgttctctctgcaaatccttcctctttttctcctctggccttcgcgttttcatctctcccgccgtcagtgcctcggagactgattagcctgtggaggccgacgttgggttttttttatagttttgcgttgttgaaaattgcgcttccaagtgacacctaataaataagtacattttggttttgctgt

SEQ ID NO: 227507 - DNA, 428 bp, Homo sapiens
aatggcaaagagaaaaatatggtgcacaaataagagcacccctggaccaagcaatggctctgccaccaactcaatgcaaaatctggtaacagtcactgtgttagtcttttcttgccgtgcaataaaaaatacctggctggggccgggcacagtggctcacacctgtaatcgcagcactttgggaggccatgggggtggaccacctgaggttaggagtttgagaccagcctgatcaacatggtgaaaccccgtccctactaaaaacacaaaaattagccgggtgtggtagcacgtgcctgtaatcctagctactcgggaggctgaggcaggagaattgcttgaaccccagtggcacaggttgcagtgagccaaggtcatgtctttgcattccagcctggacaacagagcaagactctgtctaaaaaaat

SEQ ID NO: 227508 - DNA, 307 bp, Homo sapiens
cctgcctctcctcctttcaaatgagggtggtcggggttccagggtggcaggaggggagtggggccagatgaccgtggatggaattggtgggtgctaggactgacgcctgggttccatggcggaggagagggtttgtccccatggagctgtgtggacttttctgcatatgtacttgaggtcttcaaagaaagaagggcagatctgagaaatggagaagtggctggtattagtgagatgttgaaaaactgccacagaagccctcacagtgcctggagtgttaagacagaagagaaaacctggcaccata

SEQ ID NO: 227509 - DNA, 473 bp, Homo sapiens
gtctctgggtgtgtcattcacatttctgtgggttagatttaggctgcaagtctagccacttgctcatatgtgctggacaaaacttacaggaggcctttgttttggattaggccccagcagaccaaaccaaaatggagtcactcatgctaaggttacatatcaccaagctgaaaataagttgtttatctgaccttctgagaaatcaggagagagagagagaatggccaaatccccaaacagaccagtcccagccagcataaggaagtcccctctgctttaacattttttttttacaaggaaagtcgctttgaaatgaccaatttgctttttgttttgtttctgctttcctcagcctttctttgtctataaaccaatctcctctgctcagctcagcagaacaattattctattttatggaatgaagtgttgcctgattctaaaattgcaaataaagccaattaaaatatttaaaa

SEQ ID NO: 227510 - DNA, 430 bp, Homo sapiens
tgattttattatttttttattttttagaagtgatttgtgagtttaatactatgttttagccctgaacaataggaaatatagtaaaacctcattcattgatttcttttttaaatctcatgtttgagtagtcttgccatagtgtcatctataaactttgagggttttgtttctccttttgtttttacatttgggggacacatgattaaccttaatttgagctctgccgtatgttctgttttgtagttttaggaagcagaattattttcctatttgattctgtagtttgagaaatgactctggaatttactcattcagagaacacatacataattgacattaaagttatttgctttgtcaatttattaaggaataccagctcttttgaatttgttttgcatcacagctattataagacagatacatgatataa

SEQ ID NO: 227511 - DNA, 323 bp, Homo sapiens
atcagtggttctcagctagtggctattttgttctccagggggcatttggcaatgtccgagacatatttgattgtcctgactgggtacgcactgctagtacctagtgggtagaggccatggatgccatcagccattctatgatgaacagtataggcccttacaacaaagaattatccacccccaaatgccaatgttgagaagccgtgatctaacttaacccttatctttcttaggtggaggttgattatctatctatctctttctctccagccagccaggcagccatcatctgtctacctacagatgaggaacatgagcttgtg

SEQ ID NO: 227512 - DNA, 644 bp, Homo sapiens
gagtgcagtgacttaaacctgtaatcccagcactttgggaggccaaggtgggtagatcacttgagcccaggagttcaagactagcctgggcaacatggtgaaaaccctgtcctataaaaaatgtgaaaattagccaggtgtggtagtgcacgcctgtagtcccagctcctcaggaggctgaggtgggaggatcacctgagcccaggaaggtcaaggatgcagtaagtcatgattgcaccacggcactccagcctgggccacagagtgagaccttgtctttaaaacaaacgaacaaaaaagattgttttacttcttaaatctggattaaaactagatgcattttttttcattgttttcccctcattaccctagctagaacctccagtacaatgttgaagtggcaagaatggactttcatgtcttgttgtaaagcataaggattttgattctcatttctgacaagttttaaactttggtgacatttcaaattcctttctccatgatcctatttgagtttatctaatatagaaagtgaactttttgagggcactttctgttgctaatttttctatatggctttgaaatgaatagattttagtttcaaattaagtcttatcaataattgttaatggtcgggtgcagtg

SEQ ID NO: 227513 - DNA, 442 bp, Homo sapiens
gcagtgagctgagatcatgccactgcattccagcctgagtgagactcaaaaaaaaaaaagatgaataaaatgccccagaagacacatgactcgcccaggcctctcaagttggcggtgacaacactagactggagccaggtctcctgactgtgtcttccaccctcaccgcaccacagctgagatcaggtttcccgctcagagctccctttcagatcagagttcccattgagattctataagccgaggaggaccacgagcgagccagaccctgcccgacagctccctcctttcagacctacctgtggatgctgttggctctggaagggttcattatctcagggactcagggtcatgcagtcattaggataatattaaacttttaaatttttttttttggtcattttataacttcataataaaatattagaaagtatacgttagc

SEQ ID NO: 227514 - DNA, 281 bp, Homo sapiens
agcaatcaaatggtagtataattactatttttaaaatattatcccataattataatttttgttaagattagagttttgttattgttgttgttgttgtgttattgttgttgtttttgagatggagtctggctctgtctctcaggctggagtgcagtggcgcaatctcggctcactgcaacgtccacttcccaggttcaagcgattggagatttttaaacttatttttgttttttacttttcatctagattatttacctattctgatatttttgaagttgctg

SEQ ID NO: 227515 - DNA, 444 bp, Homo sapiens
tttcacataacacaggagatgataaatttagaccccctcaatctcatcgtcatactgattatactgtaagcagtgattggggtgcacacattgcatgttttgaaggtatggatgtggcaattctaatgtatcaacattgtttctgaaaagctaaggttttgttattgaactactattagaagtcgaatgtgatcctcttccaatgtctggcattgccttcctgtggaattaacattctgtgtgatttagagtacgtgtcccgactttctcaatgctcataaataccttgtctgtaggaaactttctttaagggaaaagcagctttagcctgtctccagtacatggccctgacttgcttatacatgtaatctattatgaaggaaaaagagccatcctcacaaatctacaagattaaaactcctagcacaaacacagcttgaatca

SEQ ID NO: 227516 - DNA, 357 bp, Homo sapiens
ctcccgctctgagtcaccagagtctgatgagggagatcacagcgaggcctttaccaagccccctaaggcacccaaataaaatctacagatcactgtgccttcagagccgaggccagagtgggtagaaccgcagcttttataaaggcagaaaaggagatggacgtgagaggggagggcgtgaggaaagccagctgggggcccctcctctgccagccttcggggtcctttctgaagcagagggtctgagaaacactccagtccctccacaaaagtggaagaatacctgtctggccggggaaaggggttgccctgcagagaaacgcctggaaaaggggggaaggatggtttggggttccg

SEQ ID NO: 227517 - DNA, 515 bp, Homo sapiens
cactcagtactagctaaaggagaagggttcttgaccttgagaattggttaccgaaataccaggggtttggtctgggtcccgctgctcgctgcacagaaagtcaatgactgagacaacaattattgccaaggaagaaggctttaatagggtgcttcagccaaggagatgggagatcagtttcaaatctatctccctgactgtccaaaattagagatttatatagtacagaagaaatgtaacaatgtataatgaaacaggaactaaggagggggtaaggaagcaatcatgatgaatgaggggtctggcatctcattgtctggatgggtgatctagtgagtttcaattctttgatttttttttttttttttgagagtcataagggtccttttctgagaaaggaactcagataaaacaattatttttgggccttgttacattttaaggggagtttgctaagaactatcctaactctcaagctttaagaccagaagggccaatttctatatttatccaaa

SEQ ID NO: 227518 - DNA, 475 bp, Homo sapiens
attgccctatttttgtggttatgttgaggtatcaagtttctgcagcattcacgaagcccagaaatctctaaataatgccaccctcagttcattggtgatatctcaaaaatggctagagagaattattgtcttttatacatactgatccaaaagaaagctgtaatttctctaggacaccatccacaagtgtgctataaagcacaacttcaccagggttcctagaaacactgacgccctcagctcttgggggcctgggtagggtttcaggcacctagggacctcagaatggtctcttatcctacgagcatcttgatagggcttcaaatccccaggcaagtatcaccattatccgttatagccatggcatgcaaaagacgagaggcagaatggaacagataaagggagatggataaacaggttgagtatccctaatccaaaaatctgaaatccaatatgctccaaaatccaaaaaaaa

SEQ ID NO: 227519 - DNA, 283 bp, Homo sapiens
cagttagccccagctgggaataattttttttcccctcatcacattattcaaggacttactgtatatagtaattaggattggctatttagatttttaaaatttaagtccctgtcagttttactgtttccaacatgagttgtgttgccagtgtttagataatcagaagtatatattgaatataaatactatatatgtatgtattttgggggtggggaggtggggacagtgtctggctcttgcactccagcctgggcgacagtaagactctgtctccaaaaaaaaa

SEQ ID NO: 227520 - DNA, 974 bp, Homo sapiens
ggtggggcctgagaatctgtttatttaacgaatagccaaggtgattctctctagggtttcgggggaaaatcctggatggcgatctctagggtccagatggagagtctaaggctccccctgatagagactctgagatggagactctatgactgctaagcatggcatattcagagctgggccagtgcagtgggtaggattctaccccatcactgacagtccctccctgggacattccttgtgctctagcaacactgttcactaaatatggagactcctgccaaaaagtggaatctggggaaactcctgtgtactgagattgcaggcagaggttggaagacagcatcctggtcacagcaggactttggtgacagacaagctgaggtgggtggtagaggtggcaggaggggcatataggaagaggacagaagggtctccgtgcattaggatgatttctcctatctgtccattttcaacaagatatatcacaaatcccccatccactcctaagacagagcccacagcttcaagggcattgatcaccatctatcccatctctctcttagagcacggttccctttgcagcctccctgccagggtgtcggctactcacagcttctaggcacagggagctcatgccttttggcttagccagcttgttccattttctcctagtttcacctccagtccatgggacaaatggcgccctgtttgtacaggtgtgtcccaggaaagctgagtgcaaagcagatttgtgcgctgtgcctgaagaaagcttctatttcctcacctttaaggtgcagagaattgtacttgttgttgaattgcttttgttttgagaataaaactgaaaaatcagatgggaacgtgctgtagaaagccacctgccacacttccttagagcagggctggcctgacgacagtgtgcccagctgtggggggttcagggtatactatcccgggtgcagacgcccagc

SEQ ID NO: 227521 - DNA, 436 bp, Homo sapiens
agggcgtggagatgtctaggcactcgttttaaagattggtttacctcccaaatccaaaacagagttttcatgtctcttatttaaactacctgtgggttttcaggggcttttttccgcgtcctctctagcgcggactgagctctttctctccgaagagcggtagcttggccggcccacgttccgctccgctctgcgctctcccctccccggctctctcctggaaggttatttgtagcctctttggcgtgttgggacagcggccctactggggtaggaatgtagctgttcttcccaccacatgggccccttaaagggacagctttgctttttggggggtttcccccttcgggttgcaaggaaaggggatggaactttcctctcagccccctggaggaagttttgaaaaagatcaagggaaatggcaaggcactgggaa

SEQ ID NO: 227522 - DNA, 204 bp, Homo sapiens
ggtggctgggcgacggcggagggaacggcgcagagcggggcgccccgccgggagcgctgcctgcgtggcgcccgaggcgggggcgcggggggccgcgcatagcacgtgctcgtctgggagccggccgggccgaggcgggcgcgcgtgtgcgcgtggggcgtggggtgtgtgcccgcgccgtgccccccgcgtgtgctgccgggc

SEQ ID NO: 227523 - DNA, 476 bp, Homo sapiens
  misc_feature (39)..(39): n is a, c, g, or t
tagtaatttatttattagaattgttactactaataatanaatgaatcaccaagcttcctgctccagagttccaatttaggctgcaatgcctcaggaagatatggaagctgcaagagacacggggaagagagatgttatccatcaccgctgtagtctgctagaagagtagctgtgtttatgagagtccatcaggacctccgctgactctaaaagtaactttccactgttgaagttattcttcattatcattgataacgcacccacgtatccacactgtgaaaggaggcttttactgctgaagtctccagtaatcccactgagaagatcatctctccaacctgaaaggcttaaggacctggccaccttccccccagctcccctatccccctccaggtggccttttctcagacccctacccctaatgttgcccagccatctcctcataacttggaatcacccacagagaaaaaaagaaa

SEQ ID NO: 227524 - DNA, 624 bp, Homo sapiens
tcagaagtccttaatttaatagatgggattcttctatctgcttagggcagtgtttttataccttggctacacactggaatgctctgaggagatttaagaaacacagatgcctggatctcaacctagagcttctgattaaattgtcttgggcattgaaggagagctgcaaatggctcccaggtgagaaggctgagaactgctgacctggaggttgaaatggatggcttctaataaacctttgggcattgctaagagcagaagaatgctcaatccttttaacagtgataaacaaacatctctggggaatggagaacttgtttggtgctatgcagtatacaaaatgttctgttggatcagtttggattacatttgattgctggtgaagagacctgaaataacgtagatttaagtaagacagtggtgtcctttctctcacataaaagaagtccacagtagggtgttcaggatcttatggagtctcacagtgccaacatcatcccaggctcctttttcctttctaatctgccatccttggcatgtggctcttgtcctcaagatttttttcatagttgccattgtaactccagccattacatctgtgagcatcacatcttcggacaagca

SEQ ID NO: 227525 - DNA, 619 bp, Homo sapiens
tgtatgtggcagcacatatcaatattttaatcctgttaggtgacaaatcctattaaattggatggatagctcccattagtttattcatttatcagttgatacatatttgagtgtttccactttatggacaattatggataaagttgctatgaatattcacattcatgtgttgtgtggacataggtttttttcttctgggtagacagctagaagtgatagtgctaggtcatatggtaaatatatctcaacattttaagatactgccaaactggtttccaacgtgactacatgtcccatcaacaatgcgtgagtattttagtttttccacgtcattatttcacttcccccaggtgttgctgtccttttttattatagcattctagtgggtaagaagtggtgtctcactgtagttttgatttgcatgtccctgctgactgatgatgctgaccatcttttcatgtattttattgtctattcctacacctttttgatgaaatggttattcaaatattttgcctattttaaaattgggttatttatctttttgttgcgtagttgtaagtgtatttcatattctggatatgagtcctgtattaaatatatgatttgaatttttttt

SEQ ID NO: 227526 - DNA, 641 bp, Homo sapiens
gacgatccccttttagaaggttgtggcaggcttgtagaggttgtggggttcaagcttgagctttgtttaccaggataaatactcagatatctcagaaaatgggctaggctatagagctccctgggggcgtggtcctgttgtctgtatccaaggcaggtgaaaggggcaaagctgagtgggactgggctaggcaagtccatgcttaggctccccaatggcacgcacaagcaccagcccagacaggagttagatagcaattctaacaccactggggcaatgctccaggaaggagtgaaggaacctctgctgtgccaaagagcatgcatgaagaaaggggcagctttgaattcaaaccctagcatgtggcagtgggtcccacattgcttccacactctcaacctggtggagctctctcctgcaacctaccattggcagcaagctaaaacagccagacgagacacaaacagtttgccttcagatcattaaattgtcccaggctgccgaactccctgattggaacaaaactgaggctcccaggccacatccatgctggtctagtcctgccaagggaagagctcccaatttctgcacctgcagctcatgcccatgccacactcacctctcagttctgtccatgaagt

SEQ ID NO: 227527 - DNA, 448 bp, Homo sapiens
agtattagttattgctcatagtggcaataggtgggggagggaacatcaattttcaatatctagtagcaataccattgaaatctttatgttcctatgatgttccaagcctttttgcactagcgattccaataataagcactcaaaaaattatacactcatttttttggccaggcgtggtggctcacacctgtaatctcaacactttgggaggccaaggtggacagatccttgagctcaggagtgtgagaccagcctggccaacatggtgaaaccctgtctctactgaaaatacaaaaattagctagcgtggtggcatgcatctgtagtcgcagctactcaggatgctgaggcaggagaatcacttgaacttgggaggtggaggttgcagtgagccaagattgtgccactgcactccagtctggatgacagagtgagactccgtctcaag

SEQ ID NO: 227528 - DNA, 381 bp, Homo sapiens
atattaggaataagcttaaaaacaattcctggtggtcacacaggcccgggaatagtttatctttccaccagtaaagtggtaagactttttaatacaacgggaattgaataaagtcctcagaagtgtatggccctagtagcgggactaaattagtcttagattagaggctgctcttagtctaccctaacaaggtttgaaaacaaggcttgaaaggatcccactgattctgagtaattttactttgccatagaaaaatccaacattatttaaaggaatgcaataaaatctgacagccaagaatgtaaagtcaaaatgcctgccatccaacaagcacatactaagcatgccatgaagcaggaaaatatgatccgtgaccagaag

SEQ ID NO: 227529 - DNA, 994 bp, Homo sapiens
ccaagttctgctcccttctagaaacaacatagacaaagaaagcaaaaggaaagaaatgctgacagagacccacaaaggccgctgtgatttggtaaagcaccaagcctgccagcacgtcctatggaaagtgagggcagacacaaccacagttggcagggagaacagccaagccgcagcacagctaatgacagtcaccactctggagaaatgcttcaaagggcagctgcagaggtggcagccagctcactgaggaaaacggtcttgatcaggctggagtgcagtgacataatcacagctcactgcatcctcagactcctgggctcaagcaatcctcccatctcagtcttccaagtaattaggactagaagtgtgtattagtctgttctcaagctgctgatgaagacataccctagactgggcaatttgcaaaagaaagaggtttaatggactcacagttccacgtgactgcggatgcctcaccatggcagcagacgagaggagaatgagagccaagtgaaaggggtttccccttataaaaccaccagatctcaggagtcttattcactaccacgacaacagtatgggggaaactgccacccccatgattcaattatctcccaccgggtccctcccacaatatgagggaattatgggagctacaatttatgagatttatgagatttgggtggggacacagccaaaccatatcagtgtgccaccacactcagctaatttttttattatttttagaaacatggtctcactatgttgcccaggctggtctgcactccagggttccagtgatcctcccatcttggcctcccaaagcactaggattacaggcatgagccatcacacccagccaagaaaacattatcttctagatatgcacactgaagtatttgatataaaatgtatgatatttgggattgcttcataatattttagcaaaaataaaataaatgaaatacagcaagctgctgagcattgataa

SEQ ID NO: 227530 - DNA, 360 bp, Homo sapiens
agtgcccgccctctgtgccctggtgctttctcctttgtccccctgctggactaggctcagctcttccacctgagccccaagaggtcagcccaagcccctgctttcctcactcacataatgttgtttgtagtgagctggtcctgagactcctgggaacttgttaaaatcgaagcctcaccccacccagccactgagtcagcatcttggggctggagactctgtgtatgtttgaaaaagggtgagagagaaagacatgcatccaagtggggaagctgggacaataaataaacaagaattccttaatatgattaaatatatgcaatcacttatttaagtgtgatgctatcatggttatgtggc

SEQ ID NO: 227531 - DNA, 515 bp, Homo sapiens
caggttcactccattctcctgcctcagccttctgagtagctgggactacaggcgcccgccaccacgcctggctaattttttctgttttttagtagagatggggtttcaccgtgttagccaggatggtctcgatctcctaaccttgtgatccgcctgcctcggccttccaaagtgctgggattacaggtgtgagccaccgcgcctggcctcatcaggctagttctaataactttaagagggaagttctctggtagatttgatctaaatgtttgcaatttttattaaggtagagaagatccttggattcttctctgttggctttagaaatgtggaaaattattcccgaattgccttggacaaccaaccaagtttacctattacattctccatatgttttggaagaaaatatttaaaccagggtgtccagtcttttggcttccctgggccacactggaagaagaattttcttgggccccacataaaatacactaatgatagctgatgagccaaaaaaa

SEQ ID NO: 227532 - DNA, 385 bp, Homo sapiens
gaaagaggggtcacctgctcaacaactccaacccaaatggaagggactttttcagtggtgttggccacgccttctgtagtcaaagtaccaggattagaagttggatacgtctttctagggtcaagcctgcaatacctgaagccccagacctgtaacttgaagcttccgtcagccactatacctgtgaacctgtggaagacctgaagtacctgttttaaagacagtcaaaagataagtgaatgcctaccaactctccttggtgtctatgctgcatagttactgtaggtttgataatagtagcagtttttatatttttataatttattgccttcttccaaatggatggaatcatttcctttgtaataattaagcaaaatgttttact

SEQ ID NO: 227533 - DNA, 926 bp, Homo sapiens
tgcagggagagagaactggatgctgccttctcaataggagaagccaagaaacgcagatgccgatgcttaatcaactccgtctctccctctagtgactcggggatagctgccctgatgccaaggcgattgtcttctggaagcagccacgccgtgtgaggttcctcatcactgccctgcatctccctgcgagctctcggggataattgcaaaatcacgtttgattccaggggagcagaaagcagcaggagccgtgaattctccaactcttaactggtcctcgactggagccacttttccctgcccacccatccctgtggcggattcattacagttatccaaagccggttttaactttgctccccctggctcagaagtctgtcagtgggtcctgagcggcttcaccattcaagtttattcctatcagcctggaatacaatgctctatctggcaaaaaaaaaaaaaaaaacaaaaaaaaaaatttggcggggggccggggcccgagaaaaggtttttaaacaccatttggtgtgggggcgggggccccattgtatcgccacctgtgcaaaagggggtccaagggaaacctgggtcctaacatatgcgttgtgcttctccccaccaaaaaaaaacgcgggcggaaccgcgggcggtttgggaacaaaacccgatagggtgtccggaggcctccacgggttctccaccagcgggtgccagcggctccgtaataaggcgcccggcggcggtgaggagaaactgacagaccgcaccaacgacgaagaacagaccagcaaagacgaagctcacgacaagagacacgaccacaagacgacgacaaaacaagaacgaacataaacaacaatagcaacagagacaagaaaccacaacgacacacaacaagcaactctctgtatggagacaaaataatg

SEQ ID NO: 227534 - DNA, 405 bp, Homo sapiens
atcataaatttgtatatacctaataagatctacagtcataggtggaaattttaacactactctgtaacttatagaaaacctagacaaaaaatcagttagaatatagaagatctgtaaaaatacttcagccaccttgacctaactgacatttgtagaatatcatgggcaactaaaatagagtgtacattctattcaagtacacatgatatgcataccgagataaataatatatgggtcctaaaacatgtctcactacatttcaaaagtttgaaatcctaaagagtatactctgtaactacagtagaatttaaagtagaaaccaatagcaataagatattcaggaaaaatctgaatatttggaagttaaacagcacagttatccctagtcgatctatgaatttaatg

SEQ ID NO: 227535 - DNA, 446 bp, Homo sapiens
agatattgccgtgtttgaagaacacatatgctctctctgctgataatgagagctttataatttattacattttaccctttgctttgaatgccaaaaatcatagaggcaagtctggtgttcaagcacagcaataacatctttctggctaatttgtgggctatctcagtggtgtccacaaaaattacatagccccaatcttctgtttttaggcccaacttacaaatcttactgtatatgtcctctttgtagagaaaaactttaagatattatttgtaaagagttaaataatttaaaagtaaaaacaacaaagtgttccatagatagggtgccgtctagaacctgacagcactaagagaaacttggcctgtatttcacaaatttgctgggggctgggagaagtgtgacctctgcctacaggtgtaagccacagactttgaatagcatac

SEQ ID NO: 227536 - DNA, 499 bp, Homo sapiens
catgctggtctcgaactcctgacctcagatgatctgcccgcctcggcctcccaaagtgctgggattacaggcatgagccatggcgctcagtgagttatttgttcttatgttcgtttttaattgtccgtctccccaactcctctttactagaataaagttccatgaggacagggattttgttttgttttgttttttgttctctcacatttcaagcacctagaacagtgtctggcacttagtaggttctcaaaaatttttttttatggagtgcataaatgaagaaagattatcacacacataagacacccctgttcacaccagcagtatcttgggtggttttaggaatttgtggatataaatgaagtctgttttgtttggggcactctgttgtagggtgggagtgagtgttaaatacccttttgttagttataaccgtaatagaataaacttgtcattttgcagaagctaagaatacaagttactaaaaagcaaatgacta

SEQ ID NO: 227537 - DNA, 739 bp, Homo sapiens
atctagcttaaacataatttatttcacaaaataaagagttgggggcaggcaactcaaagctacgcaaagcatcaaggaagctacccaagataccagtttcttctaatttcctgcttcattttcttaggatatgggacttccttgtggacataaaatggctgctgcagctccaggccacacatgcaccttccaggtagaaagaactcactaggaaaggcaagaagaaaactgttctcccttaacaagaacctccccagtttcagctttctttgtggggtagtggagaggcagcattcagagaacccagaatcagactctgcttagagaaggttggcttctggggacatcttttgatcatgtctgctcaatgtcaccatcttaaggcaggaggaagcaacagaaaacagggaagcaggtgtcccaggaggagcccaatgccatggaaagatgggaaaagaggtggtggatgagatcctggattcttataaactttatctactccacttgcacagatgatggaggatttgaggagtgtcagtgaatgctctgtgtggactgaacttggagcagactggggctggaactctccagggagggcaactttgaccgagacatcttagggtttgccaagtcctcagcagatgttttttgatgtgccttgagatcctcaaatgagaagggcagtgggattcttccctctccagccaggaccacatctgtgcttttctgtaattgtgta

SEQ ID NO: 227538 - DNA, 460 bp, Homo sapiens
agtcacagcttattttgtatgcaaagtgaaggctctagactgagacagtaactcctctgggcctctccactgtgtctttggactcctgtgatggataccactttaagttgctcccttcaccccccaggagaatccaagactcatcttctcaatcagaaagactttctttagaatgtttataccagggccctgtatattggaccagattcctcccagcctttgaggaatgaagacagtattgtcagctgctgttagggcatgtgttgtggattttctctccagggtgggtactggacttgtaactaaatacacagaatgttgaggctgatggcttgccttcatctacctggacagtgaatcctttccttattatcctgtatttgcatatttgatttataccaaatatgtgttgcattcttttagttttatagtccagcaaagtaatttttaaaaggcagac

SEQ ID NO: 227539 - DNA, 210 bp, Homo sapiens
agggagtccaggtgtcaggaggaaggggctgaggtcttcagggctggtggctcagggtatatgagtagcctgacacaggcacccatgtccccagaccttctctggccatatggagtcagagtgacctccagtcccctggaagattgccaagagcaaggcagctcctcagcccctgaggagttagcagcagattatccagagagggtctca

SEQ ID NO: 227540 - DNA, 417 bp, Homo sapiens
gcatgagacaaacaaacaaaatccttaagagtgtttttcttgggttacaaagttatgttaaataaaaataaaaatggagggaaaacctttgcttctgagccaatggcccacaccagctcaagaaaacttataaagaccgattctggaaatgtcagaaatgaagcttgagctttatttccttgtaagcatgactcagcacatgcagacaatcatctattacctacgtaacctgctctgatcatcctaaaaggaaagatactgtaaaataaccaatgagaatcaagatgtatgaacttctttttttccgttttttaaaccttaactataacctttaggagatgagcttcttgccattttctattttggagtctctgttctggaatagtgtgttctcaataaaatattcatgtcaagtaa

SEQ ID NO: 227541 - DNA, 493 bp, Homo sapiens
acatcttgcaaaactgtagtataatttcataaacaggatattgacattgatacagtcaatatagagaacttttctataaccacaagtatccttcatgttacccttttctagtcacgtgcctcctgcttccacccccttctcagttcctgacaaccagtaatctactctccaattgtataattttgtcatgtcaagaatgttatataagtggaatcatacagaatgtagccttctgggattgcctatttatagtcagaataagtctctagagattcatccagcttgttgtgtatcaatggtttgtttctttttattactgaggagtattcatggtatgaatgtacttcagtttgtttaaccattcacctgttgagagacatctgggttgttttcagtttggcctattacaattacagctgctataaacatttgtatactggtttttgtgtgaacattgtcttcatttttttggaataaatgtccaggagcatgg

SEQ ID NO: 227542 - DNA, 178 bp, Homo sapiens
tacagctttggattgcagatttttgaaatggttctgggctaagatgcagatgttaacttctggtcttttaaaaaatgaatttaaaatagaatagaatatcttggtgctgttccatttctcataaattgaaaggatctgatgtcttccagttcagaagaaaaaaaaatcgcacaggcca

SEQ ID NO: 227543 - DNA, 581 bp, Homo sapiens
gcaatgacacgatctcggctcactgcaacctccacctcccgggttcaagtgattctcctgcctcagcctcttgagtagctgggattacaggcacgtgccaccatgcccagctaatttttgtatttttagcagagacggggtttcaccatgttggtcagactggtctcaaactcctgacctcgtgacctgcctgcctcggcctcccaaagtgttaggattacaggcatgagccaccacgcccagccttcatagtcacttttcatactgccattttccctcttgggataaaaatgttctcagaaaaaaatggaccacgtaaattaggttgacagcttctttctttgagtcaataatgatagcttcctagtcaatcactcctttctccttaaaacattaccttggaaatattaattctgacagtcatagcaatgacatctttcctgagtcagctgctgctctttgttaattatcgctcattaattggtaaggtgagcaaccacaaaggctgccagcagtagcctaggatggcagttagataatcaagattgtttactcaatgtatgtgtgtttgaatccccttt

SEQ ID NO: 227544 - DNA, 491 bp, Homo sapiens
tcccattttcacttacagttttgaatacatttatacatttccttcttcaagcgtcatttaaattaaaagtgtttctattttctccagatggagtttcaatgctcataaacatttatattaggagagaatatagtacatattatctaacttaagttgaaaaagaatgaaactgtaaaatatatttaccaaaataattaagatttatttatcttcggtaggcctcaattagtttacctttaaaaagcattcattgatacaaattttaaaaatccatgtaacagacatcaatcaaatgtgatttttctccagtttattattttctgccaggggaaataaaatgcaataatcacattttaaatatacatctttttaaatgattctgttgttatacatatgattgttattcatatttttactgttattgaatgcccctgtactgacctttccaatttgatagtgcagtaagaaataaacttttttttaatattgag

SEQ ID NO: 227545 - DNA, 682 bp, Homo sapiens
aaataaaaaagcagctgtctcatttagacccatgggtcttgcaggagctgaacaaaaatatgctcggaagttggcatgtgtgaaaccagtggcttccatattaagtctggtgtcctgtctcttggtgctttttaaagcattgggggtaacctaaaagcttttttctcttccaaagctttattaacccttcaaccattttcatggctttgtactcttaactttttagagggctctacaccagcctttacagaatcccagttgtggagaaggaggtgggaagggtcggaggaagagagtaatacagaaatatacctggccagttcaacaaaaaaagtatatacctatccatgattaccagcattccggttgtttaaaatttcatgtgctccttgagattaaattgttcacaataaggtccaaaagtcttttccaagtggtactggggctaatatattttctttttaaggcttttacactggtagaaactgtttccttaagaatgctgtgagttgtgtattttctttgtcaacatttttctctgttgtgatatgtagtcctgggttttctcttcttttagagagtgaaggatgacgggtggtattctctccccttaatatatccctgaggcagatcagtccttatctctcttttgcttcttttgctgaagcaacactggatttct

SEQ ID NO: 227546 - DNA, 242 bp, Homo sapiens
cagggtgtggatgtgttcacagtgcactaaagcctcctttggcccctcgattccttgactgccctagatatgtgagtggaaaagccccttgtcttgtccttctctgggtagactttagtccatacacatactttctgaagctatttcgtctgttaaccacatcttagagtctgttctgttgtatctgttcattcagttgctccattaaatttttttttccaaaaaatgagaataccaaagaa

SEQ ID NO: 227547 - DNA, 293 bp, Homo sapiens
tctaaatcagctgcttattgacatctcccacttgtaactccttcttggtaggtcctataaaacctgctctctggccaggcatggtggcacacacccttatatcccagcactctgggaggttgaggcgggtagatcacttgagcccaggagtttgagaccagcctgggcaacatagcagctgaatatagaaagcaaaatttcaagtgagaagtctgagctaaatttgtgagtcattagcaggcacatgttttaaaagcataatactgagtaagatgcatcaagagaatgaatgt

SEQ ID NO: 227548 - DNA, 380 bp, Homo sapiens
agtttcatgaagttgtcaatgtttgtaagaatatagaatgcatggaggatccaaattagtgtaaataattcatttactgttagagaatcaagtagatagatatggttgtatatatttttttcgcatgccatccatttacaaactgggattgacaagaatctattagaaaatatgactgcactgtgttctcactcgtaagtgggagttgaacaatgagaacacatggacacagggaggggaatatcacacaccagggcctgtcgaggggcagtggggtaggggagggatagcattaggagaaatacctaatgtagatgacaggttgatgagtgcagcaaatcaccatggggcgtgtatacctatgtaacaaacctgcatgt

SEQ ID NO: 227549 - DNA, 371 bp, Homo sapiens
tatatatctgagtttcaggatctgagaaaagactatctctagacccatttcccttattttgggaacagaagtgcatcttagacattatttaggatgaaggtactcagcttttttcctgtcccaacactcctaaatatatgatttactgtggcactgagatagcagttcttaattaggagaagggagagttataagtttttggaaaaagccctccaactattaagatatatataccccctaccccagtgaagaacaatctgctaagttgtaaagatgagagaacctaggcccagacacctaaaatgccaggtctcgggtttccacaactggtgaccaggactagaatcccaggtttttacttccccattgag

SEQ ID NO: 227550 - DNA, 583 bp, Homo sapiens
aaatcctattgtcctctaacattctgctcaatttgcagctactggactacaaatgaaatactgactctaaactcagttttatccctagctgtctacataacacaactatgtcctcatctgttaaataggaggaagtttcatagtatctgtatcattttacagatactatgaacatatgcagttgtaaacttcttagagctcctacaattcagatgaattaaacagatgaagatcaggatgagaaatttttaaaatgtctatctgtgaagccaatcctttgctatcttccctcccactccctttactgacatgtgagtaaatgcttcccatttaattggattttaaggtcataaaacaggtaagtcaaccctaccacaagaattttttacaaatcagatgatgacctgaaaatactcttgttctgctaaatctgaacattacaaaatggctaaaaatgacattttaaagataggggtctgagcctactctcacaagcagtcacattaagatgtaaatttactatttggaggattcacagtgcaccagtgaaaaaatatcacgaaagaaaaattcttatgtctaa

SEQ ID NO: 227551 - DNA, 476 bp, Homo sapiens
ggtcaaggttactaaaaataaggcaaatctgagaaactaccagattactagtgtcccagaagaggctaagaggacgtgaggaccaagcaccacgtggtgcctgagccgcgtcctggaacagaaaaaggacatcattggaaaacccggtaaaacctaagtagcctgcaggttagttaacagcaacggaccaatgttcattccttagttttgacaaatgcaccacagttaacatcaggcaaacgggatgaggagtgtatgggaactctctgtattatttctgccactttcctaaaagtaatcccaaagtgctcccaaatactatatcattaatatgaatataaagtaattcactttagagatctgaaaatgttctccataaaattgacaagaaaaaattgtaaactccctaaacatctttcagtttcctttttgtcctccttccccgttttttctttataaatatggatgttttaatc

SEQ ID NO: 227552 - DNA, 572 bp, Homo sapiens
tgaataatattccatgctatgtgcaccatgggtcgtttatctaatcatcctccgatggacactcggttgcttccaccttttggccattgggaatagtgctgctacgagcatgagtgtacaattatctgtgtgagttcctgctttcaattcttttgggtatatgcccaaaagtggaattgttggctcctatggaaattgtgtttttactttcttgaggaagcatcatactgtttttcatggtcgctgtaccactgtacactctcaccagcagtgtacaagtgttgtgacttctccacatcttcgccaacacttggactagtgaagttcagcatattttcatgtgcctattgcccatttgtatatcttctttggagaattgtctattcatgttgttcactcatttttgaatgagattgtttgtttttctgttgttaagtcatagttctttatgtattctggatattaattctttatcaggtatataattggcaaatatttcctcccattctgtgcattttcttttaactctcttaatagtgtcccttgatatataaaaaaggtttttaaatttt

SEQ ID NO: 227553 - DNA, 199 bp, Homo sapiens
gccagagctgctagactctaaagctttgaattttccagctggtcaggactgtctccagccaccagggcaagactttgcagctcagacatggtggcctgaaatggtgggaagttgaccagagagaggaggctggggagtcccagcacctacttcgttcctgagtggaagactgctggtctggctttgaaaccttgcttca

SEQ ID NO: 227554 - DNA, 339 bp, Homo sapiens
cacacatcatcaggcccagctaattttttttttttttatttttagtagacacagggtttcaccatgttgacaagactggtctcgaactcctgacctcaggcaatccacccgctttggcctcccaaagtgctgggattacaggcgtgagccaccatgcgtggccaacttcttgaagttggatttatacattatataaacgatctatacagataattctaaaaaccaatatagaaataaaaagttaaagaaaataatatgcatcggaatatgtgctcatatctgactgttaagaagatgtgatgaaatagacacatgcacctatacaaaaaaaaaacatga

SEQ ID NO: 227555 - DNA, 492 bp, Homo sapiens
cagtagaagacagagcaaagcatgatttctcttttctctggcctgatttaattctaaggtcagacgttcagcttgatcataacctgtttataattatgactcagaccatttttccactcttggatcattggccattaatgatgaggggtctcaaacaacatgtctcagtgacacagtaaagcagaaattggctgaaagcaaagctgtttttatttctagcttcagtcagcacataatgcttaaaacctaaagaggaaagtaaaagcgtgttacaatctctcaaactttatcaagacagggcttagaacctgacatcctccgctatggtcattccattttgaaatgtagaaaatccaacttgtggatggtttgtctgtaaatgagctgaatgtgtgtgcgtgttcattatcaagcacgatatgctcacaaatgcacagtactttaagccttgtgcaagaaagatgctttcagtaaacatatttaaaaggttta

SEQ ID NO: 227556 - DNA, 609 bp, Homo sapiens
tactgcacttatacggcaacacaaaatattggtgattctgctgattcccagacctgtttgctggtctttgaatcactgccgtagatgcacatgatccctgagagggacagaaaggctatcccatcattcaggggcataggcgaggcactcttactatttgcagcacccaaggtgtctgagaccatggccttgatggggaagacagggactctttgaggagccttggattgagaaaaacaaggagcagtgacatgctgcgatcccttcactctgacttacacgagacccaggactctccatagccatggcaactagcccaaaatgacaaggctgattaattccacaagtgcattattcacgtgtcaccaaatattgactcttatcaacctccttcccccagccatctgtcctcgtgtgtcaaatcaaaataaatcaacaaacaaaaagtggcaggcagatgccaccccagggatgctgcaattgcacagtccccagggctagtctgagttctaagtggctctttcatttccccatctcccttcttccccagatgactgggagtgtgcacacatgcgtgtgtgcgtgcacgcacacacacacacacacagg

SEQ ID NO: 227557 - DNA, 718 bp, Homo sapiens
gcaagtctaaagctcttctattttgaacgactactgctgctagggagttaagttgatcttgcaaggtgaccagggagtcagagacccgttccatgtcaccatttagttcttgagatagtttgtagtagaactgaatagaggttgtgataccgccagtgccagtacctactccacctagcactcctgctccgataacaaaaggaagaatgggtacccttttgttgcggggcttaggtacgacatgattgtataaatcttgttcagtgtagatggtcatagggggcgctaagaatgagaggaagcatatagattctgaagagccattcaaacaacgataggctgaggtaccacagacaaaaaatattcctgagggtaggcagactattcgtgtgggaagagttacccacctgatgtgctgggagttggttgcacacacacacaaaaatatatttagtcagtcttttcaagagtgtcacaaaagtgatttgtgtttttagtttaagtttttgcagtgccttagttgcataagtgcaagagcccaaactatatacacatttccaaataatcatggaattgagctgtaaacaggtaatttataatgttcaaccttaaacatctcattataaataacccacatgtgcataacttacatttacagaaccagaaacttttttttttctcacaatccatggccttacatttaagagaagtagaaatg

SEQ ID NO: 227558 - DNA, 621 bp, Homo sapiens
cgcggtggctcacgcctgtaatcccagcactttgggaggctgaggacagcagatcacctgaggtcaggagttcaagaccagcctagccaacatggtgaaaccccatctctactaaaaatacaaaaattagccgggcgtggtggtgggcgcctgtaatcccagctacctgagaggctgaggtaggagaatcgcttgaacctgggaggtggagtgagccgagatcgtgccattgcactccagcccaggcaacgagagtgaaactctgtttcaaaataaataagtaaataaatgccattgcactccagcccaggcaacaagagcaaaaccctgtttctaaataaataaaataaaataaaaatgaggtgattgcaggctgaaggtcttggtcactactgagttctagttctctcaagacaaatattcatatggtcaaaacagaattataatctaacgagtcattcttatagagtgggattcggggagggaaaacagatagctagtaatttaaatgatcttaatgtaatttggggagaggatgatcagatgacatttagacttggatatagtttctgcttcaaacccacgctgtgtgtgtctgtttgcatactctctaaagaagga

SEQ ID NO: 227559 - DNA, 371 bp, Homo sapiens
attcctgagtcacttcacttagaataatagtctccaatctcatccaggtcactgcaaatgctgttaattcattctcaaggatgaatttgtattcaaatctggaatcttccttgggctgagaggggactggttcctgttgtcgggatgtctgtgttgctaggatagctgagggatcagtgcttggataccattcaggtctttttcctgcctgtgggtacgtggaggcacacattcctgggaacagctgtgagtgcctaattccttcggcctcttgtgctgtgggagcatgtggtaggacaatgtggtgtttcattagtttgcatgagtggaactgactgactcgtcacaagtgttttaactgacagtggcca

SEQ ID NO: 227560 - DNA, 373 bp, Homo sapiens
ctcttagaacttcatatttaaatctcatatttggtcatagacagtttactactgaagtattccaggtccatacaattctgaacttgcaggagtgtttatctttaagtgacatgtaactatgtagtaacatttaatggtatctacttggtttttttgaggtgttttagatttgaatcgattttgaagtattcaatctagaaactgttctttaaaaactaaatgtttattacttagatttcatctcattttatctcatttacatatatccttaataaattcttctaatttttcaattcacaaaaatactttataaaaattcacaaaagtattttatatcatttgtcagatgaataaataagtatatgttacattt

SEQ ID NO: 227561 - DNA, 480 bp, Homo sapiens
atgatttaatgtataatgttaatgtatttgcctttatgccagagcagtcataaaatataatttttaatatttttatgggggaagaggttcatgaaagcaaaagtggaaagggctcacaaaagtcatgagtggtcccaattcccacctaaactccaggggttctattgctgaaatgaaaaacagaacaacaaatagtggggacaattaatagtttccattccaagctctacctgtggatgttcataaccataaatgtacttcttcatccattacaacacactccctagatcgtcaaaaagagacaactctaatcctacccaatgactgcatatagcttaacgttcaaggactctaggtcttgatgtgactcctctatgaacagggacccacaaattaataaacaaaacaggcacctcctcccatactcaacatgtaaaggcagagtaggaatgggaaagactagggaaataagaagatcag

SEQ ID NO: 227562 - DNA, 402 bp, Homo sapiens
tttttgcccccacttcacaggatggcagctctactgatgtctcccagttttctctcatagacccagacctgcaagaactcgagggaaaggaagatcttgaaagcctctcattcactgggtgcttccagctccaagtgtgtggtaatggtttcagagggatttggagagaaacagaatagtcgaacttacctcatcaaacgactccagtttttattgtccccccataaagatagtctaaacctgctcccctgcttgtgaactcagagtcctgttgggggactcagaaggttgtacatatatatgtgtgaatagttttcaaatgtttcacacatgtatgtataaataattttaaatgtttgtgtatattgtcatgattaataaaaagcccattcatttaaaagc

SEQ ID NO: 227563 - DNA, 194 bp, Homo sapiens
gagacagagtctcgctctgtcaccaggctggagtgcagtggcgtgatcttggctcactgcaaataggctagttttctattccaaaaatacctttttttgtttgtttgcttctaattaaaaattataatacttatagacaaactcaagcactgtaaaaatatacacaaatgtaaaagtcttcaggaatcctcagc

SEQ ID NO: 227564 - DNA, 574 bp, Homo sapiens
gttcctagagtcctccaaatgtctttacattcactgccccctgggctgctcacaacctcagtggaagaggcaggaggaggattttcacatccatttcacaaaggccaacacggaggctcaacgaggcattgttgctggcccacatcatatgcccagtcaacagaacaacagcgttactaaccaggctccaaatcctacgtcccttccgtggggctgtggctcacggggaggtcatgaatcaggaccagggagggaggacagggcataaagcccagctctgctcactactgcactctgattttccccaagagccccaactcaggacagagaaaggtgacagccccctttccgctcatctctccacctgctgtccctcactcccactcagtaagcaccactccagggagagaaccccttgccccagacccagccagccgccatctaaggagccccagtggagcccccacgggctgggcacacgcctcatgttctgcagagaggccaccagacactcacatgccccaggatttacaggccctgacatcctggggcatgtgagtgtctggcggccgca

SEQ ID NO: 227565 - DNA, 398 bp, Homo sapiens
ggccagaatctcctgctctgcccccaactagggaaccggtcgaaggagagtgggacgactgcaacctgctgcagctaagtatgcaaggatcgcgccgaccggcttccgagtcgagatcccactaagtcccaccgcagtcaccacagccagccctgcccaggggctcccacgtgagaaggctgtaacagacagacagcagccacgatgaaacacgctgaaaagagccagcagaaaaaaacgaggagagactggtatgacggagtggaattccggttgtggatgacagaatggaaattttacgcaagatgaaagagttaagacaaattactctaaaaatatctgacttagttgtttctaaaccctggggcacccttaggaaaaaataaaaataaaaaaac

SEQ ID NO: 227566 - DNA, 303 bp, Homo sapiens
ggccagaatctcctgctctgcccccaactagggaaccggtcgaaggagagtgggacgactgcaacctgctgcagctaagtatgcaaggatcgcgccgaccggcttccgagtcgagatcccactaagtcccaccgcagtcaccacagccagccctgcccaggggctcccacgtgagaaggctgtaacagacagacagcagccacgatgaaacacgctgaaaagagccagcagaaaaaaacgaggagagactggtatgacggagtggaattcccgggtttttttttttttttttttttttttttt

SEQ ID NO: 227567 - DNA, 245 bp, Homo sapiens
agcgtgcccgggtagtcctgttggcagcctgcccctatgcagcttttggcaatacagaacagcttcttggggctcccacgtgagaaggctgtaacagacagacagcagccacgatgaaacacgctgaaaagagccagcagaaaaaaacgaggagagactggtatgacggagtggaattccggttgtggatgacagaatggaaattttacgcaagatgaaagaacgcacgtctttcaaccgcagtt

SEQ ID NO: 227568 - DNA, 399 bp, Homo sapiens
atgtagatagttttctaaaatgaaaaagaaatgggctggtcacaggaggtggggacttgggatggatggttttagcagcatctgaatggagtaggcagctcttgtattcctaatgtactttcacacactgtagctttaaaacagaagcaagttgctgtgttgttgccaaccagatagcaaagtggataatattcttggttaacaccagggcaaggtactttttatacttggcagtttagttcttttataaaatccagtttgaaaggtgtatcagcaaattatcttgaaaaagctatcaaataattgccttatgaatgtaatcagaacctctttcaattataaatctttaagtaaaacatggaaacaataatggaaaaaataaagaactcttcagacaga

SEQ ID NO: 227569 - DNA, 355 bp, Homo sapiens
gtgtataacaggaattggcctttagttacaagtagaaactatggacaaaatggtagatgaaaaataatggcggccgggtgcagtggctcacacctgtaatcccagcactttgggaggccgaggcaggcagattacctgaggtcaggagtttgagaccagtctggccaacatggtgaaaccccatctctactaaaaatacaaaaattagccaggcctggtggcggatgcctgtaatcccagctacttgggaggctgaggcaggagaatcacttgaacccaggaggtagaggttgcagtgaaccgagattgcaccattgcactccagcctgggcaacaaaagcaaaattccatctca

SEQ ID NO: 227570 - DNA, 421 bp, Homo sapiens
cctgattacacaaaatgggactttttaactcccagtcttggatcaaattttgaggctacaaaaaagcagggggtggcaaagagaatatgtgccatgtttatatattccagatatggtgattaaatgatccataccacgggctgggcaccgtggctcacgcctgtaatcccagcacttagggaggctgaagcaggtggatcacctgaggtcagaagttcgagaccagcctgaccaacatggagaaatcccatctctactaaaaatacaaaattagccgggcatggtggtgcatgcctgtaatcccagctactcaggaggctgaggcaggagaattgcttgaacccaggaggtggaggttgcggtgagtcaagattgtgccattgcactccagcctgggcaacaagagcaaaactcggtctca

SEQ ID NO: 227571 - DNA, 187 bp, Homo sapiens
ggaggatatattgaggcatatgctacgcccttttcctgttatggcctgaaatagttttcgggatccttttggccaatgattaggggcagggaggagatgtccattcagtcagtttggggcttagaattatatttttggtttatacctgacatgtgaataaatgttcaataaatgttgattgtcacta

SEQ ID NO: 227572 - DNA, 610 bp, Homo sapiens
aggcatggtggcaggcgcctgtaatcccagctacttgggaggctgaggcaggagaatcgcttgaatccgggaggcggaggttgcagtgagctgagacgacaccattgtactccagcctgggcaacgaggctccatctcaaaaaaaaaaaaaagaaagaaagaaaaagaaaaaaccagatcatttatttgtagaattttcccagaatctggattttgttgattactttcatgaaatgtaggttaatgtgttcttctataatccatgtttcctgtaaactgggaattggatccagagacttaaccagtttcaagaacctcctccagcacctttttttaacaagactatatcctaggtagtggggtattcttcctcaagagagacataattctgtttttgaaattattgcagcagttgatgcaaaatgcctagatccatgattcactaggggttgcagcatcattatggtatatttgtatgatttcttttttattcatttgctggaatttttctataaagagaacgtttattttctctactgtttggttagccagtgatacagttagtgtaggacaaacaaggtacatgcttaatattttttctttatttgcc

SEQ ID NO: 227573 - DNA, 649 bp, Homo sapiens
gagatattaagaaattacttgacagtttttggaacataatgactatttgtagtttaaaaaggaaagatatttaaaaattgagatttattatttgtgagtccaattggtttttagaaaggtttactttaccactcaccaaacaaacaaaaacccttagttgtttacatgtaaagacagaaaaattaaggtgacctttctttcttctgctgccaaatagtaaaactcagtatgactataatacatttaataggcagctcctctatttagctcaagctagtctctcataccaaaaaccaaatttttaaaaactgaatatttgaaattatacaaacaaaatatgctaagaaaattcttaacaatgaccaaatgcaaacttcatgtcataggaaggttaagtaccagaggcaattccttttaataggatgacaatcataagaaggaacagttacaattctgaatatgaaagagctgtttctttagtaataaaccaaatacaaagttccgggttcatctgttctggctggcaaatcttgcataaaaaagccatactttagctaaacaaaagcttttaggctggcccagaaagagggaatgaacaatttgaaaaacatcttttactgcctgagaaaatttaaaaagtgtctgaaag

SEQ ID NO: 227574 - DNA, 528 bp, Homo sapiens
cttaacacaaccaaatctgatttgagaattattttgaggcttgcagctctgtttgtggcataaatatatacatacatacatacgcaggtatatatgtatgcaaaaatgcttattgactgtggaaatgacagtttaagtcactctgtatttcttttttccatgagtctaatattgaattacgatgattcaaaggctctcagagtgttgtgctaacatcgtaaatggctaaacatccaaaaaagaaaacaattaaaacacaacgcacacacaattttcttaaagttgtggaaaattaggtaggcacagttgattgttttgagctggtagaaaaacctgggcagctagcagaggtctggacaaccacggaaagcccacagcaaggaccacaccgtgagcagccaccagagatttgggatggtagacttaccaagagtgtccactggcgggggggcacacggtgagaaagtgcaggatacacaattgacacaaaaaggaaaataataaagtcaaactggtattcaagcagca

SEQ ID NO: 227575 - DNA, 502 bp, Homo sapiens
actgcatcccaaattaatggtgctgaaaagaatgtattatagaccagtgtctcaggctaaatgtggatgatacagtcatcactgtgcccagacatctggtacataaacacttggatattttggagcaggatgagcaaacacaatggcaaagctctgaaaggcaaccagccaactgagcagagaggttagcagagctgaccagcacatggaaacaaattttgcttgcccattgacaggacatgacttgattgcataatgttgaatttttttccttttttttctccttcctgtcagatgggtaatgtgctgacatcataacaaggttggagggaggcacatctcacatgtgagtgtgaaaacccaatcaccacatgtatgaaccacaaaaggatctcaatatacctttaaataagaatctcaacttttaaaatattttgaaaacactgagccttgtatcaatattgaaaagtcaactttgaaataaagggttgtttaaaataaa

SEQ ID NO: 227576 - DNA, 149 bp, Homo sapiens
ggtggggggttggcttggtttggtttttgcttcattttttaattttagggatttttaaaaagccagcattccttaatcttctgattgttgtgtgactgttgtataatattgagaaatacattcctgtcatccacaactaacaaccatta

SEQ ID NO: 227577 - DNA, 1264 bp, Homo sapiens
  misc_feature (848)..(848): n is a, c, g, or t
cgattcggagtgggcacagtcaataattacattgtatattttaaaataactaaaagagtgtaattggattgtttgtaacacaaagcataaattcttgagtggatgagtatctcatgttccatgatgcgattattacacattatatgcctgtatcaaaacatctcatgtgccatataaatacatacacctactatgtactcagaaaaattaaaaataaaaaaaatttaaaaagctactctacctaataaatgcattcagaaaagttacaaagtacaagtttgacatgcaaaataggttgtatccctatacaatcacaatgaataatttgtaaatttaagattatataagaaaattattaaaattaataaaataattccttttacaatagcatcaaaaagaatgaaatatatagtaatacatttaacaaaagaaatgaaagacttacactctgaaaattagaaagggaaaacaaaattgttgaaaaaattaaagaagacctaaatataaatgctcgtggggatggatactctattttccatgatgtgattattatacattgcatacctctatcaaaacacatcatgtactccatatatatatacacctactaaatacccataaaaattaaaaattataaaaataaagaatacctaaaatatagaaatacttcttgcattcatagattggaaaatgtaagtcattgaaatgtcaatgctacccaaaacaatctacagattcaatgtgatgtttattaaaattccaactgttttgcagaaatggataagctaaccctcaagttcatatggaattgaaagtggccttacatagcctgaataatcatgaaaaanaacaaagttggaagattcatatttcccaatttcaaaacttactaaaaaggtccaattatctaaagagtgtgttactggtatagaaataaatatatagaccactgaattagaatttatatttgagatataaacccttaacatatatagataaactaattttgacatgggttccaagggtattcaatagtaaaaagataatcttttcaataaatggtactaagaaaactggacttccatattaaaaaatgatgtcagatcaccatctgaaaacatacaaaaattaattaaaagaaatcaatcacctaaatatataatctaaaacataaaactcttagaagatcacatagaggtaaaatttcatgaccttggatttggcaatgtatttttcgatatgacaccaaaaggtgacaaaaggc

SEQ ID NO: 227578 - DNA, 507 bp, Homo sapiens
ttggctcaggcttgtaaattgctctcactggtttttagaaatgccctggttcttttcaccccactgttctcagcctacgcaaatcacttccatacgacaaggatctgtcgggatatagagagctcaataaaagctagatctttgatgccgatggcagctgcagactccagctccttcccattatcgtgatagactgtctgttgctgtgttcattttggttccaaatccacatcatgttattctgaactcgcaggccagaagccgcaacacagaataaatcctcaagtactgacgtgctaaagtaaacagtctccttgtttcaggcattagaggttctctactgagcatgctatggctgtgaatattttgtattgctttaaggatttaatagtttctgggtgcttctggttttaaaaatcacaaggacagccaaagcctagtagaccccaatatctggactccatagatgttcaagaaatacatttttgagtaaatgtttagttatca

SEQ ID NO: 227579 - DNA, 369 bp, Homo sapiens
tctgaataatacctaactgcagaatgttcctggcattaagtgaaaatagaccaaatattagcattctcaaagcccttatcttatatgcacacatgtactgctcttgttctagctgtggtttagtactgcttgacatcagtagcatattcagttcccatttttaggcaaaaaggaacaaatcgcccttccttgttcaaggaagatcaaggcagatcaagtaaccaaagatcagctatctgttgcaaactttggaaccactgtcaggcttatagtctgcttctatgtacaaagaacaaaaaacactgggaggatacatttaaaaaatcagactatcagaggtagttggaaatttagtttgccctcagatga

SEQ ID NO: 227580 - DNA, 495 bp, Homo sapiens
cggctgcctcctcaggtagaagtgtaagtttggaagctgacacagctcgggaggccgaatcaggaggacttggtgactgattggctggggagggtgaggcgggaggaggagtcacacagatggctctgaggtctggagccgggggacagccggtgccacctctgatagactctgcgagaggagccactgccagcttcgggccgccccatccgtcggggatccggcctagggctagggaggggtggctgggcctgtgcaaacttctactccccacccctatgtcctcgtcttaaaaaaaaaatcggcctggattttgagcaggtcgttatcaggggtgagggtccatcctgggggtcccctccaggcggccgtcttcgagggagacccccaggggcagcctggcaccgcgcgggctcggcctggtcagggccgtggcccgccaggcccaagtccccagcctgccatcacccaggagtggggtggcgaggtggtttt

SEQ ID NO: 227581 - DNA, 432 bp, Homo sapiens
gtgtaagggagacatcacacacacaagctacctgtgggtcccaaaggaagggaaacgtttgcttgaagtaaacaagtacttttatcaggaatctctagtggaaagagaccacctgacagtttcctgtgaacaagccaaagtacccttcagaggactggttctagatggaggtagattcccaggactgacaaacacatgccttttctaacagagcaagggaaatgaacggcagctgttagtttcaggagtcatttagctccaaacagcagtgtacagtgttattggaaggttcttttaaatgtacctccttctccctcaaaacacagcacacacatgcacggacacaaacacgcaggcctgtttgaagtgtcttttcaaaccattactctgacagctcacttggaaagtattaaaagtataaggctttcatca

SEQ ID NO: 227582 - DNA, 496 bp, Homo sapiens
taaagtctcaccgctcacccaattctctgctcacaaacagactgacggggcccatttgcattctgaagtgcagctcccctgagtcccctgtccctccaggcaggtattattagtccccttgttttgttgggtgactctgaatgggagcctgtttacgggctgggttcctaatagaaggcttcggttccctcctaataatctatcccctggtgggttttatttccaaagtacagcagtacagaacctgccctcttgggagtttattgggcttttttcttccccacaatattttctcccacgttttcatgcgagggaagagtttcctgctcgtggaactgattgttgaccaagccacctgcgttggtcttttgtgtcctggcaagagggggttcacggaaagtggggggcaccctcctccccgcctcggctccatagagcatctcaagaacacggaaaacctggatccggttggcatcaataaaaggagtctgggtca

SEQ ID NO: 227583 - DNA, 471 bp, Homo sapiens
tcagatttctgattttttcagatttttgaatatttgcattacaccaggctggctgagcatcccatttttgaaaatctaaaatctgaaatacgccaataagcatttcctttgggcattatatcagtgcataaaacgttttaaattttggagcatttcagatttgggatttttagatttgaaatgctcaacttgtaacaccagtgtgacagaggtagacccttcatgcagcttctgtgagagatgtatatttttgccataattatttacctaactcagattattggttaccacaaaatatatgctcatcagaaaaatactggtccaaatttgcttttcaagcatgtttatttaattgtagtataatgaagacaaatcttcagagctagttggcattatcattaatttatttggacttttgtggaaaacagaggaaacttgaaacctaaatggccttttggatgccaaaggaaa

SEQ ID NO: 227584 - DNA, 474 bp, Homo sapiens
aattcttacatattagtcaactgactttggacaggctatttaacatctctaaatctaagtaaactcatctgggggtggggtggggagagagaaagagtaaaagtttaaatgagatactagattttaatactgactgctctcattgtgttagaagttattactgttgagtttgtgaaccgagatttaaaagtatgacattgaatgggatatggttacatatccgacatgtgtagatagatgcacaggatggtttgtgttgaagacagctgtctccatgacaaccacattgccctctacttagcaggtcccctgacaaatcacctaaggcagcgttttactcatagctcaatgattcctggctgttgcagatgctttaataaggaggaagagagatttttctcctttttaatataagaatagcttttattaattttaattacacatataatacattaacacattctttttactaaa

SEQ ID NO: 227585 - DNA, 439 bp, Homo sapiens
agagaaagtgtatactttcctccttgcatctttagacatcataatgctgttggaaactggcctttaccctcagtgaggcctgatgaagaaaaattgtttctaccacctgtgcacacataggcaaggcagaaagtacagggagtgccactgtaaattggaagtgtttttggtgacagttgagcatcagctctgaccttactggcctcccctggagccttgttgaaggaacactggtgcaaatccttgagggaacaggggcagacttctcaagtgaagcaagcagaagtgcccgctggccctgaaagggtaggctgctctgctcctcggaaaggaaagtccagtgggacctcgctgctctgctcccaggtacctgtggctccactcggcttggagggcatctgaagggggatgtggggttattgtgtctgctctctgtgtt

SEQ ID NO: 227586 - DNA, 459 bp, Homo sapiens
ttgacttttgacaagaatgtcaaaagaatttaatgggggaaggaataaggaatagtctcttcaacaaatggtgctaaaacaactggatatccacatgaaaaagtatgaatttggagctctacttcacaccatatacaaaatgaactcaaactggatcaaagacataaacgtaagagctaaaactatgaaaccattagaagaaagcatagacatacatcttcataatctcggaattgaaaatggtttcttaagtatgatgccaaaagctcaagttaaaaaaatgtgtatatatatatatatatatatatatgtatataaattggacttcatcaaaataaaatacttttgtgcctcaaaaggcactatcaagaaaacagaaagaaaatctacataatgggaaaattatttgctaattatgtatctgacataaggagcttcaatatgtaaaaatctcttaga

SEQ ID NO: 227587 - DNA, 665 bp, Homo sapiens
ttcacccagaatgtaatacacatgtgaactaaatgttttctgttgctgacgttttgtaggcttctgaaatttaatgagacttttacaaggtttaccttttttcctaaagtttaatttttaaactgacttaaatgttttttgaccctttggttatatttaagaagttgacttctctaatttccttgtcatgtttatttttaaatatctttctctttaaaagttgggatactataataaatattcagcaagtattttgcatttaaatataaaatcttgttatttggattttaatactttatattaaatgcctttaagatttattaaaattttagattaactgaactctgcttttttgtcactggattaataagcaggcttgtatctgacataatagcttaataaggcagtgacaatttaaatttgtcatgagtataaattgaaaaatcataatttagaaatcggagattgaatatttcatggcatttatatttagtgttttatataatgattaatgaaaagaaggaaaacttaaattttttttcaaagatggataggttcaggccagatgcagtggcttactcctctaatcccagcactttggggaccaaggcaggaggattgcttgaggccgtagactaggcaacatagtgagatcctgtctctac

SEQ ID NO: 227588 - DNA, 616 bp, Homo sapiens
ggccactgcactccggcctgggcaacagagcgagatccgtctcaaaaaaaaaaaaaaaaaaaaaaaaaaaaaaaaaattcatttaagaccacggcatcttggcagctttcttacaaacccatccttctgaaatgttgcttcaaattcatcctctgctccccagtcccactattccacacatactgttactgtttctttatcctactttctcaattttggaacatagtggcagttactgcattgaatacctgtggttggcctgtgttctgtctgtctctgtgttctggtaatagtgatcccagagataaaatggacagttgtaatgcacagttaattcagaaactagaccttacttgctgtgtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcattttttt

SEQ ID NO: 227589 - DNA, 439 bp, Homo sapiens
gtgccccctgcctgccccagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcg

SEQ ID NO: 227590 - DNA, 759 bp, Homo sapiens
ttcttttacagctttaaaattgtgaactgatttaacacatctgtgttggtattctttccatggcttgacatggctgggtactaaaattgtaattcataaagcatatgaaactttgacctataatggctgacattcaaaaagtaatctcagatgacattcagagtaatctctgttaagggtgagactattcactagaatttcaaaaacaatataattgttacctaaaaaattacctattgtcactttacttccggtaaatatctttcattaaaatttcagttactgccacttgacaattggcaaatatttgatatgtcacactatctaaaacatggctaggactcaatatatttttattttaggtatgtataagagttaattgccaatggaaaaaaaggttgcttgcacttagctagaatttttttaagactttgttagcagattcctccaaaggtatcaaagaattgtcatgtttccagttattaaaattctactctcactttcaaaattccgataggaccattaaaactgatttgaagagcatctgctaatccattttcacctataccgatccttctgaggaactcctctgtattggtctggataaagagcaaatatcagtaaggattaaaaattggcaaaggttgttcatggtggtttacgcctgtgatcccaacactttgagaggtcaaggccagaggattgcttgagcccaggagtttgaaatcagcttgggcaaaatagtgagaccctgtctac

SEQ ID NO: 227591 - DNA, 889 bp, Homo sapiens
tgccgtggcatgctggtgggcatagcttatggggaggtgcttctgccctgttctacctagtcctcaatttggccccatgtccgagtcccttctcctacctcactgccataccatcgtgggtttcctctccagagaatgctgtgaggaaccagtgagtgattccacctcaattttatgtggttttggggaagcggagcgagagaagagcaagtaaaaccaagaatctcttgccatacacacgttacaggcaggacaattgtggctgttgttgttacttctgtatttactcaatttttaaaattaagctcttggcctaaagatccaacatgtaacttcaggggagtccttcattaattaatactactttaaaccttagcacacatcgtctgggaatgacaaataagcatttctttttttttaaatttaattttattattattatactttaagttttagggtacatgtgcacaacgtgcaggtttgttacatatgtatacatgtgccatgttggtgtgcatttctaaatgacttttaagcaaagatctagatgattgaggtactcagagatcaaaggtggagggaaggaaactgagattcaggaacacttggggactagttcaagagccaggatatggccaagcattggaatttcgtccactctcttaacgctgcatctccaaggacctcaagcccagaaactcttctttaaaaggcaagcagcaatgctcatgtttcaaaacataaaatacagttggggaaaaattagttgggatattagtcaaaaaatagctcaatctttttaaaactttatattagaaggtaatcccctaaatatggctgatggcttcaactcttcaaaatgtaagtcaaaaacacaattaacacagtc

SEQ ID NO: 227592 - DNA, 492 bp, Homo sapiens
actctttcctggaatgttccaccctctgctgtgctgtggcctacactgaagcaggagacacagaagcgtggtctattctactttaactgagatctctcattggacacaggtctgcagtggcgcccatgattggcttcgagtggctgcttgctcagatctcaaggagcctcatctatttcacatgagataaaccagatgaggtgtcctccctgattcacagccctatgcggctgtgatcttcccattactctggctgtggctgctgagtcttctcccagaggtccagggggcagcagaagaaagttgctgataccggcaagcagggcctccctcctggtcccctgcccagcccgcgcagtccactttccaggcttccacggcctgactccagccttgccagccatccagagatgcccacatttgcataaagtaattgccctttaaaagcgtcttttaaagagaacactctgcatctgaggattataacaacag

SEQ ID NO: 227593 - DNA, 233 bp, Homo sapiens
tagctcatcccctgcaaagaacacttttcagtggcaggtgtttccaaagtaatttttagggcattgttaaaattggttgcttttaaaaacatacagaaaattttaatgtgttctataaaacagcacctattgcaaatatttaaatgttacataattttaccatttgtgtttaggattattagaatcacagtagttcatagttctacagatgcagttaaaatctgtcaagtata

SEQ ID NO: 227594 - DNA, 452 bp, Homo sapiens
tagatgtcttttgaagtcatagaatggaggaggttggctaacagattgttgtcatgtgagagaggtgacaagtttgatgccaatgtttttggcctaaccaactggaagaatagaattgcatccaatgagaaagggaaggccatgggtaaggcagatcagagcaaaaggttaataaattagttgtagacttgtttagtttgagacatctacttgatctccaaatggcgatatcaagttagcagttagataagtcggagaatggaaaataaatcttggctagaggtgattgagaattagtagtgggtaggtagtatttaaacccatgagacaggatgagattacaaatgtagtgaaagtagagaagaggttcaaagactttttcctggggcaccaaaagataagaagatgaagataaactgaacagtcctatatttattaaaggcattttcata

SEQ ID NO: 227595 - DNA, 553 bp, Homo sapiens
agaaattttctccccatttcaatgactgtaactgagccaaggagtgtgtcatcatctcaacggtgatgggaatgtcctggaggagtttctttgtttcaagtggttttattatctgaagagaaataaagcaagtctctggctgctgctgtctatcaaaaatgtcaggatacgttcctgagaggagtgaaacagctgattttaactttcagcgtctccccaggagaacccccacccccgcagtactgctgaggcgtgatggttatcaggacaaggccaagaggtaactggtaactgccatttaaggatagtgccattgacaaagggtaggtgcgtgcatgtgtcactatatataaaaaacaggtaggtagatgaccgatcaaagaagcccgagcaagccttaaagaacagactcccaggctatctttacctcttgaatgattttctgctgccaccagctgagggaatataagcaatatgttttctaaagaccattattcacttctagcgtgtcctgatcagaacaaaaacctatacaatccgttgtgagaagtgt

SEQ ID NO: 227596 - DNA, 661 bp, Homo sapiens
gggagtaataggcagaagaatggcctttctacatgtccatatccctatatggcaaaaaggacctgtggatgtgatgaagttatggatcatgagatgaggagattattctggattacccaggttggcccaatgtcatcacaagagtacttaaaagcaaaagagggaggcaggagagtctgaggcaagacgcatgacagctagggtcagaatgatgtggttgctgcctggaagggggccaggggccaagggatgcaggcatcctttcaaagctggagaaggtaagaaagtgttctctctcccctagagagagtgtgtgttctcttaggctactagaggtgtgctaatttattccagcaatcatagaaaacttatatagaaggtctcacagagaagataacatttgaacaaagattccaaggaggtgagggcaccagctatgcagatatctggggaagagcactcgaagaagaaaaggcaggcaaacagcagggtgcgtagcccatgtgcatgaagtagagaatactgggagtcagaaggctaacaggagacaggtcagagagagggactggggtgggtcaactcacactcagcctcactggctattgttagaactttgagttattctgagacactgagtataggagagtctatgaatatttat

SEQ ID NO: 227597 - DNA, 500 bp, Homo sapiens
tgctcttcttttctaatgttaaaacatttgtgctttcctgagatgaatgctgtgctctcatgaaagattgcagagtcaaaaagtagcctctggagttaagactttctggttttagagcctcctatggccacttactaattatgggtcttaggagagttactgaaccttcataatgggtaccaatcctagatcctgtcaaaagggatccttctcttggcgatgactttggaagatcctttgcatgacaataaaaaaaaaagtattattagatctaatttattagataacacttgggtgtctctaagtgttatggtggtaaacgttcaacaggctctcaaaaatgcatatatgtatatgtttatatagatacatatacactcaaatgtgtatatatgtatatatacacactaatatgtttatcataaattttattgatataaaggttgtgtaacacaagttacaaataataataaaatattcaatattatttattgtaaatt

SEQ ID NO: 227598 - DNA, 368 bp, Homo sapiens
attttaaatgattattactcagtatagtaaatagcagctatttgtggaatattttggagttgaggagcttgatatgttagattttcttaaaattgagcaaaattttttccatagcttggttctcaggggttatagatgcaagaagttcctggaaagagctctaaaccagaaaataacagtctgctggtcaaactcaaaactgtcttggttgatatatgagctggctgtctttactgttacctcctgtcatgatcattttgctaattttctgctataactagaggggaatgtcactccctttctcatttttgctccactaccttcctttctccctggcctcctctctactttgttaccttaagttttca

SEQ ID NO: 227599 - DNA, 1617 bp, Homo sapiens
acagaattttgcttcaaggagattctgaagctcacttaatagggacttggtacaggggagccacacatcaacagaataattagttgatggttttgttaaagatatttccagtcttgagattacatgtgtctttggtcctggacttcatagagtttacaagttagttcatgagacaagacaaatgcatcacaaaaataaataatgcaaggaggccaagtgataatgagaggtgctgataagtgctaggaattcacatgacagattattcccatcacagttccagaggcttaagggagaagagaggaactgaaaatagactacctagaactgccctatccattggggtagccaccagttaaatacgtctcttgacatttgaaatgtggcttgtccaaactgagacatgcaatgagtccaaaatgtacaccagatttcaaagacttagaaaacaaatgtaaaatattgtaattcttatgtcgattacatgttgaaataatatataatggatcaaataaacactacttgttaaacacacttaacaaacaacacaaacaaacaaaaaacaacaacaaaaaaaaaaaacaaacaacaaaacaaacaacacaacaacacacacaagacagagagacagagagagagacacacaacgaacgacacacccagaagagaagcagaagagcgagcaacaagaagaaagaacaaggcgaaagaaagaaggagagagaagagagagagcgacaggaggcagaagcgaggcagcaagacagagaggaggaagcaggcttctatgaacgaggcaggcagagcgacgagggagagagagaaagaaaacagaaaaaagaaagagagagggagagaaaagggaagaaaaagagaagcagaaaacggaaaaaaaaagaaaaaaaaaaaaagaaaaaaaagcaaaagaaaaagagaaaaaaaaagaaaaaaaagaaaaaaaaaaaaaacacaaaaaaaggagaagagagaacaaagaaaagaaaagaaaaaaaaaaagaaaaaaaagcgagaaaaagaaaaaacaaagaaaagagaaagcaaggaaaaaagaagacaagagagaaaagaaaaacacaaaacgaaaacaaaggcagccaaagaaaaaaagaaaatagaaagaaaagaaaaacaaaaaaaaacaaaagagaggaaagagaagaaaagaaagagaagagggaaggagaagaagaacagaagaagaggagcacacagcgggacaacagactagcaacgaggaggaaggggggagagggaagaaacagaaaacaaacgagcacacagcgaagacacacgccaagacgaacaaggggagacgacagcacacaggacagacagaagacagaagagagcgagaaaaaaacaaggagagggagaaaaaaagaaagagaaagaaagaaaaggagacacaagaagacagggagagaaaggagagaacagagaaaagaacagaggagaagaaaaaagagacaagaaaaaaaagagaaacgggaaaagaaggaagaaaaaggaacaagagaaaggagaaaggaacgagaaaaagagaaagagaaagagagacaagaggaagaaacggatgcatctcgtcgaaagagaaaa

SEQ ID NO: 227600 - DNA, 535 bp, Homo sapiens
gacattttggttttcattctttggtgattatgaatacagttgctgtgaacataacattataggcttttgtggacctaagttttcatttttctagggtaaataactgtgagttggattgctgggtcatatgaaaaatgtacatttaacttatttataaagaagttgccaaactgttttctagaatggctatacagtactattttgcgttcacactagcaatgtatgagtttcagtttttcctcatcttctctagcatctcatcctctttagcatttcaagttaaatattggcagtatttaacttgtaatgttgaaaattttaggtttacagaagttacagatagaatctccatatatgcttccctcagtatatcctaatgttcacatcttgccataaccgtgatatgtcatcaacactaagaaactgggccagtcatggtggctcacacctgttatcccagtaactctggaggccgtggtggggaggattgcttgaggccaggcgtttgagaccaacctggttctcagaagttagg

SEQ ID NO: 227601 - DNA, 293 bp, Homo sapiens
acaccaccatgccgggccaatttaaaaaacatttttgtagagactggatcttgccatgttgcccaggctagtctcaaactcctggcttcaagcaatcctcctgcctcagtcttccacagcactagaattaggcatgagccactgtgcccagcccaatattgtattttaaataaatgcagttttgattttcttttggacatgatagttacttaggaagctttttttttttaaatttccaaattttctaccttctacttttattaatgtttttcagttttattgtttggtagtca

SEQ ID NO: 227602 - DNA, 658 bp, Homo sapiens
cctcagaggaaatgctgtcattctccaccagaagtctactcttccatctgctctgttgatgccattctctccagcctagtcagaaacaccatcacctaattcagtggtccccaacctttttggcaccagggaccagttttgtggaagacaatttttccgtggaccaggggggttgggggagatagtttcagaggcattagattctcatacggagtgcacaacctggatccctcacatgcacaattcacaataggattcgcgatcctatgagaattgaatgctgccattgatctgacagaaggcagaattcaggcagtaatgctcgcttgtcccctgctcacctcctgcagtatggcctggttctggtccatggcccaggggttggggacccttgacctaaatcatcactctttatagaatgttacatctctcttttcccaggggcatctttccctttgccttcaaaactgcacaccttcatctgaataatgattaaactctgctgctcaccattaaaatgggctgattgctccaagcagtatctagaaagaaactgtttctagttcttcacccctaatcatttttctagatttttgcaaagaataatcattaaatatttcatatgtataaaaaaataaagaatagtttatatagtata

SEQ ID NO: 227603 - DNA, 542 bp, Homo sapiens
gccttgctctgttgcccaggcgggagtgcagtgatgtgatcataggtcactgcagccttgacctcctgggctcaagcaatcctcctgccttagcctcctgggtagctgggactacaggtgtgcaccactgcacctggctaatttattttatttagtttagttattgtagagacggggtctcactttgttgcccaggctgatcttggactcttggcttcaggggatcctcccacctcggcctcccaaagtgttgagatgacaggcatgagccaccacgcccacctctgtcttttctcttgggattaatgacttccacaatagctccaggaataatttttgttaaggtgatgcctggcttgacacttctggtaactcccgttgtttatctattgcttatctccagaacccatttgatgcttcctacttcaaagtgcactagcgcctgtcagcttgaaggcatcccctgagctgctggcaaacaaggcctttttacccacagattaacctcttatttgttttaataaatgataaaaagttggttt

SEQ ID NO: 227604 - DNA, 278 bp, Homo sapiens
agatcgtgccattgcactccagcctgggcagcaagagtaaatctctgtctcaccaaaaaaaaaaaaaaaaaaaaaaattgcttttgttcctctgtgtacccaactgtcttcctccactcctgtttgtccatccttgggccgaatctgtccatccatgcactctttttgctcctctatatggctatctgtgggtgcccctgactatctctgcccctcttctgcccctctctctgtctgtcctaggcagtccatctgtccatccctacaccctgcccctt

SEQ ID NO: 227605 - DNA, 418 bp, Homo sapiens
aaaagctacctatggggtactgtgctatctatctgagtagtagtagcagttatcccaaaccttagcaatacataatatacccatgtaacaaacctagacatgtggcctctgaacctataggaaaagttgaaattaaacaaaaataccaaaatatgtgctctttataaatgtgcagtcacagttaaaatgcatggctatctagaataattattgtttggtagtacactatgttgattcaatattttttggttaattttttttgttaaattttgttccaccattttatattttagtggcttatgttttacagtagcctatgtcacattaattaattgtgtttttagtttttatgtatcataattttatatgacaataattcaactctgtacacattaaaacaatgtttggacaaaagtca

SEQ ID NO: 227606 - DNA, 636 bp, Homo sapiens
agggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagactttgaacacttcccatggccttgaagatccttcatgccccgactgcagcttctgtcatttctccctggctgccgacattcagccaaaatggcctgccctacttcagctcattcctgcatcagggactcgccaggatggctgattattaaaagcttagctcaaatgtcacctccccgaccacccatacagaaagcattactaccccaacccctctgtatgttttccatgtagcgtgtatcactttctgagatcatcttcctcatttatttctctgcatattccatgagagtgaaggttttcctggagcaggcttcttgctttgttccctcctaacttcatgtcaccagaactaggtgtaccattcagtaggagctctacaacttgttgaatgaatggaaaatgaataaatgatcaatattacccta

SEQ ID NO: 227607 - DNA, 572 bp, Homo sapiens
agggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagggagagcctggggtcagaggccctccaggtccttctgggcctcggggcgtaggaacccaagggccaaagggtgatactgggcagaaaggcttgcctggccctcctggcccccctggctatggatcacagggaattaaagtaagtgaatagggttgtgctggagtcacctctgatttcaccagagtgattgggagaagaggttgtagataacgcaaaaatggctattatgaaatagatttattgtgagcctcgcagttaaatggcatccagtgtttagagacatcatctggaagtgtaaaaatggtatgagtacaatacttcagcaaatgctaaacattatataaattgcttggtgcaaaagtg

SEQ ID NO: 227608 - DNA, 432 bp, Homo sapiens
taagctccccctccttgagggggaaatgtccacatgtgttattttgtgccccctgttttaaattgtgccatctcccactcccatcttggttcccacttgcagatgtcatcctcagcacttagcatccatggacaggcagcatgtgtgtgggtttttcccctgtctctccccaccaggacatcaactccagcagggaggggggtgggatgggctggcggagagctcagaggaggtagggagaggcatttactgaagtctgtctttgccaactgtcagatgtgaagcactgtgggcaacctgtgaaatattaataattctgagcccctcctgaaaaattgggatgagaagatccgtcttttagggatattgtgagagattaatgagaatgcaaataaagtgctttgaaccaaccaggttctgatctttttaaaa

SEQ ID NO: 227609 - DNA, 467 bp, Homo sapiens
gcgcgtggtggcgcgtgcctgtagtcctagctactcaagaggctgacatgggaggattgattgagcccaagaggtcaagacggtagtgattcgtggtcacaccactgccctcaaccctgggtgacagggtgagaccctgtctctaaaaacaaaagcaaagtctactaaaaattcactggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagag

SEQ ID NO: 227610 - DNA, 756 bp, Homo sapiens
agaggtaaagggagggactgtaggaagtagaagcgctaatgccctttattaagtcaattaatcaggtctaaaattgaaacgtggttttaaatatataacttcttgcttattttcctccctaactacctgaggatcaaccaccatgataaatgacacagtaactatctggaccaggaagttcatgaccaatcgaccactccagaggaaacaaatggtcaccaatgtccttcaccccggaaaggcaacaaaatgtacaagaccacaataggtgtcatcttcatattaatagttggactcagaacccgtgttggtggtggttaaacaatgggctttggcatgctatctggttctttgaattatgcaaagaaaaatgaactcgaacatagacttgcaagacacagctggcatgagaagaaatgacctcaagaaaacagcaaaaggaatgcgagggcagaatgaagtcaagagactgcaaaggccaatgtcagtgctggcaaaaagcaaaaggagtaaagattttgcaatgactttatttgcagtgactgtacaaatttttcatgagatgatcaatcaactgtgaagacttttacatatatataaaacatcttaatatttttcatcatctttgatttcttagatgttctagaaactgatttttagtgaggaaaaactacatttacctgagttgaccagttccttctgtttcacttccatttctttttcttctgataaatttacacagcattcaatttgcta

SEQ ID NO: 227611 - DNA, 561 bp, Homo sapiens
gtgatgatttatttttgggctttaagttccatttcattgactatatgtctatttctatgccataccacattgtcttaattacctggggctctgtagtaatttttggaattgggaagtgttttccttcaatttcatttttcttgttcaatattatttgggttattctgggtttcttgaatttgtataaattttaagatcagcttgccaatttctgcaagaagtccactgggattcttgaagaggattgtgtttaatctgtacattaattggggaatattaccattttagcaatattaagccttccaatcatgagtgtggtgtctttctgtttatttaaatcttaactttcttccaacaatgttttgtagtttctatgaatacaagtcttgcagttcttttgttaacattattcctattttattctttttgatgccatattgtatacaggattgtttttttaatttcattttcagattgcttgttgctaatgtagagaaatacaattgatttttgtatatcgatattgtatcctacaactggctgaactcatttattagttat

SEQ ID NO: 227612 - DNA, 372 bp, Homo sapiens
cagggatgctaccaaacatcctaccatgtgcacaggacagcctgacaacaaagaattatccaccctgcaatgccaatattgctgaggttgggaagccctggtggagacagaagtggctgcttggtcagtgactatatttcccagcttcccttgcatctagctgcggccttgtgactggttttcaccaagggaccatgagcaggaatgctgtgcccacatccaggaggagggcttttaagaagtggatgtactaggccgggcgtggtggctcacacctgtaatccctgcactttgggaggccgaggcgggaggatcacaaggtcaggagatcgaggccatcctggctaacacggtgaaaccccgtctctgcta

SEQ ID NO: 227613 - DNA, 484 bp, Homo sapiens
caccctccctgtagttccaactgtgctcctccttgcccactcccgcaagaagctaggtgtgtccctctggggcaaagtccatgccagaagtttacaggagtgggtgtaaaagctagagatggaaaaatagagacagacatgtagcacatccagaggtcctgacaactgcctgtttgttggggaagcaaaccccactttcattttctttgggaaattccaatctcttatggaggaatcctgcctctatcctctataattctgccttgtcaagttcccattttaaaaatgaagctcactgtagcaatgacagggaaggagagacctttggaagaacttctgaaatggttatgggtaggttgggtgtctttaataggggctgtgagaggtaaggtgttgagaagaagcactgggggtagatggggagtctggaccctggccagggcccattgtaggagagagagggctttctgtacctggcggcagc

SEQ ID NO: 227614 - DNA, 287 bp, Homo sapiens
gtaagtaatttggctaccattcaacacttagcatccttgtagcatttccattaagcacagacatacacagatagtgtgagatcccatgtaacttagagggatattttgcttagtccattggaatattaagtgttatgtacggtattcaactgttattattcttggttttaaacttttattctgtgatctcagaaacagctagtacaggactgtacaaatgcatttgtatgcatcataacaaacatgtttatttgttcagactatttaaagtcctaagatttttctac

SEQ ID NO: 227615 - DNA, 529 bp, Homo sapiens
taatatcccagacaaggttttatacttcctggaacctatcagaaaaattattctagaaaatgtctggttctagtttgtccctttttctccaattatctcttctatgaccaggatagtgcctgagatgccctatttaatgcagcttctcctgatgctttggctgaagatggtgggaatccaagcactctggaaattcagacaattctagaatccctccagcttccttgatacctattcatgtcagaacagtgtgccaggtcccttatggagtcttttataaaaaataatagaggctttttttcctgccatcaaaaactttagctagatgccaggcatataactgaaaacatgattatttgctatgtctatatgcatattcatttgccatagataaagcagagatgccaagcacttaatgggaaaataattacaaaatgaatgaattgaacatttttatacctttattgtcaagtatctaataatctaaagatgttgatgtgtctcaattaaactctttgatgctaatgag

SEQ ID NO: 227616 - DNA, 301 bp, Homo sapiens
gcatgatctggtgatgaaattcaagccaaaaatcatcccgcagtcaaaattatcctgtgtatgctctggaagggattgccggggagtctgttccagaacttcatggatactaatgagtggatttgcacagtggatttacccagcaggcatggactgctcctgtttggcccttcagcttctcctggctacctgaaatgggaacccccaccatcccaaggggagcgggcagtctttcaggggatggagtcactgtctttaattctactcagtaattcagtcaataaacatttcttaagcacca

SEQ ID NO: 227617 - DNA, 453 bp, Homo sapiens
caaatctttattttatgacatgactcttcatctattagtccacaaacgatgatcctgctttgcaaacttagatcagctacataccttcagtaaatataaacacagaacattaaagaatcatttaaaataattgtcatcatatgtattcgtgactgctgtattcactgttgcagtctttgcactattaaagtaccagaggatttttcattcttacacatatcgcaattgctgtggttaaatgtagactttgaatgttactgtcacaagcactatcacaagaaactcatttccaattatagtatcgaataaaaatgttttaatgcttctctatgcaatgaaactgaaattgtactcatcctagtgccactggaagcacacgttacattttctttaactgggcttttttttttttttttaaataaattcgaatcaaagattgttaaaacagctgta

SEQ ID NO: 227618 - DNA, 493 bp, Homo sapiens
ttcagagttatgcagccattaccactacctaatttcagaaccttttcttctccccagaaagaaaccccatgcccattagcagtcactctgtatactcgtctcccccaccgttgatcctggcgacctctgatctaatttctgtctctgtagatttgcctatcctggacatttcatataaatagaatcatacaaaatgtggcattttgtaattgacttttctttgaagtgattataaagcaaatgcctgaagaggccaagcttaggatagtgtttgctgtacagctttgacaactgaattttttttaagttgaaaatattactgtgtctgtatatgtggcatattatccttagatgaccgttacttcaattattagaatttttttccctagtattcttgaactgtctcaatattcagtaggaaccctttggagacaaagagcagtaagaatttggaacacatattgacgaaatgaatgtcatttaatacagtagt

SEQ ID NO: 227619 - DNA, 492 bp, Homo sapiens
agatgaagtggaatcatatttaatagcaatactacggcccagaccttgttccatactcttcctatgcattagtacatttaatccttacaaactcacgtgagagagatataattattatcctcattttacagagaggttaagtggtgaaaccatggtttaaacccaggcagtctgactccaataattctcaattgtaaaactttggaacagttcagagtcaagttcataaaaattatgtcataaaactggggcattaagaaggctgactgttgaaaggaaagtaggtatgcacaaagcctttatttgtatttgactcaaatttgtgatgtgttgggtattggtaaggcatgattcgtcttctggctataccacagttcagtaaaaatttgcacataatacatttgtattttttatcatgtgattcaccattaaaaatattacaatgtaccccacactggatttttcaaaatgtgaataaatttagacaactta

SEQ ID NO: 227620 - DNA, 950 bp, Homo sapiens
aacaacggactccaggttcttcagttttgggactcagactggctctcctttctcctcagcttgcagacagcctgttgtgggaccttgtgattgttcccttgctgaaaatgcttcagtggctctccatggcccttaaagtcaagtacaaagtctacaagcggaaaagtgatctgcaaagcccttcaggatctgaccccaggtcacttgtctagtcaagggatggctattttttgttgttttgcttttcagttcctcaaatattcaaagctttcttttgcctctgagcatttgttcctactgttccttctgcttctgtatctcttcatcttggtccgattagcccttactcatatccttccagtttcagtctaaatgtcactcgttccagaaaccactactgacccccccaagtctatgtcatgcaccctttcttcttggcatctgacacttcttggcatctgacacttggcgaaacttccctgttttgcagcttttacccactttgccatagctgcctgtttacttgtgtgtattctttcaaatactctgatttttccagagggcaggcagtgactcttcttcaatattgtattctcaatgcccggtggacaatgttggtactagacagtgttttgaacaaatgaataaatgaaggagagaagaaatgaattctcagtgatatttctgtaagataagcaaccgctattatttatattacacatttcaaataatcttttcaaaaacaagtataactcatctatggtaatggaaatcaaaatagtggttacctttggaggtactgatgaggaaaaggcacaagggaattttcaggggagcagaaaattatccgcatcttactctgggtgttggtttcataggcatgtgcagacataaaagttcaatgagctgcgtacctacaatttgtaccctttgttgcatacgttaacata

SEQ ID NO: 227621 - DNA, 240 bp, Homo sapiens
tgaagcctccccagctatgcttcctgtacaacctgtggaacttcccttgctgaaaatgcttcagtggctctccatggcccttaaagtcaagtacaaagtctacaagcggaaaagtgatctgcaaagcccttcaggatctgaccccagaggaaatttgttttgcaacagaaaacataagaaattttccctgcttggaagatactcatacataccaggtatgctcatcatactttgtataaa

SEQ ID NO: 227622 - DNA, 500 bp, Homo sapiens
gtttttcaaactctttatttgtccatattgttattttctcttacatgtgctacttcaaaacaaataccaatctgctgatgacagtcccttgctgaaaatgcttcagtggctctccatggcccttaaagtcaagtacaaagtctacaagcggaaaagtgatctgcaaagcccttcaggatctgaccccaggtcacttgtctagtcaagggatggctattttttgttgttttgcttttcagttcctcaaatattcaaagctttcttttgcctctgagcatttgttcctactgttccttctgcttctgtatctcttcatcttggtccgattagcccttactcatatccttccagtttcagtctaaatgtcactcgttccagaaaccactactgacccccccaagtctatgtcatgcaccctttcttcttggcatctgacacttcttggcatctgacacttggcgaaacttccctgttttgcagcttttacccactttgccata

SEQ ID NO: 227623 - DNA, 350 bp, Homo sapiens
cattgctcaatttcagcagcaggaactatggtaaaaaataaattggactatttataatctttcagatttaatctctgctataagcagaaaatgtgttgttgtcgtctgtaacaaataacaagtatttaaatgaatctgtgttcctaaaacatatgctattctaagggagaatgcattttaatttcaatatttaatcgtctgccctttaaaaccaagtatctcaaatccaacagagctttaaaaaaaaaaaaggatacaaccaaatatctccaaatacctgatttcttcattcacttgtctcatggtaagttagttattttgccagtgagtttttaaaaataatctactgg

SEQ ID NO: 227624 - DNA, 389 bp, Homo sapiens
ggttttcattaatagagaggaatgttcatggtgcattatttgtttactggcaaatctatgatgaaaaaaggaaataccaagcaaaccaccatggacatatttctgaaaagagggacacctccttaagaagagtcccaggcaggtccttcatgggtatttcagaagagggcattgctatcataggagatgacagctctgtgcatgttactgcccgggaagaccttccagtgggacaagatgtgaaggtggaagatgatgatattgatgattctgacctgtgtatgcctaggctaatgtacttgtgtcttagtttttaacaaaaagttgaagtaaataatttaaaagaaaaatgcttataaaaataaaatatttttgtatagcattacagt

SEQ ID NO: 227625 - DNA, 275 bp, Homo sapiens
tttcctgaattttaaagatgaacagataatccaaaaaaatttaaacactatgtgaatcaaacagaatatatctgcaggttgaaaatgttcaatctctgtccctagacaaacataagaaagtgggccatttctccgatgcctgaaattctgccccaggcatcttctccccagctccctagggcttacacgatagccagaggggtggtttccagctgtgaaggtgaagacctagtaagatgaaatgatttgcccacaagccacccttttgcaatgtg

SEQ ID NO: 227626 - DNA, 446 bp, Homo sapiens
accagggagtttcctccatcatctttgaggtatattcataaatatacacaaaggcagaaaaggtcaggggcggtggcttatgcctgtaatcctaacactgggaggcctaggaggaatgatcgcttgagctcaggagttcaagcgatacagcctgggcaacacagtgagacccccatctctacattgtaagagaaaaaaggcagaaaagaatggaattagctacgtatctcaagctagcttgcaaggtgatcatggtctgcctcagggtgttatcctccccatttctaggttcttgagctttcaagcttagatgcatcactagaagatgaataatgagttgcaattcattcgcagcaataaagccaattaatttttctccttgaatttttttctgtataaattgaacgtttgtcttttgaaaataaaatgtatgctcatctgtatta

SEQ ID NO: 227627 - DNA, 921 bp, Homo sapiens
gtggtgactacgtgggtctggagctgactgccgtcctgacacgtcctagagctgcaagcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtgagtgagagagagagatagcggtggggtagtaaagacagaaatggcccactctgatctgtcttggccttggttgggggacgggcaacaggtttacaatcctaggatccgagcagaattccaagtgtcgaggccaatgagcaagtgtcaggcagaggcaagacgattgcgagcaagagggttcccaccaggatcctgcctctgcctgtatcctaagtccttcttagaactagaagctccaccattg

SEQ ID NO: 227628 - DNA, 830 bp, Homo sapiens
gtggtgactacgtgggtctggagctgactgccgtcctgacacgtcctagagctgcaagcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgtcgaggccaatgagcaagtgtcaggcagaggcaagacgattgcgagcaagagggttcccaccaggatcctgcctctgcctgtatcctaagtccttcttagaactagaagctccaccattg

SEQ ID NO: 227629 - DNA, 774 bp, Homo sapiens
  misc_feature (756)..(756): n is a, c, g, or t
  misc_feature (774)..(774): n is a, c, g, or t
gtggtgactacgtgggtctggagctgactgccgtcctgacacgtcctagagctgcaagcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaatgtcgagccaatgttggtggtacgactcgaatcgtaatctgtctgctanacccgggagtaaaaacan

SEQ ID NO: 227630 - DNA, 977 bp, Homo sapiens
gtggtgactacgtgggtctggagctgactgccgtcctgacacgtcctagagctgcaagcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggtaaaaaacaaaacaaaacaaaaaaaacagcctgcaaaatgagcctgcaaaaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtgagtgagagagagagatagcggtggggtagtaaagacagaaatggcccactctgatctgtcttggccttggttgggggacgggcaacaggtttacaatcctaggatccgagcagaattccaagtgtcgaggccaatgagcaagtgtcaggcagaggcaagacgattgcgagcaagagggttcccaccaggatcctgcctctgcctgtatcctaagtccttcttagaactagaagctccaccattg

SEQ ID NO: 227631 - DNA, 390 bp, Homo sapiens
ccttgattttcaatcttctcagattggttggggctacaaggaagtctgataaaaacatttaacatagcaagagtaatatcattgccataatagattaaacgtgacaatatcaacctagaaaaagacactagattgcaaggtataatgacagtctagcaaatatatgtaatagaggcaaataccccaatgggccataatctagtaagtgtctggatactagtgcagagggtaagttcccatacccatatttaacaagagtcctaaaaattcaagtatgccatggctgctgtcagcattgttaaagtttatttccctcttgctgttttagaacagcctattttatatccaattaattttcttatatgattattaaaaataaatatgtagtat

SEQ ID NO: 227632 - DNA, 383 bp, Homo sapiens
gttttcagtagctgaccagaaaataggtggtttagcactgagcaacaaaaatcagagagaaatgggttaagaagtgagggtgaaaacaagaataaggagttcctttgagattttggttttgtaaagtcagaaaatggggtatagtggtggatgtgggagaatctgtagggtagaaagaagagttttgtttttgaatgagagtgacatgaacattttaaaatattaatgggggatccatttgagtggaagagtttcaatgtattaaaagacatcacagatattcaattttttaccaaattggaggaaatgaggtacaaggcagcaatggcaatctgttttacagaagagaagagatatctgccctacttcacaagttgagaaag

SEQ ID NO: 227633 - DNA, 423 bp, Homo sapiens
ttataagcatatagagacatgattgatatttacatgttgatcatgtgtcctgtgaatttgctgaacttattatttccaggagattttaaaaaatagttttcttgggaaattctatgtagcaaattatatgcaaaccaggatagtttcattttttgctttctaatccaaatgtgtttctttttcttgccatattttgctggctagaatttctagtactatgttgaataaaagtggtgagagtggatcaccttaacttgctcctgatcttaggggaaacattcaggcattaagaaatgcatttcacttaaatataatgtcccctgtaggttttttgtaggtactcattcttgaacaagttaaggaagttcctctttactcctaacttgctgagagtatttgtcatgagtgggtgttggattttgt

SEQ ID NO: 227634 - DNA, 795 bp, Homo sapiens
ggctgaaaggaacactcctgtcggcctgaggtcaagtcagggctgttgctggcccagctgcagtctcccttgcagccagaacccacaaactgccttaacatgcctaccttcattccttccaagacatttacctgaaactccccaagaacacaacacaacagactagacacagggcagctgccagctatcaaacgcccttgctcgtgggaacagacatccgcagtggtgttcattgtggagagatgtacagaagagccctgatgcacctgcccatgggaggcccttgctagttaaggtgactgagctccaggaggtgagggcaatgcgctacgggtccaaatctttagcatgtagcacagtgctgagcacataattagaaaccccaacacctaggtaacaaacaagccccaagtgtacaaaagcctgcctgctccaaacccccgggcccacggggagggctgaatccaggaaccattaatagctgcggtctatggagagcctgctgtcttgtgccaggtgccctatcaactctgcagcacatgaccctctgaatcctttcccaggtcctatgaaggtgttactatcacattttgcagaggaagagaatggagattcaaaagattaaaagctggccccaggtcacccagcttctaagtggtagaacctggacttgaaggcagctgaccccaaagcagggcttccagtgtggggtgctgcactgtgcctgcaagggagagctactctccaccaggaagagggggcatggcattcccaactctcccagcgagctctctc

SEQ ID NO: 227635 - DNA, 624 bp, Homo sapiens
gataagatgccagatttctagatcaagcataaagctgtggagtgggacaataggacttaataattttaatacacttcccacgtgaactgtcaagtaataagctacatattcagacgtgactggcattgagtcatcctgccattagtcaaatgtatgagacttttcccaagtcccagcaacaccaaatttgagaaatcgtataaaagaaaaatgaaaaagtaaatacgtctaagaaatggggaaatcaataaaaaatgtactagcaccaggggcggtggctcacgcctgtaatcccagcactttgggaggccgaggcaggtggatcacctgaggtcaggagtttgagaccagcctatccaacatagtgaaacccttctctactaaaaatacaaaaattaggtcggtgtgagggtgcacgcctgtaatcccagctgaactcaagaggctggggcaagagaattgcttgaacccaggaggtggaggttgcagtgagttgaggtggaggtgcaccactgcactccagcctgggcgacagagtgagactccatctccaaaaccgtgttagcttttatcaggaaaggccattaaattttcttcaatattacctacatcaatttgacatca

SEQ ID NO: 227636 - DNA, 385 bp, Homo sapiens
gataagatgccagatttctagatcaagcataaagctgtggagtgggacaataggacttaataattttaatacacttcccacgtgaactgtcaagtaataagctacatattcagacgtgactggcattgagtcatcctgccattagtcaaatgtatgagacttttcccaagtcccagcaacaccaaatttgagaaatcgtataaaagaaaaatgaaaaagtaaatacgtctaagaaatgggattacaggcacctgccactgcaccctgccagtttttcttttcttttctttttttgagccagggtctcactctgtcacccaggctggagtgcagtggtgtgatctcggctcaacctcctgggctcaagagattctcccaggtcagc

SEQ ID NO: 227637 - DNA, 825 bp, Homo sapiens
gcaaaatagaattatggtcaattgcaattataataacttctatgcattaagtatcttctactacatattagctctttatatatgtcttatataatgtaattttaactaatatcttaagaagtctaggtagtatttatacccatttgcccaaatctggaaacggagtttccaaaaaattaaataaattccttaaaactgcccagctagagtccatttcacatctgtcaggctctactaagctgcttgtcagtctttgacttcctcattatcagagatagatatggtattgataatgtacaaattgtttatttggcccagaaatgtgtttgtgcttttaaatttgaactaattgtctttggcagtttgaaatgtacaatacttgatggaaaataataaaactccactccaattagaataactacctgatttcttgattatagcttctttaatgacggcccattttatattatacacggtttcatatttttcttatatttaacaaacacatatacaacactactgtgtgtaaggcactgttctaagtagttacaaacatgaattcatgtaatcctcaccagtatacttatgaggtaggcattattttatccccattttacaaataagataaatgaggcacagagaggttaagtaacttgctcaaaatcacacagctagaacatggcggagctgagatataaacccagtcagtttggctgcagagtgctcttaactgtatgtatttttcagatgtttcagaatttggtgaaagcaataattgttctaatcctattgctggatttaaaagtaggaaagggtaaatagaga

SEQ ID NO: 227638 - DNA, 224 bp, Homo sapiens
ttgatgctttcttcaattcgcttttgttaacattttactctgtgattaattcaataaatgctatgtctccaaaagtagttgacatataacccactttacatacattccaaaattgcgagtagtgagtttaatgttctactgacaaaagcatttattacacttaagaacttctgtattatgtccttcagtcactgacattagttttgttttttctctttgctctg

SEQ ID NO: 227639 - DNA, 296 bp, Homo sapiens
tgctttactgcagttagggagaactgattgtcatgttgtaccctaaatatcaactaaagtgtctatgacaaaattagtgcagttagatcagcattatcccactctgtatgtttgaatttctctctctgacctgcacagctacttcagaagcccttctgaatgaagctttatgtttgcaattcatataagtacaatacagctggctatagcttactgttttagctgaatgtgataaattattcacagaattaaagtttaactttgtgataacaagtatataaattatatataactga

SEQ ID NO: 227640 - DNA, 313 bp, Homo sapiens
ctgccacccgggccgcccatggcgcctctgccacccaggtcacatgtgcctcacactggcctggctcctgtacacatcacatgggcccctgtcatcaacagttattatgcatgtccctttttctaaagtaaggtattcataacagtttttccaaagttctttcctgccagatagaaattgtgcacagcacagcatcaagtaattcgttagatgcttgttaaatgaagtgggtaggtgaacaaagttaacgaatgccctgttatttttgtaggccacataattgtagtattttcaataaagatgtgacttaata

SEQ ID NO: 227641 - DNA, 282 bp, Homo sapiens
tgagtcttcaggtggtttctttttgtattcactctggggtgttaagtagaaatcggtgagagagatgctgaaatgtgcttatctcatcttggccagtaatagaagtctgccttgtatatattattgtatgtgtgtgtatatattaagttgtatatacacatattaaatatatatacatatattacattttatacacatacatttgtttcctcatgcaatttgtttcagcagaagtaaaaattaaagatataagtaaaagaatatttacagaagcattatttt

SEQ ID NO: 227642 - DNA, 311 bp, Homo sapiens
agtattgaggaactaagcactggggatcacctctctgtctgtatgcgtctggaaggttgcagtattgaggaactaagcactggggatcacctctctgaaaattactcttaaattaacattttatatggtaaatgtaaaaaataagagaccctaaaaagcttcagtttggtattgtgaaatatggattcaatatttgaccaaaaatcatgttgattttgttagacttattatgaaaaaaccaatttgggccaaaaaagggagaacccaagttttgatcctttgcccttaagggaaaattgggtttacatcca

SEQ ID NO: 227643 - DNA, 211 bp, Homo sapiens
aaagggcccaccaatcaccaggcttaaaagcactcagagagatctttggctttagctgctgagctaataagtaacagggagagtgctgggattgcatctggtttctcctcatggaggggttgttgatgagctctcttcactcatccaggaaaattcactaggcttgactatgctttatgacaaatgaataaacaaatctttcagtttatgc

SEQ ID NO: 227644 - DNA, 545 bp, Homo sapiens
aattaactagtatatgtgaactggtagggcttatttgcagataaggaattttagaggtttagccagaacatgtaagaactcagttgttttactatagaaggaatatatgcagtataataaaaatttgatttcaaaagtttattcaaatcaaaacaaaaatttggtgtatctgtgtttcatgaaatcattagttagaagacttagggcaatgacctttctaagtcgcattcactgatattatagaagaagtgattgagattgcaaaaaggatgtctttttgtattcttaaccactgtcaacttacagtgtcttaaaggaatctatagtgcactctggaaatttaaaatttttgttttaatgcagtagaaacttaaaagatttaatgatctccttccttgtatcaaggaccattttgaattggctcaattcacttaatcctggaaggttcccaaaactatattttcttaccaacattgtaagatattagatacagtgattattaaacctcatcaaaaaagaaaaatgttgctaacttattcaaggac

SEQ ID NO: 227645 - DNA, 507 bp, Homo sapiens
ccaacatgcataggttaaatgctgagaattttattttagggaaaagatgataaaaataatctgtacgtggggaatattttaacacacaatgattcttaagtataattaccattgcaatacaaaatctagctacgctggtaagaattccaaggtaaagaagcataaaggtttaaaaaggggtatatttagaaatggattttataacacaatctagaatgcttatttcttaatttactaaaatagtttttagtattgtgtttctgaagccagattacatctataatacattgatcatgttttccatatttttgtggtagtgcctatgctgaattagcttcaccagcagtagaatatttgtaatagatttaatttaagaatactttaaagttaaatgaacaaaataaatactaatattggatggctatagatgaaacagatttaacaggaaattaagagagcagcattaaaaagcaaccactctgaataaaataaccatttataaacaaa

SEQ ID NO: 227646 - DNA, 521 bp, Homo sapiens
ttagaccaatatgtaccaagaactcattgattcttacgggagtaggttattaccagacagacaagtgaaattcagtaggcagaatgataataaatgtcatttattaaatattaaaaagacaaataccttccctattttagaaataaggtaggcaaaggaactgaggagtggaagttgaaggccagctctgggtgctttgtgaacagagcccagttgacagtgggaagatctgtgctctatgctaaggacatgctctgtaatgacaatccactcggttgcactaagaatttaagagcatttatatgaatatatacaatttaaggaaagataaagagaaaaatttgctatcaactctgtgtagatttggaaaatggtgtcaaaggaacagtttcacctgcatttctttgtctagaaagttttattttattaaaaaatgtagtctacaaacgagcctcaatttttggcaataaactcaaaaatgctacacaaaccatcacagaattcggtttgtccttgcagga

SEQ ID NO: 227647 - DNA, 384 bp, Homo sapiens
cccctttcccctctcatctcttgatggtggccgctgtgggtcaaacccagcaggaagccagagggtttccatgtaccttggcctccaggggcacagatggggtgaagaaggttggagagggtggaggggcaagtggaagacccctagcactttccataacttcatatttctaaacaaatgctttgagtctttcctcaaggtaaggaaattctgccttcctgtcagcttcaggagggcccttatctctgtggttaccaatgtggctccagggccccctgcgaagtacactttaagaaggggtagtctgggaggccagggcgggcggatcacgaggtcaggagatcgagaccatcctggctaacacggtgaaaccccgtctctaat

SEQ ID NO: 227648 - DNA, 518 bp, Homo sapiens
tcccacagggctcatgatgtctgtcacactgctttctcaagagtttcattagaaaactaacagtcctgttaacatactaccttttcagccctcccactcccaccaccaagctaggtgaagaagctgcgaacagtagtcaccatattcaatagtattatagctgtgaaacggccagaaaacaaaaccaatgccaaagaaaacagagctgacggagggcgggagggagacgggttcctgatgacatggtttaaggacctgaatcctgctgtacctgaagccatgctatctcagaacatcctagtgacaacaaacttccttttttcataaaccagtttgtgttaggtttctgtcacttgcaactgaaagagacctaacggatgtgcagattgctgttttgcctttttttctttgttttctttctttctttttattgattgttaatttatttccctgctgaaatctatgtgtggaaaatttacaaaacaaccttaaagaaaaaataattccaccaccaagaa

SEQ ID NO: 227649 - DNA, 334 bp, Homo sapiens
attttcctgagctcattaagcatctttatgacaatagttttgaattccttgtcaggtaattaatatagccccttttctttagggttggtttctgaaaatttattttgtacctctgattggactatttttctctgattctttgtgctcctctaattttgtgctaatatccacacattaaaaacaacaacaacaacaacaaaattacctctccagtctctaaggactggcttcatacagagaaagagaccttcattaatcagcctggctagagatgctggaggcctctcaaaccttttctatggaagtgtcttctctggacttatgcagtcgacgc

SEQ ID NO: 227650 - DNA, 552 bp, Homo sapiens
tttcatttaggcttatgacaatcaaaaatgagagaatttaaattttttacaattaagctctggttttgagtagattgtgggttatcacaccgtgcatttttttaatgtacaccttactcaaacacaccctaaaatgcaggcttgcagtctgcgcattgtaaagcaggagcaccgcagatcaattgggggaaaaaatatttaaggttgtaaatttaattttgttctaggatattcattttcatttatggcacccgttgtgtttgagaacatggacccatttatggattagttgtcaacccccagtctgtcacactcaatgaacaattctaagttggagagaatccatatgaagggattagaatgtgctccagtggagcttacacatgactgtttcaactaaatattgcccagctgcctctcctgcagtattatatttttttttttgctacttagttaaattgctagtgtctctaatttcacacattgtcagagctttttttattttgtaaatatactgccacaataaatgtatgtgatgtttcatttattcaa

SEQ ID NO: 227651 - DNA, 475 bp, Homo sapiens
ttttgctttgtggggtggtctcatctgggaggggctgctgtgcacacggggagagcttgctgggcagtgactgcctccggctcatccacagccctggcgtctgtgaagcctgtgtgctttcccctcaggaaagctgtggtggccttgttggggtctctcagaatcccaccttccctagactctacccacttctttgatggctgtgacacatgctgtctgttggagagatggacgcccagttatggtccttccatgatttcagtagtggcttagggcaggaggaaggtggactgagaggtgggagttagtcgtctgtcccaaactcaagggagcactgcgattataaatggtgtttctcgacagagggccttgtccccagataaagaatacttagggtcacctggacaggagcagtgtgtgcacccacgggtgtgtctgtctctgtgtgagtgcatgcgtgtatactgtgcatgta

SEQ ID NO: 227652 - DNA, 365 bp, Homo sapiens
atgggggcttcttttattccccagagagttggtttaccagcaaagagctgcccccaacagtgtcttttctggctcccatggaccccggttgacactgcccctggaccgttagatcaatcatgctgggccatgtccacatgtctacatgtctacactgcccaacctaacatcgtctccacaccttcccatacttctgccttgacttccctaggtgccatctatactgagtctcccagagtctctacaccgacccctgatccctgatattatttacattgtatttattatttattatttattattatatttttatatattatatattatataaaatatataaattatatattatatattaacatata

SEQ ID NO: 227653 - DNA, 376 bp, Homo sapiens
acacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttagcccgcctgcacccaggtgaaataaacagccttgttgctcacacaaagcctgt

SEQ ID NO: 227654 - DNA, 630 bp, Homo sapiens
gcctcagagcctttgccaggcctggagaactgcataggtgcaggactgccagtagttcttcctgctctttgatcattgaaatgttttcttttgtgaagtaatgatggtagaagatgatagggtttctgtttgtttctaattctagtctttacttggcattaagaaattgttagctgctagggttgattttgaaattgtgaagttggagagtccctcctggagctgtgggttggatggctgcagctctgtgactcagctgtgctgggtgcctccctttggggctcagttacctccttttaaggtgtccctagggtgagagagatgatcacgatagtcccttccacctgggcggcccaggctttcctcgcccatttagtgcctttcatgtagaatttccacctgttgtctgctgtgctgccactgcttgtcctccctccctgccacacagagctgtgttctctgcctgccactcacgcctacttctctgatcagggtttgtggaaccctccagcgtggtcaccattctggtacctgtggtaacacgctcagccttggtgtggcacattctaggtctaccgtttgtattcaccagcctgtgagcttgtgtacatgggacatgtatcttcgttt

SEQ ID NO: 227655 - DNA, 452 bp, Homo sapiens
ttaagcatcagaattctggagcagagaaccctagcacctgtccccatgaaaaactctggttctataaaatagttttcctaattttttaatgctcctaaatttcaagttagatatattgaatttacttctttgagagaatgttgaaaaagtgtttgataatttgggtttatgcagtcaataaataataaataatgtcatcattctatactgatgaataaactttgactaaatatttattgggaagcagagtagcattgtggctaagaccaaaggctatgaagttacactgcctgagcataaatcctggctccaccattcacactatgactttgggctgatgacctctccatctcagtttctctgtttgtaaaacaggaataaaaattgtataaaaatatagaaatatactcataggctgataggaataattaaataaaatatttaaaaatagt

SEQ ID NO: 227656 - DNA, 270 bp, Homo sapiens
tgaaattgtctgatttttcttctttagaacagccacctcaaactgtaaaccctaaacaaaaaggaagtcagctcattatctgagttattaactaagaggagatgaagttctctgtcaaactgggaaagaagccatctcaaggtaacaggctagttctaccaaatacttactcatcttacttgcagccatgatacaaataaatatttacggtttctccatagaatgtcacaaagataagtctcctgcacatattttgttttgtttttaatt

SEQ ID NO: 227657 - DNA, 603 bp, Homo sapiens
cagtatgagtgaagatgctaacactgaaaaacaagagcgggaggaatgtccacctcccagtttgcatgcacgtatccccaatcctggatgaaagatcagggccagaagaagcacgccacggtgacaacttcagggcccaacgaaatcctcctcttttcctttggccaagcaatcagaggcccgtctagctgctgttgagcccaggtggcgttaccattaacagttacatttttaaaaggtttgaaccaagcttagttgagctctgggaagtttagctctgacctcagcaaccccgggaaggaataagatctgcctgaataaaccagcggtctcaatcttttggtctcaagaccgctttccacttgtaaaattattgagagccccaagaacttttctttatgttggttacagctattaatattaaaacagaaatttaaaaattgctattttttaaaataataatgaataaaaataaaaatgtcaaatagcgcattttaattaaaaataactattttcaaaaaattagttaaaagaatggtgttactttaaaattttgcccatatctttaatgtcttgcttaatagaaggcatttggattttcat

SEQ ID NO: 227658 - DNA, 398 bp, Homo sapiens
acccacatgtaacaatttggatagtacaatttgaaaattcaattgtatttattattgtaataatgtaattatgtatataattattataaaacaatattactacataaaactattataataatttattgtcatagtaattatgttttaaaatctaattgagaataactcttataatgcattttgaaataggctttatctaaaataatgtaaatgctcagtttatctgtaggattgactaaatttgtaagcaatatctgtaactttttggtcttctacaatatgacagttggcaatgtagtgactgtgaaaatattgtgtcattaattttgacctcacacacaaatgttggctcattatctgtacaaattagttaataaagtcccaccaggtttaatcac

SEQ ID NO: 227659 - DNA, 573 bp, Homo sapiens
taataatggaataatctgttccttgttatatacaaagatgaggctatttgctatgataaatagtgcatataccttaaattatttttcttaaaatggaatatgtttaccctgattccattaatactaatttgctgaacatccctttgtaacgaagctacacttctcccatccctatggcagcacaccaaggttaatgtacctcagtagccacagatcaggaccaacctaagtggtccatatggaaattacctctatgactgtagcctcattagcattattctccttgacaaagctagccagctgtggacctcttatcattaatgccgctagatattgccatacaaattcttgccttatcaaagaaagtttacaattggtatttttactataatgtaacataaaacaatttgtaaagtaattttattcacaggtactcatgaaaaaaaatttcaaatatgaagtaacatgtttttctttagcagtaatacattcaaatcctatttctgttttctgttgtgtgatttaacttttaaaattaaaaaagcataggatttttagaatcccttcaattca

SEQ ID NO: 227660 - DNA, 674 bp, Homo sapiens
tacaatgcctggcagatagcatatgcttagaaaatactgtagaataaatgttgcagaaagttggtgctcagtacatgttttaaatcttgtatgtgtgattatatatatttggtctttgtaattcacggcataataactgatgaaatagtcactattacaattttttcatgtgttcagggaaggaggtcctttaatttgcttactaaggcttaatcttatggtgaagaggagaaataaaaattgtattgtataacaaattgaatacacttgaaaaattatcagccgtttgattagggaatgcatttttagttttcataacacatgaaaatctatatgctgtcaaggaaaggttattctaacatttaaggaattacacaaattctgttctttaacatgacagaataatagaaagagtcctctttgtaatgttagggcagctaagcgtgaccaacataactgagaagtttgttgccattattatcgttaaatctatcattatatctttgtgtaattaaatctttataaaagcaaatgagatgaggtatacttctaataattagtggtttagaataaatgaagaatttataaagtatattaatagtaagaggacacctgactaaaatctcaacagcaaagataactatgacctgaattaaagagaagaaaaaactaag

SEQ ID NO: 227661 - DNA, 486 bp, Homo sapiens
aggccatctggtttccattcccatgttttgagccaaatggcgttcttgcaaaccttaccagtcacctcttgactgctaaacacaaccatctgtactaggtccttgttatatgggttgagtcgtgtgctccaaaaagaaatgttgaagttctaacccgtagtacctcagaatgtgaccttatttgcagatgtagttagttaagatgaggtcatacttgagtatggtgggcccttaatccagtatgactgatgtccttataagagaacatgtaaagacgtggaaacacatggggagaagactcgtgtgaagggattggagttctgctggctgttacagccaaggaacacctggaatcaccagaagccaggaagaggcaatggaatctcctttcctagaggttttggagggaatgtggtcctgccaacaccttgatattggacttccagcttgcagaactctgagagaataaatttctgttgctttaag

SEQ ID NO: 227662 - DNA, 357 bp, Homo sapiens
atctatgagggagggaagccgtgattcaatctaggccatgatatatcagtttataaagcagagcagactaacagaccttgctattaaggaacgaagtggggttaggggttgtctgtgctgacagatggcacagccccgcagcacacttgctctccattttcttccctgtttggcaacaaatgctaagatgcttagcactgggcaaaagctatgctattaatcttgtcttttctcattgaggcttctcatctttccaaaagatgacatttctagaatcgtaagtgcaataaacttaaggtcatagagcacagctcttaaaaagacagtttcatgagctgtaaaaagtaatcatggttt

SEQ ID NO: 227663 - DNA, 692 bp, Homo sapiens
taaataaataatacttaggctttgccccagaacaagtgaatccaaacaactttgctggtggcggtgggggtcggggaaaggtgccctggcattagaacttttaagtttttagaatattctaatcataatagtttgagaatcactgcataagcaccaaaaaagcagggaatatatcttatgacccacatatagtgcttaatgcttaacaagcactcaataagtaggtgctgaattgattaattactacatgtcctggacagtatagccagggatagtcctagaccaacttgaaaagctaataacatttaactagttccatattcccaagagggtcatctctagtcattgttaagtactccctcaactttctctccttcccttatcccagatttgtgctatttcccaactgtccggtaattatcactaaatccatcacaagatgttaaccaccaagaattgtcttcacttccaagtctcattaaatttccccaaataggaatagaggttcaagaaggctctctagagacattggacacaggccctttcagaagaagaaccaaaattgtgactagataatcacacctcaaatagaacatcaaaagagaatactggcgtttgacagagaagtcacaggaaacgcctaagacacagaaggagtaggaagcaagcagtcaggcctgctgagatcacct

SEQ ID NO: 227664 - DNA, 261 bp, Homo sapiens
tagaaagttatttaagtggtactacactgcctttaatatgatcaagcttatgttcattgtaccctgctttataaagatatatttctctgatattttgtttcacttaatgatacacaattttattaattaatgttgatatcagttatgccaaactattgatacatatacaatttgcatactgtatacacttcatctgacttcattattctcatcaacatcaatatcagagatcatgctgaatacatggtatattctagggag

SEQ ID NO: 227665 - DNA, 461 bp, Homo sapiens
taggctacaaacctgtacaacatgttgctgtactgaattctgtaggcaattgtaacacaaatcattaggcaataggtattttctgactccattataattttaccagactacggctgtatatgtggcccattgctgaccaagaagtcattatgcgatacatgactgtacttctttatccattaatctgaatataacgacatcttttgaatcagtagtcacttacactatgacagggtacaagaattagtgggctcttctggccaggaacgggaggagaaattaagggcaaagtaccaactcctcacttccacagatcacagaggtggttaggggttgctagaaaacaatgaagcaagtttattctagattgtttacctggctctgcagcactgtggtgttgagcatgtcacctcttttgtattcatgacacccaaaagaagtaaaataaattccatcaaagt

SEQ ID NO: 227666 - DNA, 186 bp, Homo sapiens
acatgcagcagaagtccagccttgacctctgatatgtcactagatttattaaaaaaaaaaaaaaaagttttacagtggctcttttctaactttaataagcacataaaatccttggggctttggttaggatgaagattctcattcagtggatctgagatgggacctgagtataataactaggtgatg

SEQ ID NO: 227667 - DNA, 601 bp, Homo sapiens
gcagagacagggctgtgaagcttgggtactgctcacatttggataatgaagatatttttcattgtgttcattttaaatgtgaacattagaaaaaactctgagcatatagtcagaggaatagaagaacttgcttgatccttcacattagtggtatttagtgtttttatttaaaggcctcttagagtctgtccctctcttggcacaaaatttagccaaatattttctttcagaagatttacagatccttgaatccacttcagacttaaaagtgtatgaagatgatcataaagagttaatgatggctaacagctgtgatgaagccattagacatggcacctatagaaatgcacacgtttttttactactctacaacagtgggtaaggaacaatgcatgaggaaaagtagagaaaactgtgagggtaaatacgcatgacctcacgtcgtgttctttacataaactactgaatttcatcagtctgattacagtttagattttctaataccaacttatgttttcttttaaaatttttttatttttagcttagagactattctgttaattacttattttttagagacagggtctcgctctgttgccca

SEQ ID NO: 227668 - DNA, 1202 bp, Homo sapiens
ataggctatgaatcaggtttagcaggtcactttaatgagatccaagagaacttttatcccttccttgataccaggagttattgtcttatggcattatctcaattccccacaacatgatggaaggactcacggacactttgttagaaccaaagaaccaaggaaatccaagcagtgctgccatctctcactgctgaggggcttaacaatatgtacatgtggcaggggacgaggttattccacacagcctggaagctactaacattctggccagttccatgactgcctcaattctaaataattacatgtgtgctcagtcatgaagctgaattctccccttttcattcttggtagatactaccaaaagtctactgaaccttgtgttaaaattcttgcgattaacagatgcgcaaagaatcttactttggcagctgaataatacaaagctattcaatctcactgcctatgctataaatataagtttctagtgtaatgattattatatataacataattattcatcatatataaagcaacatacaggttttgggtagcatatgaataattaagcagcaagcagcttcccttctagatcaggaaaccaaacacaataaaacactaacaaatgaataccaagcaacactcaaacaaagaattgcatgctatacaagtaagaacatataaactcgtgtacacagtctcatgccttcctgtgcctccagcatccccttccttctcagctatcatttaccccacgttactctcagtgtttccttccctttctgccctactgctaagaagctcaaagctaaggtttctactcaatttcaataagaagtagcaattcagactttttgtcagttactgtacatttcctagcccctattacttgattattgctcctttataccattataatgtgtatgtgtgagaatatgtgtatcttttggttctaacctattattgaaaactgcttcaaatccttactggaaggagtctgggtttttgttttttaatgttgacaatactctctcattaattttaataattatctatctcaaaacctagattataaggacctagaaggatcttgcttgcttctaacaatcccccaaaagacttaacgctaggcacatggtaggcatccagctgatactggctgatacatattttcaaaagagattttaataaaaaaagaagaaggc

SEQ ID NO: 227669 - DNA, 341 bp, Homo sapiens
ctacaggcttgtgcaaccatgcctggctaatttttgtattttttgtagagacagggttttgccatgttggccaggctggtctcaaactcctgacctcaagtgatccacctgtctaggcctcccaaagtgctgggattacatgcgtgagccaccatgcccagcccacctgtgatattttgatacatgcatacaatgtgtagtgatcaaagcagggtaattaggatattaattatctcaagtgttataatttctttgtgttaggaaaattccacatcttgtgctatagctgttttcagttatatactggattattgaactatagtgaccctactgtgctgttg

SEQ ID NO: 227670 - DNA, 1563 bp, Homo sapiens
  misc_feature (1277)..(1277): n is a, c, g, or t
ggcagagggaaactggcagaaaaacacagggagctgtgtgtgcatataaggaatgcatgaaagaacacaaccctgactgaaacgtaggacactcagagagagaggcactgggtgctgctgctgaaaatgtggccgggtgccccagccaatcagacctcattagacctggtagaaagtaagtgatggaagcaaagctcttaaccaggagacatcgtggatgtgaagggtattgactttggaatcatacagatctttgattctggttggtcgaatcactagctatgtcaccttaagaaattaatttaacttcagtaaactttaagtgtctgatcttaaaatggggatcaaatgactgcccatctttcactcaggctcttgggtagattaaatgataaaatgctgtctagtgtgtatacctgccacatagtgggtacttagaaaattattaaaactccacacatttggataaaaagagagaaatatgggttctagtggattctggagtatcagttcaaataagtgcctgcaaggtagggcatcttgtagataactgccctatgccagcatacagaaaggggtctggacctaggatacagagtggcttcacaaaataacacattaaataagggctttgagtcagaatttctgcaaaggaactatgcaataaaccaagatagagaacacaggatatttgaacaagaagagaattaagttgcatttagatgcaatcaagtaaggccctaatctcttgaaatcatcagtcatgttacattggaatgtaattgctagttttaactgatggagattccttgcagcttaacataaatatctggatatatttgagagataagaagctgtgtttgcagttacagaattttgctctccttaggatgttgggcttcatgagatttcagagcagatagatcacctgcccagacaagggtggcaatccagtcagactccacctcagacaggaactgccatcacctgcatggagtatgggcagaaacactctgatctgaagaggcactgatggtttcctgacagtttggacaaggacaagccagtagccccagtgagtcaccaaatactgcaaaaagttttattaggcactgtctgaaaacttaaactaagcagagcaggcaggtctataaaatacaaaaggatattcatgattattgcaagaaagagcatgaagcagacacagacacaagtattctgggtcatttacagttagttctctaggactgagaagctgcatctctctactacaactntattaaaaggctgaaaatataaatggatttctgggtcttgcattcaccctagatctcttatcgagctattttaaaaatggaagctaacctccactgcagaaagagttcacacagttagaattaatacagtggcagaaagttctaatagtaacacctttagaaattaattgagtatgctgatttcctcatcattttgaaaactggaattaatactatcacgactatagggtgcagattttatggaaaaaaggttttattcctgggaaaagtaattcaattgcttatg

SEQ ID NO: 227671 - DNA, 501 bp, Homo sapiens
cagtgatgacatcaggtgaagatgaagaaaaataaaacaaggtgaaaaagaataagcaggagtagagtgagaagatatttagaaaccatggttagcaatgtccttctaaatgtgcctggtgtgtaataatacttcagaagataatgatttctttccccgtcacattctttagtcccaaaacacaagggcattttaatttatgaaatctcctgtggggaactaggagctccctgaccttcaggagttgtgattatattcccaagatatagctgaaaaattggcacttagtagatatttaataagtatttgttaaataaatgaatagatgaatacaagtcttcgaaaacagaatagtctgcacctaggctagtttacgaaaagactgagatgcttgaggacattctatgtccttttaaacttcatactttcagtgtctatcatgttgcttaccacatagcggtctccaaataagtgtttataaaactcaactgaatgaattcc

SEQ ID NO: 227672 - DNA, 432 bp, Homo sapiens
caggctgctgggatagtcaaggcagcagcctgcccttcagactcacagcaaccaactcagtgcctgccggggcaactggcagcagacgctcccaggaaccctgaggaggtgaggaccgtcagggcagagcactcaggaaactcacaaaacatggatttaggctcagactcgtgagaaaggagggacggcgaggtgtctgcgaatgtgagcagaggcgtggctatctcccggctgctgggagcagagggcaggaccaagcaggggctggggacctggaagggccggcggagcgcactgcaaggcccctgtactcccacaggccatgaggaggagggcgaactgacgatgagacaaacgtggtggccgcctgcaggacccccaaggaggcccctgcagtgtctgcaaaaggacagccagcgattcctgcaccaa

SEQ ID NO: 227673 - DNA, 432 bp, Homo sapiens
gaatccatttgtttggacatttattcaacaaatatttatcaatcaccaatgttccaggcactggggatacattagagaagacttctctcctggggctaaccttcctgtatagcgtgtaaggcgaggacagaaagcaagtagactaggcacagtggctcacgccggtaatccctgcacttcaagaggccgaggcagttagatttcttgagcccaggagttcgagaccagcctgggcaacatagtgaaaccccagctctaccaaaaatacaaaaaacaaaaaaaattagcggggcatagtggcacacacctacagtcccagctactcaggaggctgaggtaggagggtcacctgagcctggggagattgaggctgcagtgacctgtgattgagccacagcactccagcctgggtgacagagcaagactctgtca

SEQ ID NO: 227674 - DNA, 188 bp, Homo sapiens
taaacaggtgtgacaggtgggtggattttaaaatggtgtgacagttgtttccaaggctgggcgtgggtggatcaatagcagtgaccactagggggcaacttgcatgggaagccctaggtggtgaaaaataaatcgtaccaactagcatgatgtttatcatttcctgtcctggcagacacactccaaag

SEQ ID NO: 227675 - DNA, 421 bp, Homo sapiens
gaaggcgcctacgcctgggaatgcccagatgcccctcagagagttgaagatggcgtttctctgagtcaggtcaaagttaacacattaccttcgcttcaaagactgcttggcttcctttcggtggattagtcaagatgttttgctgactgagactaggaaatctataggagggcgggttagtttacattgttccttgtcattatcgctaaaacactccaaagccttccttaaaaatgcgcactgggctaaaaaggatagacaaggaacacatcctgggccggtaattacgcaaagcattatctcctcttacctccttgcagatttttttttctctttcagtacgtgtcctaagatttctgtgccacccttggagttcactcacctaaacctgaaactaataaagcttggttcttttctccga

SEQ ID NO: 227676 - DNA, 505 bp, Homo sapiens
tctcctgctgccacagtctctcatcctgctcccaaagcctctcctgttccagcagctcctccaccttgtccagcagcctctccctctccagcagcctctcctgctcctcttgccacctctcctgttctaacagcttcgccacctcttccagcagcctctcctaccctggcagcttttcctgttcacacagcctctcctcctattcacatagcctctcctcctgttcacatagcctctccttctgttcatgtagcctctcctcctgttcacgtagcctctcctcctgttcacgtagcctctccttctgtctcctgttcaggagactcaacatctgattgttttccacctcagcctggagctgtcttcccacactctccagctccttccttaggtggttggtctcatcttgtagctgctccacctcagagggccctgctgggggctctggggccaggggttcagctgagaaaggaagcagacaataagggcctctggactctcaaaa

SEQ ID NO: 227677 - DNA, 312 bp, Homo sapiens
tcagagtggggccagtggactcaggcaggccttgggtggtcaaccatcctggtttgcccacaagtgacaggtttctgggacacagaattttccatgctaaaaccaggacggtcccaggcaatctggacggccaccctagtggggctgatgctgaactctggttttcagttcaactactctctgtgtctcagtttcctcatctggaactcagagcttataacagtaccttgtgtatggttgctgggaggtgggggagagtgacattaaataatgtacttaaagtgcttagcatccggcacagcatgtcgataa

SEQ ID NO: 227678 - DNA, 191 bp, Homo sapiens
atcactttggtccaggcaataggtgtaaactataataagaatgagaaataaatgttatgaatagttgacaaaaaattaaaatatacctatactctggaggcagacatttattactttcgttgtgcatttggtttcagaacatatggcttcagcaaacacaacagcattgacaatgaagcctgagattggca

SEQ ID NO: 227679 - DNA, 455 bp, Homo sapiens
tccccagcccggcctcctggtcccccgggactccgggccagggtcagcagctcctggagactgaggtggggtctgtggagcttctgtggggagggacttggtgtccccagcaggactgggtatcccgagtcccgggctgcagctctgttgctggacagccttgagagaattgttcgagctttctgatttccccagcatcctccttagcaggctttagaacagggaaccaaaacccaggcacctctgggccagaaggtgaaaggatgagtaaggtggcctggtgctggctccggtgaactggagagaacaggctctcctcaggggacggtggcctctgagccagcaggcggcccggatcttcccatttagtaagagaagccagaagtctgagattgtatgtgaaaagtcctgatttttaaatgttggccaacgagtcaaattaaaaacaaataaac

SEQ ID NO: 227680 - DNA, 555 bp, Homo sapiens
caagaaacaaggttagaaagataaattaggatcagcacctcaaatgccatcctgtgaggcatttgaacttaatccgttcaaaatgtggggagtaagcacactgacatgtcaggatttgtttattaatactctgactttgatggcactatagaggatgagtagagagggaagaaggacacaggaagaggagcttattagctgatgtggctatagtgatggacagagaagagtccgggatattgcagcagaaaaaggaataaaacatagtaatccttgacttcaggagtgagagaaagggaggaattaaggatggctgagggaggcttataaggatgaattcagcctaagcaagtaaaaattccttttacaaaaatatacatgatgccacctaatctggattcacatgctatttcttcaagagctgcagaagaaaaaaaatcaattaaattttactctcccagcttcccaaccaaatggttcctaaatataagactcatctttcatgtttcacaaaacaaaatcatatgttaagaaataaaagtggaagaaattgct

SEQ ID NO: 227681 - DNA, 405 bp, Homo sapiens
ctattcataactaaggctttagacagagacttgacagattctccccacagcagcaccctatcctaaataaaacaagtgatggtttcccatatgttttacaaagcagcacacaagctgtctaattacaatatgtcttagtaggagaatttcaaacttaagacagagaaaatgcccccttttctagagtagagcaattccttagaatttctatgatctcatcatttactcaaagtaggcaaagacatatccctgcttcccagtaatatcccagggaagataaagcaaaggagtagaacctgatgtgttggaaacctattcataatgagtgggcaaggcaagagtagtggcatgtcaactcttgtgtgtcaatgtttcatgtgaatttattttgagttcggccaaact

SEQ ID NO: 227682 - DNA, 339 bp, Homo sapiens
aatgatattaaactacttcaaagacaagttaaaagtacaagtttccctccccctgctgagtttgctattagttttatgtctagggtgctataccctacaatattttgtttttactactgtttagttaataaaaagtcataggaggtcatcatacatgttaagctcaaatgaggtagacaggaataaatggtttcaaaagctgaggagtattacaatttttactttagaaatgattaatagacatgttcagcagctgaagataaatataggctcactaaaatccatcagttatatttgactcagccgggtgcagcggcacatgcctatagtcccagctac

SEQ ID NO: 227683 - DNA, 556 bp, Homo sapiens
cagaatcattaaaatctagttttctgtgcttaacttgcttccaccgattaactttccccaacttattatagtggtcctgaccttggtctattcataaaagaccatagcaaccactaaccggatgggttgctttttataggagcagcacagttttatctactagaggcattggcagatttggattacattgtaaataaatttatccaatgcaaacattcaccaatctgcattgcattgtaaatacattttcccaagtgattgttaagtgatggccttacaatcatgttggcataagaaaaacaaccagagagagattcagtagctttgtagtaagtgttgatgaaggaaatgggatttgtaaggtgacagtcagcttggattagatggatggaaggagagggccatttggtgagtcaaggaatcatcaaggaattgaatttgtgatagacattaagtgttggccatacctatgtaaatatctatgttagatgttaagtattcagctttttgcccgttccctgagctacacatagtcccaagaaggggtattatttat

SEQ ID NO: 227684 - DNA, 482 bp, Homo sapiens
atttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccgaaaggcagaggttgcagtgagtggagatcgtgccattgcactccagcctgcgcaacaagagtgaaactccatctcaaataaataaataaaataaagttttaaaaagtcaaaattaa

SEQ ID NO: 227685 - DNA, 415 bp, Homo sapiens
tgtaatcttcatttagttgcctataaaatagggatattaataatacctacctcctattattataaggattaaatgaggtaatgagtgtaaaatatatagaatattgtccacatatagtatgtgattaatatgtgcttgtgatggttcttttagttatttctctggtgcgctatataatcttattgattacatgacaagtggaattagaaatttctttcaaaatctactacacagatatataaatatgcttttaaaaatcaaaaaattagaaggagataaattttccaagggttaaagagtctagtggaaaaaacactggaatgggaattacacagactaaactctagtcccaattcttttgaccttgagcctgacatttaacttttttgatttcatggatattatataagaatat

SEQ ID NO: 227686 - DNA, 460 bp, Homo sapiens
actactggaaatgggagcttttagcattggagggcatcttaatggaaatgccctgtctggaaaactgtaagatggggtacaccccagttgcctggaatcctttaagtaatgactatctaaacagctctaggagatttaagccccaaaggccaaatgaagaactccccaaaaaacagtctggaagtcagaggagataatgtcctcaactacttggatggctttaccgatttttcaagagacatctatgtctccataaaagccaatgcagtgactaatcgctctcaagtgtctagagagttcctcactcactactgatgttactgctattatttaggattcgtgattcaccaaaccacagcctagagacttcagagggagcatgactctgccaatatcttgattctgaacttatagtcttcataactgtgagagattaaatgtctgtgttttaagccatatg

SEQ ID NO: 227687 - DNA, 496 bp, Homo sapiens
attgatttcaaagatagaagtattgagagctaagactcaaatctgacttatgctacagaatctccaaaaggctaataattggtggtaccaggtgaagtagggggaaatgctaaaaataagggaatgtggctgaaagtcagattaagacgcagtcagatccctatttccctttctcctactccagcaaatgaatagaggtttattctctggaaatggttgaaccagacaaccaggggattccaggcctcgctgaaagaaagggtaacgtactgaaaactgaggaattaaggaaacatgcatgcagaatgctgagaaccctgcctcttcaacccttttgctctaccactctgttcccagtatgcagcttgttattcagctagaagattgaaaaggttttttctaggcaatcagatcagcccaaaaggaaagatcttaagatatttcactagatatttcccaactaatgaactacccagcaagatcactcaatagtgaa

SEQ ID NO: 227688 - DNA, 387 bp, Homo sapiens
tgaaaattatatgggaaatcttcagtaaaattctgcatatgcaagaaatcaatacttgtcactatgtctgtgaagtttaaagctcaggattggcgtgaaaatggtaactcttcattcttgtccacctttaacacacttgcttaaaaatgtgtcagataggccaggtgcagtggatcacacctgtaatcccagcactttgctttgggaggccaaggcaggcagatcgcttgagcccaggagtttgagaccagcctggacaacatggaaaccccatctttacaaaaaaatacaaaaattaaccaggcatggtggcacgtgcctgtagtcccagctactcaggaggccaaaacgtgagaattgcttgagactgtctcagaaaaaaaaaaa

SEQ ID NO: 227689 - DNA, 158 bp, Homo sapiens
aaataaaaataaaaaaaataaaaaagaaaaagaaaaaagatactaatggtaattagtatgtggatagcatcatatctctgtaatcaaatgaggttgaggtaattctggcttttcatcaaagaacaagattttctacattctgtcattttgttgctacc

SEQ ID NO: 227690 - DNA, 404 bp, Homo sapiens
acccctggcagcggacagcccctcctaccctgtgccattgtctggctgggtgactgtgacttcgaatgtcacgattgacgtcaccctgacattcctgccattcccagagtggtccgggaattgggatggaggcaggcacacacttccagggcaacagcatgctcttaggggacagagcaaggaagcatttctgactgtggtcactctcacatccttggacctcagcatcccccagctcagttttggggcactgtataatacctccctggtgataattatgtcacagggtcaggaaattaaaggggtgggtgaatatgtcaccctcttcaaggagaaggccagagaaatgcttgtagacctcaagtgagcagtgatccatagaggcccttgagtccagcatgtgg

SEQ ID NO: 227691 - DNA, 466 bp, Homo sapiens
ttttttttggagagtctcacttcatcacccaggttggaatgcagtggtgcaatcttggctgtgcagctgaccttcctaacatggcaactggtattcaaacatacagacatccagggagctggcattgggacagaatgaaggcagcaagggccagggggcaggtgaggatgagcagtaaatgtccttcacaggtgctggggtgccttcccaggtagggcagcctccatgtgcggagaataaaggatacagacagaacccttctggaaggagatcggctgtgcccagctcccagtgtgacactgagctgctctctaaacttttctgagcctcttttctctttcatgaaacagggagttgggctagaaaatttctttccagctctaaaaatactgtctaaaaaagcagaagaggggcaggcttgaaggcctcgtcctctgggctgtgtgggtctgaggctctggggagc

SEQ ID NO: 227692 - DNA, 539 bp, Homo sapiens
cgcttgaacccagggggcagaggttgcagtgagccgagatcgcgccactgcactccagcctgggcgacaagagcaaaactccaactcaaaaaaaaaaaaaaaggcatttctttacactcttacactcttggctgtgcagctgaccttcctaacatggcaactggtattcaaacatacagacatccagggagctggcattgggacagaatgaaggcagcaagggccagggggcaggtgaggatgagcagtaaatgtccttcacaggtgctggggtgccttcccaggtagggcagcctccatgtgcggagaataaaggatacagacagaacccttctggaaggagatcggctgtgcccagctcccagtgtgacactgagctgctctctaaacttttctgagcctcttttctctttcatgaaacagggagttgggctagaaaatttctttccagctctaaaaatactgtctaaaaaagcagaagaggggcaggcttgaaggcctcgtcctctgggctgtgtgggtctgaggctctggggagc

SEQ ID NO: 227693 - DNA, 388 bp, Homo sapiens
agagaacaccaaacaggtttgacccaaataagactaccctaaggcacatgctaatcaaactcttaaaagtcaaggacaaagagaggaccctaaaagcagtaagagaaaagaagcaaataacatacaaaagaagctccaatttgtctgacaacagacttctgagtggaaaccactcaggtcatgggggaggaggacaacatgttcaaagtgctgaaaaaaaaacaaaccctgccacccaagaatatggcatccagcaaagctaccctttgaataggaaaaagagataaagtctttctcagataaacaaaagctgagagaattaccaccaccagacccatcttacaagaaatgctaagagaagttagttaatctgaaaaaaaaaaacacc

SEQ ID NO: 227694 - DNA, 203 bp, Homo sapiens
aatatatccggccggatatatttatatccggccggaccacttctgtccaatattcatgagcagtcacttcaatagctgtattgggcctacatcctctcttcctcccctacctaagagcacgtatcttcttaaggaaggtcctgtcttggtccaacccaatatggagccaaactttcccaaggaaacatctcaaggcaacttta

SEQ ID NO: 227695 - DNA, 1066 bp, Homo sapiens
gcaaattagttctttgacttgcaattattttgaatagaaaactaaaattcctctttcagaagtgaggatttatttaatttgaacaacagaaactattcggttctttaagaagagtgatgtgttgtgacacgcatggaggtggtgacagcagtagggctcaaacaaagccttgggtcttagagctaggccgaagttacccaaaactgaggagtctgtccagctgatcaaacagctactgtatatgctatcctttaaagcaatatagatgaaaagcatgaatttttatattaatgtgccccatctatttaaatataattactgttatttttctcgatttataatttcatttgtgagagacatgtactcaattttagaagtcaagcatgttaacctctaaataaaagtataactatttctgacaaagcttatgatccacagagaatgcagtttaatgtttgattactgattaaggaaacagaaggaatacacattaaaagcagctgaataagtatattaatcatctatgaaaaatttcctctttggaaataagatgaactaaaaaaaataatagaaatatcataaaactttttagtgaagtacagcgtgtcctactgcagatgtttatactctttaaaacacctctttgtcacttagaatgtgtgatttccaaatttagttttagtttttttctttgaaacgagggtggaatttaatgaatcaaaatttaatctgatatctttgatgttttctttgagaacaacccaagtataagcttccaaggagaaaaatgaatcaggcagttaaatgagttcagtttgatttttattaacaagtgttttattttttatgtatgcgtcacttgtcatttcaacaagtgggtgtcaaagcaccacatggaccttgtttgaaaatgatcaaattaaggaacttgaggtagaaagacaaaagaagtgaacataaaattaagctaatcaatggattttgtgcaaatggttcccaacttcatattaaattcttaattagctgttgtcatagaataataggatggtaataaaatcaactgctg

SEQ ID NO: 227696 - DNA, 287 bp, Homo sapiens
aattgtctaaccaggaatttgaaacaactatgattaatgtgtgaagggttctaatggagaaaatagacagcatgcaagaacagataggcagtgtaaacgggaaaattaaaactctaagaaagaaaaaaatgctgaagattaaaataaaaaaaaatcaacattagcagacatgaggaatgcccttaatgggcttatttgaagactagacagttagaaaaaaacttccaagcttggggatatctctacagaaacctccagaactaaagaccaaatataagattgaatga

SEQ ID NO: 227697 - DNA, 358 bp, Homo sapiens
ctgcaatctccatgttgcagccaatgaatgtgcaccccaccatactgccactgctgttgacatgtgcaaacgagggtggatcacactgccaccactctacggagtatggtggctggcaccacccataggagtgttgtgaccagcggtccaggaagaattcggcctctccagtgtggcaagttcctaacattcaggggccacatatcaaagcctggcccaatacgactccccagaattagagcatgcacttcaggagtccttagctgagtcttggccccctaaaatcctccagaaatgaagccaatcgactgtactcaccttatactacaaccaaacctccaaggacaccaaacaggat

SEQ ID NO: 227698 - DNA, 427 bp, Homo sapiens
tcaagcaattctcctgcctcagcctcctgagtagctgggattacaggcgcccgtcaccacgcctggtaatttttttgtatttttagtagagaaggggtttcaccatgttggccaggctggttgcaaactcctgacttcaaatgatccactcacctaggcctcccaaagtcttaggattacaggcatgagccaccgcgcccggccagaatctaccttttaatcaattggtcaataaacattatgccacaccaatacttggtgtgactgtcatgggctgaatcccaagctgcagagtttttttgagtgatcccacttcatatttgttctaaataattttccatatcttcataaagattccctcatcaactaccttgacaaaatatccattattatgtcagtaattctatcattagccttatcgtaattt

SEQ ID NO: 227699 - DNA, 390 bp, Homo sapiens
aaatgcactttatacaccttagctggccttgaaggttagttaagctccctgttttacaatcttaccaatttaacactgctatcctgtcctccctctggggtgacaggtggctaaaaccacatttagattttcctctgaggggaaatttctctctccttgacggtctcactgttctgtgtctcacagcctactaggaacctgcagggagctccccttgggagtgtctcttctctgcctacctgctttcatctactctggggtcagaatattctctttctttaagaattcattccctggtggaaatgtaagcatgctagaatttattctgggctcttacagcattgtttcagtttttgctttagacattattaaaagtgacttttaaaaaca

SEQ ID NO: 227700 - DNA, 927 bp, Homo sapiens
ctcctataaactgtatattgtgtatatatgtcacattttttttgtccattcaactcttaatagacacttaggttgattctgtatcttggctattgtgaatagtgctgttataaatgtgggagtacagacatttctttgacattctgttttcctttcttttgaatatgtatacccggtagtgtgattgttggatcatataatagttctatttttagttttttggggaacctctatactctttttcataatggctgtactaatttatattcttaccaacagtgtataagaattctccttctctgcatccttgcatccttattttgtctttttgataacagccgttctaactggcatgaaataatatcacattataatttgtttgcattttcctgatggttagtaatgttgagcattttttaatatacctgctggccttttatatgtcttcttttgagagatgtctattcagtttatttgcccatttttgatcagattatttgggtttttgctgttgagctctttatatattctggatattaatctcttactggataaataatttgcaaatattttctcccattctgcagattatctctttactcttttgttttcttttctgtgcagaaactttatttacttttttagtggctttttttttctttcagatctgggaatacatatacaggtttgttatttaggtaataacttgtgccatgggggtttgttgtacaaattatttcatcacctaggtactaagcctagtacccaatagttattttttttttactcatctcccttctcccaacctaccctagtagtcccctttgtacacctacctaatacagggcatgtatgccctgtattagccaggtgcacaaggaacaatggaattcggggagcaggggagaggaacattgtaatcagaag

SEQ ID NO: 227701 - DNA, 397 bp, Homo sapiens
gaacaggttttcaacgctgatgagaatggcttgttgaaacatggacagtagcaaaataacttagatagcattttggttgatgaaaattttgtgactggaggcttctaggaatctaaccttgtatttcccctaagaacaacacttcagagttctagtttataaaacataacctccaagaataacaagaatcaaccctatgtatttaattacgattttgttttctatgaaattgaattcctttgctacattgtatcagtgagtaatcttctttgtaactattagatatttccctgaacaatgcaattaattgtgtgcaactctttcttcttccacgtataaaaattttaaaatggacaattttagaactctctgtataaaaaattaaaataagtagact

SEQ ID NO: 227702 - DNA, 150 bp, Homo sapiens
tgatactttttctttttcatacttttctgcatttttctttctttttttattcgttttggttattttcttttttccctttctctctttccttccttccctcccttcctttccttccctcccttcccttcccttcccttcccttcccttccc

SEQ ID NO: 227703 - DNA, 481 bp, Homo sapiens
aatattaaatgtaattgactctacgaggtaaaactgagttttatgttcccctatttcctatttatgcaatagatttaaaaagtatttttacgactaattatacaattcaaaaattgcctgtgttgaaaagcatgaaagtacatgaaattgtactaccctggaaaccccaggaagtgtttagtttggaaagccagggccacctgctagtgggtgagtcatgggcacaggctcgcacctgccaccgcagacgccacacaggctgctgagcctttccaagcgaaatgccccacgtgcgccaacggccacctcggccgtcgccccacgcttggcccgcagccagaggaagcccagcaacttctgctctttcttaatttctagaaaagagtgaagagaggccttttcaaagttcgcaggatcgggcctttttgtgctccactttggaacaaatcggaagctagggccttccaggtgcgccaccgcc

SEQ ID NO: 227704 - DNA, 455 bp, Homo sapiens
tcttgcagacatgtcactctatcataattcatttcaacattaataatcctacccacacatcctcctcctgtggccggggagtcatctcgcttatcctgtaatgtgcctttaattgcccctgggcagaagtgaactataaacagtctgtcaaagctttaactgggatatcctgttaaagcactttaaataaatattgccatcttttgtagaaaacagaagaaataaaaagaaacaagaccatgtccacaggtggttttctgtcagaattagatgatcttcacattttcatttagaacatgaatagttttttcatcaagctgaacaaaaacggttcttattattatattcatacagcaacttcacccagtatctgctggcttcaaaagccttggcaaattatgtgttttacaatttgctgacctaataagaaacttgtataaactaaaaaaaaaaaa

SEQ ID NO: 227705 - DNA, 445 bp, Homo sapiens
atgagaaagctgtagtcacgtagcatccccagctgagggtgaggcagaggtgggcaggagagtgctggagcctggctggctcattgactgtccttctcctcatgccacatccaacgtggctggcaaacaagactgcctttcaatgaggagcagaagctgcaggttcgtaggtgtccaggtgcctgagtggccaacacgcccaagcaaagaaagtaagcttgtgcttttatggacactaggtaaacgccttcagtttaaattttttgctaaatattttagcttattttattgttatcttccaggtgtctaaatctccagtctgtctgttgtactggtaatttaactctgtaatggaatggtttgctgccaactatttatattaaataattttaaaatatttgtaatattattgactaacaaactattaagttattggcaaaaaaaa

SEQ ID NO: 227706 - DNA, 326 bp, Homo sapiens
atgttctgtgtgcttgctttggcttctccttttaaagaatcacctaataattctttaagtctctcgaattgccgatttgtccttctgtcagataaaatgcatgaagtaagctgatgattctgaataggaacagaatacgttcttggttgatttaaagtataatttagagtttttcattttgcttagagctaatatacagtgcgatgcctgaggtccattgtaaaatcttgctatgtaacctaatcattgttgacaggagaaatttgtctacaatcattttaatctgttgcataataaatatttagagagtctcttattcacttcca

SEQ ID NO: 227707 - DNA, 570 bp, Homo sapiens
cacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaa

SEQ ID NO: 227708 - DNA, 500 bp, Homo sapiens
ccgactctatggactattcctttgaatgtattggtaatgtgaaggtcatgagagcagcacttgaggcgtgtcacaagggctggggcatcagcgtggtggctagagtagccgcttcaggtgaagaaactgccactcgtccattccagctggtaacaggtcacacatagaaaggcactgcctttggaggatggaagaatgtagaaagtgtcccaaagttggtgtctgaatatatgtccaaaaagataaaagttgatgaatttgtgactcacaatctgtcttttgaggaaatcaacaaagcctttgaactgatgcattctggaaagagcattcgaactgttgtaaagatttaattgaaaagagaaaaataaagtccatcctgtcgtgatgcgatgggagcagcttaacaggcagggagaagcgcctccaacctcacagcctcgtagagcttcacagctactccagagaatagtgttatgtgtgtaattcatgaatctctataa

SEQ ID NO: 227709 - DNA, 200 bp, Homo sapiens
ggtagagaggaggtctcactatgtttcccaggctggtctcaaactcctggcttcaagggctcctcctgccttggcctcccaaagtgctgggattaggggcatgagccactgtgcccagttgtcttttatttttgaataggaaaaggtgggagaggaggggagagataaattttttttttttttttacatattactttctc

SEQ ID NO: 227710 - DNA, 426 bp, Homo sapiens
gagctcgcctgcagtcaggatcctgaaaaggccacaggcttctccaccgcagggcttgctgcatgtgcctctccacaccaggcatgagggaacatggctggactgtgcagtgtttctcaaactgatctaaaaacagaacccttggccaggcgccgtggcccacacctgtaatcccagcactttgggaggccaaggcgggtggatcacctgaggtcaggagttcgagaccagcctggccaacatggcgaaaccctgtctgtactcaaaatacaaaatttagtcaggtgtggtggtgcacacctgtaatcccagctacccgggaagctgaggcaggaaatcgcttgaacccaggaggcagaggtggcagtgagccgaggtcacaacactgaactcctgcctgggtgacagagtgagactcggtcttga

SEQ ID NO: 227711 - DNA, 446 bp, Homo sapiens
agattaatctgctgaaatgagatgctaaggatttgcatacagatttgactatacaaaaatagatatggaattaataacagtctctatatgttttaatttctcctagactggagtacccttgcctgcagcagtattcctggctttgaaagtcatcaagctgatttgtctgctctgggttacgatgccacatgctgctatactgtcccctgcaatcaaagcacttgcaaagatagattccatgccttcctctatcgagtatattttatagattggcagttttgatctccctcccccaccccagggaggataatctgcatcttaacagctttctatagatacatctgtcattaaatatgccatctcatatcagcatccatttttaaaaccaagttttctctaactttgaagtgccacagtgaaagtaaagacttttcagccaaaattga

SEQ ID NO: 227712 - DNA, 427 bp, Homo sapiens
gtggtaggagttagacgagatgacacatatgaatcacttggacaccatgttcagcaagtgggacctcctgacagcataagaagttcagagctcaaagactttaacctgtccaaacttcagcactaagggagaccgattatgctgtatgaccttgggaaaatcacctcacttctgggcctcagtttccacgcatgtaaaatggggataaagaaacaacccagctcctgggattgatatgaagactgcatgagatgatacgcaggacacccgtggcacaatgcagggcttgcagtaagagctcaataaataccacctgctatttgtctataagtgtgtttagcaacatctttgaatggaatcatattgtgcattactttttgtaactttttttcactcatttagtgtgatcattaaatatccttcgaga

SEQ ID NO: 227713 - DNA, 115 bp, Homo sapiens
attcagggttgaaaagtaccagaggggaaaaacagcaaatttctttaggctgaagaaagaatcagtgaacttgaagataggtgaattgagattgttcattcttaggaaagaaatt

SEQ ID NO: 227714 - DNA, 456 bp, Homo sapiens
gtcatcatctccctctgctgatttctcttcccagcctgactcagctgccctgagagatcaggaccaaggccaaggacggccagctgggctcctccctccccagagacgccaacccaaccctgccctgaggaatgtgcttctccttggcactggctggtctccagacctaaattcaaccctctttttagcaggctgaatgccaagcccaatctcagcgcccccaggaaggacctaggactgaggctgtgagctctcaacttgtttttttggggcaacaggccagggcagctagccagtgattttaggaaagacgaggtgaacctgtgctcagaggattttttcctcccagtgtttagtaactgtttggctgtgactcactaggaaaagctcatatcacattatttatggcttacacacagcccaaaagaaagtttaattaaacagacgaataagata

SEQ ID NO: 227715 - DNA, 585 bp, Homo sapiens
gctacgcaaagacagcaggagccgtgcctcgaaaaggctgagatgtctgagaaataaagttgtacgcggatttacgcctgggcaggttgaaatgcgtgtgccatgacagatccggaagcttgtctactcgaaggtccacatccagcacctaccgggaaagcgagaagaaagcaaagggcatcactccctacccacgaaagactcacaacatccctggaaaagcaacgaggcgaacggctggtctgcgttcagagctggtgaggagcagggagaagaatccagagcgtccccgcctccctccctcaccgccctcccgcactgatgtgaacacgggagtaacaccgcgcgtggggaatccactggcacccagagcccggcccgcggcagcagaatcacccaagactgagatcctgtggcctgagtcggggccggggaaaccaagcctgcaggactccgggagcagccggtttctgcacacaggtaacatagaactgggggtaagcaaagccacgaggtcggcccgtggcctgtctgcccgtggcctgtctgcgcacagctattaaaagttcaataaacgtggtggca

SEQ ID NO: 227716 - DNA, 401 bp, Homo sapiens
gaaggtcggcggctccgggccagctcgcactggccggggtggggcgggggccgttcctgctgcggaagccccgaaagctttcgcccggcccctcgccgccgccgcgggggctggctggactaggcgggcaggctcgaggatgcggatgaacccaagcgtcctcgagtgcccggaggctctccgcctcagtttcccgcccagaggcaagggcgtgcgaggggatccagatatccaaggacctgaggtttcggcctcgaggtcttgggcgggggactgggcaggctgcgcggggtcccagcgaggggacagctcgggtgggcggccagggtgttgggggctgcgggcggcggacaaagcggcggcaccaccccgcggcgcgggccaatggaatgaatgggcta

SEQ ID NO: 227717 - DNA, 535 bp, Homo sapiens
aaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttcttttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtatttttta

SEQ ID NO: 227718 - DNA, 540 bp, Homo sapiens
catctctacaaaaataaaataattttaaaaagtatccaggcatgatggcacacgcctgtgttcccagctactcaggaggctgaggtgggaggatctcctgggcccaggaggttgaggttgcagtgaggtatgattgtaccactgtactctagcctgggtgacagagcaagaccctgtctcgaaaaaaaatttacaacaacagaaaaataggttttgttttgttttgctctaatacagccaaattgttatttatcatgaaatttgtgatgggagggggatagggaaaaaaagaaatatgcaatatgccttctttcagtcttttttttctttcctgttatgcctctctacttgattctgcatcagtagtatgaccttattttaattttttttttttgttttggtgagacaagagtttcactcatgtcgcccaggctagagcgcaatggcacaatctcggctcactacaacctctgccttctgggttcaagcaattctcctgcccaagtagctgggattacaggcacccaccaccatgcccgg

SEQ ID NO: 227719 - DNA, 324 bp, Homo sapiens
tctttattttagctgctaaaggctattttttccttggcactgatgtaagaatcttttgttttccacttaataaggaggcttaatcctttaatatactcttacactactataagtaccactgtacttaacagtacagattgtcattgctcttgcaatgtgaggacattttgcaaaaaccgttggagacatatattcagtattatttgtgtacggatgtaggtacctgaattgattcactaggttatgttatgcagcaataaaatgattgaaaccccagaaagctctggtactgtgtttagcttattttaataggtcaaatatgct

SEQ ID NO: 227720 - DNA, 263 bp, Homo sapiens
ccctagcagcagataacataacacctcatggagatactaaggtggtttcttaagtcagataagaatgaacagatttaacttgcttttttggtatccatggacaccttagactgttagaaaactctcaggatttgttggaatttaaattgtaaacaaaactgttttaaagcatttattctgaacacctccaacaatggtatcttcaacagtgatcttcaaactggataccattcttatcttcttttccaaaaagcctcccaaag

SEQ ID NO: 227721 - DNA, 633 bp, Homo sapiens
tctggtgtgtttctccagaatatctgtcattcaacttccgagctccaatctttgttgtccctggccatccttctctggttcactgtttttcacacctttctcctctgccttctcgaggaatgtctcaggtgtgcaactacagccttgatcgatttcatttttgtcactggatttcagttccttgaaaattcttttatcattgctgtcagaatttcagcacactgtatcatttttggttttgtcttatattttattgagtattcaaagcagacatttccttaaaatttcctctctgtagggtgggcgctgtggctcacgcctgtaatcacaacactttgagaggtctaggtgggcagatcacaaggtcaggagtttgagaccagcctggccaacatggtgatccatctgcctctgcctcccaaagtgctgggattgcaggcatgagccaccatgcctggccacaaatctgaatgattttcagtttgaaaataaaatataaaaactgttcttggaattatttataaacagaactaacatcagaatcatctgaatcatcagaatagtctattctggaaaaatcagattcatcaaatgaatctttggccaacaactgttggagaatgatgttagtat

SEQ ID NO: 227722 - DNA, 420 bp, Homo sapiens
agcgcatccgactgtcacaatacaacagtgctcatgttcaagtcacccttatttcacttagtaacagccccacagcacaagagtagtgacgctggcatattgttataattgttctatttcactatttgttattcttgttaatctctttgtgtttaaacttcatcacagatatgtatgtataggaaaagaaaagacatcggatacatggggtttggtactatttgcagttttaggcatctactgggcatgatccactgatcaatggtcttggaacgtgtctgccatggataaggggagtctactgtattgattctgattaatgcctgagaatgggatgttatttcattcacacggaagcctttttcctttcttccattctttcttcctttttaaaaaaatctccttcagaaaaaaaagcaa

SEQ ID NO: 227723 - DNA, 3408 bp, Homo sapiens
  misc_feature (1592)..(1592): n is a, c, g, or t
  misc_feature (1674)..(1674): n is a, c, g, or t
  misc_feature (1715)..(1715): n is a, c, g, or t
  misc_feature (2201)..(2201): n is a, c, g, or t
  misc_feature (2326)..(2326): n is a, c, g, or t
ttaatctagatggctacgattctctctctctgcctcttcaggctcatcattggtcaagctcttctgcttttgcagagcagtaccagttgttaaacctggagcttcaggctaggaaaagctgtggcaatctttgggctcagccatttcacccacaggtgtcctggaagcgtgggggccactcagcccgtgtgtctccaggatgatggtggtggagccactgctttggtggagtcactgcttctctccctccccctgggactgtggtcaaccactgggccccaccacctcccgcctggtgattcagaagcaccaaccaactgtaccccaagtgagagtgcagctcagctaagtccatcctggctgtcagtgggcacgtgatgctcacgtgctcccccaacactgcaacttaaagaggctgatgttgcagattttggggaaataaaaggtgtcattgggttggcagcatggagtgttggttaagcactctggagccaaaggccctgggttgaaatgctgcctgtcactttctagctagatcacattggatatattacattacttcagcggtccccagtctttctggcaccagggactggttttatagaagacaatttttccatagactggggttggggtggcagtggggggatggttttgggatgaaactgttttacctcagatcgtcaggcattagattctcataaggagcgtgaaacctagatccctcccacgcacagttcacaataggattttgcgcgcctatgagaatcaaatgccgctgctgatctgacagaaggcggagctcaggtggtcacgctctcacacttcctgctgtgcggcccattcctaacaggccacatactggtacctggccacagcctggggggttggggaccctgtattacttaattcctttgagtctctgatatttaaaaggtgaaatggaaccagtcactgtgttaaccttcctgagcaattcagggatagaaggcatacgtgcttgtgtggtgtgcagcaaagtgctggcactcagcagatgctcaatgaatgttcattcgctggtggcaaaatagtggggtgggtgctgtgtgtcccttgccacctggatggataacacgcatctcaacctccacgagtgcaaaataccttttgtatggatcttgaccctggcagggtcctctgtctccctgtttttggtcaatggcatcccctctgcccaggccccagtcccacatggcttctttgttcctcttcctctctcccccatatccatttgtttagcaggtcgcactggttctaccctggtggtcttgctcaagtagagccccaggtgggactcccaccgttgccaccctaatccacagcttcttcacctcccacctcgtttcacctaaaacacagacagacacagacacatccacccaaacccctcacctggagtgtcaagcccccagccctcatctcatgccctctggcttcattccctccctctgcttgagctcctctggccttgctgttctagagtgtcatgctttcctggctcagggtgttcactcttttggtttcctccatttggaatatcttgtctccanatcctgtcgtgaccagctccatctggttttgcagcagagagatggagtaatggagtaagatcacactgacccccctgagccntttggaatggcttcaggccacctggccctccctctcttctnccaccactttagggcctgtgagagaaattggagggaatgcttaggcacgtgtggcttggtcctaatcctcacgtttcatttgccccccaattctaagaccaagaattttgacttgatcggaattgagttgggagagttggtgtatcacacagacttccaagtatgattttagtaaaggggaagttttctcttcggggcagctacatcttggctttgggttgttggtgctgctgagttctgagttggagtgaattttttgtgagctaaatatggtcttgtgaccaactctcctttcatccaaggcgaggagggtttatgccagtgagcaggccacggattcagttctatttggaaagctagttcacgatcctcacatatgaagtcacagttggcctctggttcagaatagctcctctgacaacaaccttccttcctggatttcagaaagatgtggaatagttcctgaaggctggatggctcccttgncacatctagcctcatgctcaaaatttctttcttcagtagagctaaaaatggagctttttgcttgacagatgtgaggcccagtgaagtggattgacctggccaaggtcatgtggttgatcagcacngatgctgggttctccatctccattctttcagctgggctcggcttcacagtcacctgccttccttgggctttggtctatagcatgtccatctactgtgagagctcagctgtctgaaggaacagggcccagcccatctgggacccccacgggcctccgttagggcatggggagctggaagcacaacatggggtgaggaagaaaagggagagagaaagaggaaggaaggagagcaccagaaggggagagatgggagaaagatgctagaagagaagggctgtgggggtagaggcaggagtggggacacagacggaggtctggggagatcggggctcgaatgtgcccttgaatggcaaacactttggcaggagtctagctggtgaagatggaagatagtaactgcctgctctcttagcattttggactaagttcttctactctcttatcttcttaatttcacagcaaacaatggactattgactaagctttcagagctgtgggtgttctcagagggaggccagccagaacaccagcatctccggcttttcttccaactcccaagttggagctccatctatcagaaatatgaaaccctggaatcttcctcctcctcacttctctgccttaaggtgcgggcagctggggaagagaacattgtgcccagggagagtatattgtgtgagtgtgtgcacttattcatgagtgtgtgcatgtgtatgagtgtgcacaaatgagcgtatacatgcgtgtatgagtacatgtgtgcatgcctgggagtgtgtgtgctggcagtggtggtgtggtagagggtgacaaggtgcatctatacctggccagtgatgtcagcacttcccttgtgcccacctttcctagggaggggctgcactgaattgaaacagtgccagctgggaaatgagaaggcttatcaacaagtctttccttggaggggcaagaaagagctcgagggccgggcgtggtggccacgcctgtcatcctagcactttgggaggccgaagctggccaatcgtttgagctcaggagttcgagaccagcctgggaaacatagtgagacctcgtctctaaat

SEQ ID NO: 227724 - DNA, 389 bp, Homo sapiens
tactactactaaattcgcggccgcgtcgacaggattttgcgcgcctatgagaatcaaatgccgctgctgatctgacagaaggcggagctcaggtggtcacgctctcacacttcctgctgtgcggcccattcctaacaggccacatactggtacctggccacagcctggggggttggggaccctgtattacttaattcctttgagtctctgatatttaaaaggtgaaatggaaccagtcactgtgttaaccttcctgagcaattcagggatagaaggcatacgtgcttgtgtggtgtgcagcaaagtgctggcactcagcagatgctcaatgaatgttcattcgctggtggcaaaatagtggggtggtcgacgcggccgcgaatttagta

SEQ ID NO: 227725 - DNA, 1081 bp, Homo sapiens
  misc_feature (1007)..(1007): n is a, c, g, or t
cgctgtagagctccgatgatggctgttggccgaatggatgaatggcttcattaacttcactgcaacacgcaggagtccttgatctccccccttgaaaggctggagcacagtggcatgatctcggctaactgcaacctctgcctgcctcccaggttcaagcaattctcctgcctcagcctcccaagtagctgggattacagcaaacaatggactattgactaagctttcagagctgtgggtgttctcagagggaggccagccagaacaccagcatctccggcttttcttccaactcccaagttggagctccatctatcagaaatatgaaaccctggaatcttcctcctcctcacttctctgccttaagggctctgcctgccacaattcatgagctggccagaggtctttggattcctcccagtcattgctgagatgagtgaggattgtttcagaaaatcaggcctcctcctggggaatgtgcctcagcttctggtcattcaagaatgaggttggaagagatcattctcctgtttgcaaatgagaaacaagtataggtgtgaagagacctgtccacagccattcaacaaatgaaaagtccaatcgaagatgggacctgatttcttacaccccaggtatctgctcatcatcttgggtaagaccacagggaccaccaagacacccagaagagacacttgattgtttcctggatgttccagttttggggcccatagatatatgccatttactttacatgctttctaagacagatgcattggaatgaagaaaactgaaaagcatgtaaataatgaaatgtagtaaaataattctaaaagggaaagtgacaaaaatgataaaaacatggctgatgagaactgtggaagatacgtaaggaattgagatgaatatgggatatatggcatgagttctcagaatctggttcatggtggttgagggaggtgagcagacatttgggacctggatgtacaaatggaagatccagagcacanaacatacacatttattgccacctttttaagatgtatcttgtgctttgacaaaatcagatgtgatttgaaagttg

SEQ ID NO: 227726 - DNA, 386 bp, Homo sapiens
cgctgtagagctccgatgatggctgttggccgaatggatgaatggcttcattaacttcactgcaacacgcaggagtccttgatctccccccttgaaaggctggagcacagtggcatgatctcggctaactgcaacctctgcctgcctcccaggttcaagcaattctcctgcctcagcctcccaagtagctgggattacagggctctgcctgccacaattcatgagctggccagaggtctttggattcctcccagtcattgctgagatgagtgaggattgtttcagaaaatcaggcctcctcctggggaatgtgcctcagcttctgcgctaagcctggctgaagaggcgaagacccttctctccagcctgtgctcaggaacagacgg

SEQ ID NO: 227727 - DNA, 475 bp, Homo sapiens
aactgagaggcacatggggctgggacgcatagtgccccggccctggaggtggctgtgaaacagaaacaggagccgagcaagatccagaagcacttggcctccctcatttaccctcctcacccttgcgcggcaggcggtatcagccctgcctggtggaggcggagctcagggttctgcagggagttctggctccctcacagcaaagcccgctcgcccagggccttcctgctttccttcagttgtggaactctgggatatgcacatttaatagctgaaataggcaaagtggggtgtggtggcgtgcatctgtaatcccagcaactcgggaggctgaggcgggaggattgcttgaggctgggaggtcaaggctacagtgagctatgatcgtgccactgcgctccagcctgggcaacagagtgagaccctgtctgttaaaaaaaaaattaaaaattaaaacaggccaaagcagagcctc

SEQ ID NO: 227728 - DNA, 487 bp, Homo sapiens
gaaaagactatcttattttatgaatttaaataattgtgaaattatccacttaagggaattaataaattataatgtaatcttaaattttagttggcttacataaagacttaaaatacatcaatttaaataaaaactcatttgtctaaaaaaaaatcaaaaattttccttgtgctttaaatgtgctacctctttaagttctaattaagagaaaaaaagtttaactgtgagtttcattagtggtcttagttaacagcttaaagtattttgtaaaaaaaatacttcacaatttttaaataacttaaaaatattaatacctcttttattaggtttttttaataaggaaaatatataatacatctaatcaagattttttttggacaaattggcttaataatttcattttaaaaatggcttctttattcttatactgtaaaaataatattagcagaatattatagtatacacaagtttagggttcatattctaa

SEQ ID NO: 227729 - DNA, 141 bp, Homo sapiens
gggtaaggcgctgaggatgactgcacagcagcaaagagggctaatatgctccactatggtgagtctgggagagttggtgagaaaactgacaaagcactaatttcaacttttttcaaatttgaaaatcacttttttccatgt

SEQ ID NO: 227730 - DNA, 357 bp, Homo sapiens
tgtgctacaaaataaaaaataaatcaaatataaatacggcgatccatcggaggacaagccactctctcagaagcgctggtgcccgccgcggccacgcgccctgcagcgccaggcgactcgttggcctgcggtgacacccatcacttctgtggttctgagccgggtccaggcaggaggctgggtgagcggggttcgcggggaaccttccctcttcccaggagggcagccccgggctttcaccagaaagggctttgtccgcctggaagtagaggaaagtgtcagaagtgcccggggaggttggaaggaatttccagataattttcaggggtgggggcgggaaccggagaagaggacatc

SEQ ID NO: 227731 - DNA, 621 bp, Homo sapiens
gatttctgctttttcaatttccttttggtttatttttttctttttttctagtttattaaagtggaagcttacataaacaatttgagaccgtctttcttttcccatgtgagcatttaatgctataaatttcccttgaaacactgcttttttagctgcatcccacagattttatgttacatattcatttttgttcagctcaaaatactttcttactccccttaaaattttctctttgactcacagattatttatacatgtgtgacttaatttccgagtacttagggaagtttccagttatttttctgttagtaatttttactttaattccattatggtcagaaaacatactttatgtgagttcaatctttttattgaggtatgctttaagacacaggatatagtctaccttgaggaattttccatatgtggaaggaaagtgtactttgctattgttgagaatcctataaatgtccattagattcaggtcaagtgatgtctggaagactggaggaaaaaatgataaactcacagccagttgtatcatatcatacatctaattgtagtcttattctgcaatacactgcgatttactttttagggtcgtcaaatagctgctacatg

SEQ ID NO: 227732 - DNA, 516 bp, Homo sapiens
gattagagtccaagtaatttggctccagcactcctgcactacttaatacatttgtgtgttgtgttagtaaataaatactgtacaaatggcaagataggccagacgctggtgtttcaataaagcaaactcatcttaaccatgaaagtgactcagcttgagatttaattaatattgtttctatgtgtgaggatctttctttttatggcctttggcagtaaaatgatctaagcgtttttatagaatgtataaaatgtggctttttttgtgtgttaaatactttatgaccttgagtttactgatcctgacgaagctcctcttttcctctttttgcccactaaagatccattttatttatgcacacagttaaagccattgtagtgtagtggaaacagcacatattggatttgtgtgttcttacattttaattccagcattatccattactagctgtgtgactggacaaattatacatctttagaacttcccttttctaacctgtaaaatgagggaaattaa

SEQ ID NO: 227733 - DNA, 371 bp, Homo sapiens
ttaacatagatgtaaatggaagtcttataattctatgagattattatagctaaatttactgttacactgccgttctctgagttattaccctgagattggtgttttactctctgtatttacccagtttgtgttgaatgagcaaacatcaagattattggcttaatgccaaggttcaacaaacaattgttcccctgtttgtgggcttatttatttatttctggttgttctctgcaagaatctgtcaaaccaactctcttaaagggatacctaaaatatgcctggactctgtattttggggcaacaccattcattcattactggtgttactgcaagtgttggcaaatgaattgcaaaaatcttgattatgcaaa

SEQ ID NO: 227734 - DNA, 613 bp, Homo sapiens
cttaggtgggaaaacaactagcaactaaaaaaaaaaatggagtttactaccaactaaaaaaaatggaggtttcaaggttgacctagaatttgaaaactgctttaaagacaggtaagaaagacacaggtagatgtgcaatggaagtagaaattgggtttcaagccccaaacaggctgaggggtgggaaaatagacatattcaggtacatcaatcgttccagtttggcataagaatgagataaatgaagatggattctaggagttaaggatgaaatatgtagggaggtactatgatgtaatggagagaacaaagatttcaagttaagactttggtttaaatcccagctgtgcctcttattagctgtgtgatcaaaggtaaattagttaatctctctgaccctccatttcctcatttgtatgataacaataatgtccaattattccacaaatattttatggcaagccaagtattaactaagaactatgttaaatgatgaagatataaaaaaaccatttattcattcattcatcaaatgaatgccttactgtttactaagttacaccctgagttaggccctggaaatactgataagggggaaaaaagcatgaaaccg

SEQ ID NO: 227735 - DNA, 278 bp, Homo sapiens
cggggccagttgtaattatctctccctccctgtagatcactccagtgacaggcccttgtttttgtcgccactgcaagatagctctattatggtggttttacttgaggtcctaaggcttctgtgactcatatgaaggagcaaattaaagccatgtcctcttgatgttgcttagagggccatagatctgtttacagggtcagtgggaaaagcacaaatagccataacctaagtcctggattccttgaaacatatatgtgaattatgttgagtcctagaac

SEQ ID NO: 227736 - DNA, 355 bp, Homo sapiens
atcaccaagtcaggagatcgagaccattctggctaacacggtgaaaccccatctctactgaaaatacaaaaattagccgggcgtggtggcgggcgcctgtagttccagctactcgggaggctgaggcaggagaatagcgtgaactagggaggcggagcttgcagtgagccgagatcgcgccactgcactccagcctgggcaagagtgcgagactccatctcaaaaaataaataaataaataaataaataaagttatatgtgtgaaaaataatgtgatcacttttgtatccaagccttttcgtgggatgacgtgtttgtagaatgctgataataaatggaaatgcaggagtttttg

SEQ ID NO: 227737 - DNA, 435 bp, Homo sapiens
agtgaaaggcactttttacgtggtggcagcaagagaaaatgaggaggtgcaaaagcggaaacccctgataaaaccatcagatcttgtgagacttattcactaccatgagaacagtatgagggaaattgcccccttgattcaaattatctcccaccgtgttcctcccatagaatgtggtaattatgggagtacaattcaagatgagatttgggtggagacacagaggcaaaccgtatcaaggaccctctccgagaacctgacgatgctgacatcctgatcttggacttccagcctccagaaataaatgagaaataaataggtgttatgtgtgccacccagtctgtgatattctgtcgtagtagctcaaactgacagagacaggcactgtggtgtactcttcttgagttcaaataaatttaaaagtattttatgaga

SEQ ID NO: 227738 - DNA, 441 bp, Homo sapiens
acctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagcaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaaaaaaaat

SEQ ID NO: 227739 - DNA, 457 bp, Homo sapiens
ttttttaatttttcttttttatttttatgcggacatttaaatactaacaatacacatttaactttaactgtgtgttaaataagaacacacagatctgccaaacctttttacctgttgtgtggtgatggaagaggccctctcctggtggacattgaggttgcctccaatttgtctctattacaaacgttatcttattgatgcctctagggacactgttgctagtatttttccagagtagatactaaaatgcagaattgttaggttgaagatcatgtgtattttctgttttcctacaaacaagctgtatcagtttttacacctacctgcagcatatatggagcctatttccctatactctcaccaatactggatatgataggtcatcttcatttgtgttatcctagtgagtgaaaaattacatcttactattttttttcatggagatgaccaaggtgga

SEQ ID NO: 227740 - DNA, 525 bp, Homo sapiens
cagaagcagtaggaaattaatacactggttatacacaaccaaacagtggggtggtgaggcaatgagggcaagtgacaaggaaagcgattacacagaaaaacagccagcttaactaactagtcaattttatccaaacgaaaactcaagtatttctgtagaatgacccagtctaagatgagactgcaagtacaaattgcatcaaagcactgggccactgaaattctgtttgttcttgtaggccctacagaatcctcagtcctccttcatctggggctcaaccaataccaacaatagcatcagcaagaactcttctcaggtggaaggagataagggaaatgaagggtgatgttcccagaatcttattcctaagagtgcaacccttcccacccctccttaggagctgcatgatgttctatgaagaacaggtatttggagcacatgaaggtgaggaggtggctcccctgctaggttaaaacagacctatgatgcttccatgtggacagtcagctgtagggctgcccttcc

SEQ ID NO: 227741 - DNA, 512 bp, Homo sapiens
accacaatccttgttcttatccttatttgtagtgactagtatgaatagggctgcctcataaattagtaaatcctaactatttgataggaatgtgtcagtacttgcagtgggggctttttgtcaaatacagagttatcaggtgttttgaaatggtctactaattttaatagaactttccattatatcctagggcagatagaaatccttcattggtttcaattgagcattcctatcacacttggacaacttttggattctgtagaatacctagacaacagacagtggttttttttttctgtttttgtttttaaaaaataaaatcagtactgcttaaacagagggaaaagggtgaatatgaggttgaaaaacctgttaaaacacatcagtcttgagtaaaatataggaggagtttgttcttagatatcaaaatatatttggtagccaatcatatttaaattaaactgattggtcatcagcatactgattattttatataagaaattgaacttatg

SEQ ID NO: 227742 - DNA, 364 bp, Homo sapiens
cattttctagttcataatttctgccgaagtttcttctcaatagatatcattagtatatgccttgttgttcaagcgaaatacacctaggagtcatctgatccctcactgaaccgcactttaaaacacaaacatacataatcaccccaacaattgaaggattacttagggtcacttccaaaatgtatcccgaatttatatgggtcttttcattttcacaggtgatgcattagtcaggccaccatcatctagtagcaagatggctagaatagtcttttcatctaatgtctaaatttcaactcctttttcaggccaaatgatctgtgactccaggctgcatcatacctcactttccttcactggctca

SEQ ID NO: 227743 - DNA, 443 bp, Homo sapiens
aggagaaggctgaataaggtagataccaggatcagtcacattgagaaactgggaggaggtgaactggaaactgctgagggtgactgaaccccacttttgatatcagaaagtccaatttatatttaaaagggatgctgaggcaacaaaaaaattgtaagaattcactataatatacttgggtatatataggcataggtccttagtagattctgtttagcactatctaaaccagattcaaatatcagcatttaaattaaatatctagcatggaaaaaatactattccttgaaaattttgatagaaacagcaagagaatgcaatagtattttcttaagcctcctcctttgtgtcttgagtttattgttacagactgcagagtgctatgtatttaatggttataattgtttgataaatatataaaggaataaaggaatgaactttaa

SEQ ID NO: 227744 - DNA, 284 bp, Homo sapiens
tatcctggtgtttataaaatatgtagaattaaatatgtgacaatagaacaaagaacatcatgtggtaaatggaattatactttaattttgacattaaaccaagaatggtataacaatttcagagagacagtgattaagttaaagaggtacattataatctctagtcaataatttttttttttttttaagacagagtctcactctgtcacccaggctggagtgcggtagcatgatctcggctcactacagtctctgcctcccaggctcaagcgattctcatgcct

SEQ ID NO: 227745 - DNA, 516 bp, Homo sapiens
cacgacctttattacagttatgagctatattagagaagaggtgctaatcaacagtctcttttagcttacagctgcccattctgatctttctgtgtagccctggatgatccagtttctttttggaccagccctggggtatgaattgggggatggagggtgggattgcccacctgttctttgttacactggcataaatgtcctacttgtgacagcactagaagccagtggttgtctggatcctattcataatcaaattcaaataagatgatttatcttctgaataaaaatacttgttttatatatgatcacaacagtgattcctagccttagtttgcaaatacctaggatgcctcaaataatttcaggttataatctctaaattttcctttttaaaaaagtggggatagaggacaaaaataatcagccatatgttaataattattgaaactgggtgatgatacatggggattcattatattactattctattataaatgtttgaaattttctttatta

SEQ ID NO: 227746 - DNA, 447 bp, Homo sapiens
atctctctgactgattctcctgcctccctcttacaaaaactctagtgactacactgggccacctggataacccaggatcctcttcccatctcaacatcaatttaaacacatctgcagaatttctttgccaggtaggggaacatattcacagatcccagggattagcacatgggcactgtcagagtcatgcaagccacaccccaaattcagcctccctgcaacctgcgccccgttccgtgcctgacaccaccatctagtcagtagcccaagccacaaaccctccttcctctccccactgtcactcttccctcaattaaaactgggcgctaggccaggtgcagtggctctcatctgtaatccctgcactttgggaggctgaggtgggaggattacttgaacccaggagtttgaggccagcctcgccaacatagggaaacctcatctcta

SEQ ID NO: 227747 - DNA, 355 bp, Homo sapiens
acacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgt

SEQ ID NO: 227748 - DNA, 489 bp, Homo sapiens
tgttcaggacctgtgctcagggctgtgttctcattttgaggttggattttgtacactcacattttcatttatctctctagtgctcaagatattcacaaactttttcactgtcagggatgcataaaagaacaatactttattagagctatattctaagccaactgggtcgtcgtaccttagattcaaagttagattatggctcaaaatgaatccttagcgtatttctggtgttcaaaaagaataggttgaagccgagacgggtggatcacttgaggccaggagttcgagaccaacctggccaacatggcaaaaccccgtctctactaaaaacacaaaaaattagccaggcatggtggcgtgcgcctgtaaatccagctacctgagagcctgaggcagaagaatcgcttgaacctgggaggtggaggctgcagtgagccgagatcatgccattgcactctgacctgggtgacagagttggactatgtctca

SEQ ID NO: 227749 - DNA, 671 bp, Homo sapiens
ggcttgtggaagtcttgaagcagctgggcaaggtggtgcctggaagcctgagatcctgccggctggaccaaatgcgttgtccacaactacagccgctgatgagtgtctggctgctcacctgtcccctaggggccccgctgagcccccaggctgcatcccctggcccgccacggagaggactccaccccaccctcatttcccaggggaggagccgggcctctgggacttgcggaggggcctgcaagtgaggaccgtggctaccagggacctggcggctgcagatgctttgtgggaggcctgtgtgcagcccttcgtcctgcccggagctgggacctactaagcagtggagttcagcagggctgggtggagctgcatctccctcctggggtgcccacccacccctctgtgctctcacgctcacaaggggcctggaggtcccagttgctagggggccctctattcctgggtcccagatgatggaaacgcaatgttaaaaatgttcaccagaccaacctgtactggctgcaattctcaataaagcagttgagggacacacccagaacagtgggcgcttctgccagtgccgccgtgccacttagcctctggccatgaccccacaggaacaggagcggggctatagggagcccctagggttatacaggaccctccgc

SEQ ID NO: 227750 - DNA, 463 bp, Homo sapiens
cagctcataggtgaccaggtcccttttcacaaaactactgaagacagatccaagcatctcaactcacctactactgagttcaccagcaagatctgaaaggccttattgattaatggcttcccatgatataataggcttgtggtatttgattctcttcctatgatggttatagatccgttaatatctcaccattctatacccatgagacctcgtcttgaagggtcaatattatcttttgataacaattttggaccacagaaaagtataagaattaactgaaagtagacttcaatgaagaaaaaggggcaaaaaggaagcctaacaaatatcaatggatgattcctattacttagttaacaaaatgttttctattatgatgcatcagaaagtatgactaatatgttgctttctcggtggattttatgatacatactttttcttgcaagcaattttgcagcaagtt

SEQ ID NO: 227751 - DNA, 96 bp, Homo sapiens
ctctgtctctctctctctttctttcccctccctcccttccttcctctctttctttttctttcttcctctccgcctctcttctctcccttcgccttt

SEQ ID NO: 227752 - DNA, 465 bp, Homo sapiens
gtgctgggattacagacgttagccactgtacccagcctagttcaagttttaagcattaagaattgactctttggaggaatagggatcttttaaggatctctacagtcagtgactctaaatgtagtgtttggaccagtaagtagcattagcatcacccaagaagtcattagaaatgcaaattcttggccaggcgcggtgcctcatgcctgtaatcccagcactttgggaggctgaggtgggtagatcacgaggtcacgagttcgagaccagcttgaccaacatggtgaaaccctgtctctactaaaaatacaaaaattagccggccgtggtgaagggcatctgtagtcccagctactcaggaggatgaggcaggagaatcacttgaatccaggaggcggaggttgctgtgagccaagatcgcaccactgcactgcagcctgggcaacagaatgagactccatctca

SEQ ID NO: 227753 - DNA, 344 bp, Homo sapiens
gcagtaaataggaggttaagagggctgtgaataagagctctagtgacaggcagggcataaacgaatatatttacaaacttttagaattatcttatataaatactataactttaatacaaaattttcaaatttcacttacaaaatctctgtggttacttctgagaaaggtgtgtgttttttttttttttttttggactaagtaccaaaatgaccacatttttgtgaaagtgggccaaagtaaagttttaattattatagtacaccaattgcatgttttgaaacaatcatgtatgaattagtaaacttttttctttgttttataaaaccgttttttttctttccta

SEQ ID NO: 227754 - DNA, 553 bp, Homo sapiens
cactaggtctcaaaaaaaaaaaaaaaagaaaaaagaaaagaaataaatatatgttatagtgccagttgatgttaagtgttgtgcagaaaaataaattagacaagcatcaagattgacaggtgctgctattttaggtaaggagaaggccgttcgaggaggtaacatttaagcagatacatgcatgaagagggggaccatgaaactgatcttcattgatcagtaaatcatatcctggtgaagtccctgaactctaggaataaagaaagattcatacaagcagactgaaaaagtttattttggggtggaaaaaccaactggctccagacctacctcttcaggaacagtcaaagccagaaaacaatagaacagtgtttgcagagttctaagggaaataaaatataagccaggaattgtgagccagccaagatgttcttaaattataaaggcagctgacatcttcgagccccacacatttaggcaatgcaacctttcggcgctttccttttaaaaattgctcaataacagaatctagccaatatagagatgaagcaaa

SEQ ID NO: 227755 - DNA, 668 bp, Homo sapiens
tacgcatcgtcttgtgcccggctcttccattttgtacctcacccgtttttcccacatttcttttcccgtgcttagtgtccataatatggattccaagtatcagaatctggtgattagaatgtctaagattcttccctagaattttgtggttatttttttactgctacgttgtttgactagtctccctcccctgcaataggtcagtgactttccttctatctaaacttctgaaaattttccagagacttcaactgtgagacagtttgggtccttttagcaagaatatatacttacagcagagccttttgattaaggtttgaaaaactactctaatttctctctataaatatatttatattctgcatatatacccagacacacaggaaacttcaggtgaactgctttgaggatcaggttttgttttaaaagcctttgtgtgctggtgggcaggagagaaaagaactgcagttttgccatttgtttcattgatccttgttttaagcctacagcatccagtattccccgtccgtcccccctactaccttttctcagtctcatccccgcctaggttctgagatttgccgggaatgggaaccatgaggggtgcaggcccgaattgtgttattttcttaataagttcttttttttttattaaagaaaataaaaaa

SEQ ID NO: 227756 - DNA, 615 bp, Homo sapiens
aaggaatacacgaatgaactatcaaagcagctccagttctggactccaatcactgacgttggtaataatttggttgctaaaatctcctcttatgttctatagctcaaaaatgctatgcccagatgctttaaaatgatgccagttgattcactcaccggccatgagcatctgagcagttagttcccaatgacccaacatgccttgagttattgttcatttgatttaacttacagaaggtgaacttactttattttcctgccagaattctggctggatcacagttggtggtggtcctcagggaataaatctcaggcgatggcgctcagtcattttagggttgcctgttcagtataacttccatgtggctgtcttagtgaacacaggccttgaagctgatgatggcattttgtagacaggctacagtgacctacagttcatagaacagtagctggattatctacaagataacaacattctcacttgtgggtaaaatgtgtcattgtttctgggaactgaactttgaaaaataaataaaaatccctaccttgattcccaaagctttgacatttaactgggatgttagagtagatgaattcaatttacatgagttggggt

SEQ ID NO: 227757 - DNA, 446 bp, Homo sapiens
ataactagaatatatattaagaaaaataatcccaggaaataaaaaatatgctagtaataattacacataacagatttacaaaattatattaccatataacagtaatacataattctaaataaaaataatcatgctcacagataaaaccaaaaactttaagagcttaatttattgaaagcaaatgatttaaatatcatgagggaaataaaaggagacaagaattagtggaacactctactgtgctcctgctgtttgggaagatgtactatacagagttaattcaacaataaacaaagtccctgagggatggcctatacgagttgacaagttgatttaaaaattaattgagggaattaaacagaaatgtaaatattccaataaccatcgaattatacattttaaatggatgaatcatatatgtgaattatatctcaataaaacgatta

SEQ ID NO: 227758 - DNA, 175 bp, Homo sapiens
gccgtttccatctctctcggtttctcttctgcatgattctcccaacctctccccacatgggctatctatcacctatcaccgtgcaagcacttcctcagaggaatgcttttgttttggaaacaggtttggaggcaaagggataagggaagtaagatgaatgatatttaacagaaaa

SEQ ID NO: 227759 - DNA, 543 bp, Homo sapiens
gtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaata

SEQ ID NO: 227760 - DNA, 418 bp, Homo sapiens
ataggtttattgcccaagagaagtgaatgcacatactgtctctgtacgtaaatgttcacagaaaaaaaagagttactagcaaagaactggggtccagagctgaggggttccagcctggcagcaggagtgtggcatctcagcaggcaggtactatatatactgccatggggtccctggctctatttctgatagcccccaaaccacaaacaatctctatgtctgtcttttgcataaacaaattgtggtagtttgttaaaatagtacagtccaaagcaatactaacagctgatgtgtgcaaacaaatgaagaaactgtgagatatacagtaaggaatggtctgtgcccttctaacataggaacaaagacctgtactcacctatttagaattcaaatcaggttcgtgattgcgctcttaaaa

SEQ ID NO: 227761 - DNA, 526 bp, Homo sapiens
atctacatgtgttgagtgaagaattcctttccgaattgtcatggctctgagttgaggtcagagttaactaggtttatctaagcctgtaaggtcttcccagttcctaggtgtgacatggaggacaaggaccctacgctctgtctccccagcactgcatagccttgccaaaagagacagagaaggttgtaattaatgtggcgctattatccttagcaagctaggagaggatcaaaggagcaggaacctgcagccctcctgatttcgtcagcagagttggtaggggaatggaagggaaagagctttgcttgtgttaattaataacaacctctgcagctctcccccgggaaaggtggcgaccaaagcaatctcaagcttgggggcattgcaggcaattcttggggctattctcttttagcaccttgttgcctttgtcttctactgtgtagaaataaatgatgtgctctggacagcaattttgctgcaattttctcaaccgccaagcccctggggactcctgatcttcctg

SEQ ID NO: 227762 - DNA, 698 bp, Homo sapiens
gtaattggattcctagaataagtattctagaaagaattttctagaaagaaaattggtttgattcactctctgaaacaaaatgcctttgcatttgtatgtatctatattggtgaaaacctttcaacatgtagattgcttggagagtacaatcagccttccatatctgtgggttccacatctgtggattcaagccactgcagactgaaaatatttgggtagctggggttggtggctcacgcctgtgatcccaacactttgggaggctgaggcaggaggattgcttgagcccaggagttttcgaccagcgtgggcaacagtgagagcctgtgtctacaaaaaagggaaaaagttagctggatgtggtggcccacacctgcagtcccagctattagggaggcagaggtgggaggcttacttgagcccagaaattcaaggctgcagtgagccatgattatgccattgcacaccagcctgggtgacagaacaggaccctttctcgaatggcaagaaattaaacaagaaaactcgagttattattttttttttttaaattcgtaatctgatttgggctgtgctttagagcaccaacatttcatacacatgatcttcattctgatagccacttaaggtaacggttaccttcattttagaggcgaagttaaggttccgagtgactggatattttcagtacacttacc

SEQ ID NO: 227763 - DNA, 616 bp, Homo sapiens
attaaattctggcactttcatggatgaactgagtaacctttggcaaagcaccataacatggcgatatcatagggtttttgggtagattaatgtaaacttgtaaatggttatagcagtgtctggcaagtaaacactcaataaatgttagtgatatgatgatagctgtgaatatcatgatggtgatgatggagtagagatgatgataatatctcctgttctagattgtgaactccataaaaacagaatctttgactttctcatctttgaatttaactcttaacacagtaccttgcctggagtaggtacttaataaatgtctcttaattaaattgaatgaatgaattgcatcttgtagacttcatagatgaactgacatttaaaatggtgtgatgattaatcttatgtttcaatttggctagattatggtgctaagttatttgatcaaacacaagtctagatgttattctaaaaagtatttgatagttgtgattaatatttacaatcacttgactttaaataaaggagataactttgagattactttggcaatttgagtgggcctgatctaataaattgaagacctgaagaggaaaatctgaggtttactgatgaacaa

SEQ ID NO: 227764 - DNA, 332 bp, Homo sapiens
catccatccatccatccatccatccctgttgagctccaactatgtgtcaggcacttctggggggttgagggtattgtgatcagtaagacaaactctctgcctttatagtgtttacattctaggagaaaaatattcatcttagagagattataaaaaacaaatcttccgaaatagtatctgttacgtccaaaatagaggaatgtataaataaatgttaatatgatggactaacacgcagccattacaaaaatcctgttttgaaggctattaaatgtcatggtgaattgattccaatataaaaccaaatgaaataaaagcagttcacaaaacca

SEQ ID NO: 227765 - DNA, 521 bp, Homo sapiens
atagaaagatgaataagacattcttaagagttgatgggtggagagttatataaataaagaattatttcgaaagatgtttatagagtgagaatgacatttaataggagcattttactcatcaagtatagaggttatgctgagtgtacccaggtgagagctgatcatttaacctggaaccaaagtttaaaggtcataataaattaattgaggaaatgtttttaagtgaaatatacatttttaaatatgaccgagtccttttataattatcaacagttttggttttcattaaacattaagtgcctctttcttaattcttcaccggctttccctgccacctgctacgcattacggttcccccaactaccaacctttagtgtcctataaaatgaaactcttcttaattttagcatgaataaaacataataagcaggatgaatcagccaccagaagctcacataatatattccaggaacaaattaaagtgacatttgtttaataaactccttttatatccatgaact

SEQ ID NO: 227766 - DNA, 344 bp, Homo sapiens
ttctggagttaatcacgaggcttcctaaactcttaactttgtagtcatagaaaatgctcagtatttcaactcttttacattaaagaaagaaagaaaattgacagcaatcctctcccttcttccaccatgctcccaagaaaacaaaaagttagcattgatgttcttaagtgacatcatcctctgggaccaccattatctatctgtcctttgtttactttgtcttatacttagaatgccttcatttgccatcagctttccttcaaaccttcactttccactgaggaattccaagacaattcaagttaaaacacaaatttcaccatccatgaaatggtaacttaaga

SEQ ID NO: 227767 - DNA, 458 bp, Homo sapiens
tctcataattttggtggattcgggattccatatagggtatatctgactttaaaaattcatgcacttaatcatgaagctataatatcaagaatggtaaaatgttaaagcactttgacctagcaatttaacttttctatactgcgggagtaatcagaaattttggtaaatttgaacatacaaaatattacatacaaattaaaatgtttaaagtattctaactgatcatggttaaataaactatgtacattcatataatattttggaattattgaaatgatatttatagaacgtttttaataatatgaagagtgttcagattataatgataaattggaagaaatccaggatataaaattaaatggttattttgttgcaaatgttttcaaaattgagcagagaaaaaaggatggaagaaaatacatcaaaatgttaatgaataataaaaatattcgaatggt

SEQ ID NO: 227768 - DNA, 320 bp, Homo sapiens
gagacagagtcttgctctgtcacccaggctggagtgcagtggcgtgatcaccgctcactgcagccccgacctcctgggctcaagtgactcccacctcagcctcccaagtagctagtattaaaggcatgagccaccacacctggccaaacctccccttttatcccccaagtagagaaaactgagagttggaggtaaatcatgcatctgatcaccctaacaggtcacaatgcagaggacaagggtgggaagcctattattactggtggcattacagtgtcaccctggcaccagtaataattatgatattataataccatagc

SEQ ID NO: 227769 - DNA, 1908 bp, Homo sapiens
  misc_feature (27)..(27): n is a, c, g, or t
  misc_feature (41)..(41): n is a, c, g, or t
  misc_feature (69)..(69): n is a, c, g, or t
  misc_feature (835)..(835): n is a, c, g, or t
  misc_feature (989)..(989): n is a, c, g, or t
agaaactatgtagtgaaattacatagngatttttcattctngcagtaaaaatttcctgggatttttttntttttaatgggtgggaaactactggaaatagtggatgccagagtcttaaacagaaggaatgaaataataaagatcagagcagaaataaatgaaatagaggccaggaatacaacagaaaagttcaacaaaacagagttggtttttgaaaaggtaaacaaaattgacagacctttagttggactaaccaagagaaaaaaaagtcaaaatacatgaaggagacattacaactgataccatagaaataataagatcataaaagactactctgagtaaatatatgccaaaaaattgaacaaactagaagaaatggataaattcctaaaacatacaacctatcaggaccacatcatgaaggaacagaaagtctgaacagacctataatgagtgaggagattgaatcactaagtcaaaacctcccaacaaatagaagcccaagagcagacagcttcacgggcaaattcctctgaacatctaaagacgaattaccaccaacccttctcaaacttccaaaaaactgagcaggagagaacacttcccagattcattttatgaggccagcattacccttaaccaaagccagataaggacattgtaagaaaataaagttacaggccaatatccttgatgaacagttgcaaaaatcctcaacaaaatactagcaaactgaattgaatagcacattaaaaggagcgtacaccatgatcaagtgagatttttcctctgaatgtaaaaatggttcaacatatgcaaatcattaactgagctncaccaaattaacagaatgaaaaataaaaaccataagatcatcttaaaagatgcaaaaaaggcatttgacaaaatgtaacatcctttcacaatgaaaattctcaacaagtaaggtatagaacagtatgccacaacataataaaggctatgtgtgncaggcccacagctgacatcatacttaatggtgaaaagctgaaagcttttcctctgaggtcaggaagaagacccttgctacttccattaaatatggtaagttctagccagaacagttaggccaagaaaaagaaataaaggcagccaggagtggtggctcatggctctgattcccagcactttgggaggctgaggtgggcggatcacttgaggtcaagagttggagaccagcctggccaacatgaaaccctgtctctactaaaaaatacaaaaattcaccaggcatggtgatgcatgcctgtaatcccagcttgctcgggaggctgaggcaggagaatcacttgagcccaagaggtggaggtcgcagtgagctgagattgcaccattgcactccagcctgggcaacagggcaagactgtctcaaaaaaaaaaaaaaaagtaaaagacacctaaatcataaaggaagaaataaaattatctttatttgcagtggcataatcttgtatgtagaaaaacccaagacttcatcaagaaatctgttcacttagtcaagttctgggatacaaaaatcaacatacaaaaatcagttttctgtctatacactaacaacaaactattcaaaaaagagattaagaggtcaggtatggtggttaacacctgtaatcccagaactttgggaggccgaagcgggcggatcacctgaggtcaggagtttgagaccagcctggccaacatggtgaaaccctgtctctacaaaaaatacaaaaaaaacaactgggtgtggtggtgcaggctgtaatcccagctacttggaaagctgaggcaggagaattgcttgagcctgggagagacggaggctgcagtgagccgagatcacatcactgcactccagcctgggtgacaagagcgaaactccatctc

SEQ ID NO: 227770 - DNA, 587 bp, Homo sapiens
agttgagctctgagctctggaagatcacagaattgtattcctttctgttactgcagagaagctgacaaaggggctggtgatacctgcctgagattgctagttagttcttaaatgttttccgatggagggaagcacagttctcccatggagggaaggacaatgagataaatctagattttgaagaagcagccctgagcatgcatggaattccccccttagctctgccacactgaatctgttagataagctgttcagaactcttactgtttcaacattcaagattcactgcattgctggaccctctgtgaaactgaagccttctctacttgtttttatctcaagtgaacctggagaagcaacaataatggaccttctcccctagtcaaatagcctgtggacctcccctcatagtcagtctccaaaaacatgtatctggaattaatttattacaaagagaagtttagtgtttcttcttttttacatgcgctcaatactgactactggccagacacagcaccatcctcttacaaacatcatttcatttacttttcacaaaaacaaacaaaagtatgaagtaggtagtgtta

SEQ ID NO: 227771 - DNA, 553 bp, Homo sapiens
aatttttcttaatatctaaaaatgtaaaagccgttcttagtttgcaggccccataaaagcaggcagtggccagcatggacctgtgggttgtagagtgctgatccttgatctagataaagtaggcaaaacattccatgcaggagaaaccacatacaccacacaggcacacttaggaatgccaagcagatgttaagggttaatatttttaaaggcaaaatcatgactcttatacaaatataaagcaaatatataccaaagattctattcaatttgttcattaatgagagaaacaagagaatgttatgaccagttcaaaggagaagtttttaaaaaacacacatgtataggccatcagaaatgctgaaatcaattggctggtatctgtatctatcaatatctatatggcaataatgaactgcatctctacaggacacgactggcatttccatggacaagagtcgtttgtactactatcagtattctaagagtacagagttgtaaagtagctcaaacacagaaataaacaggaaagatatactacataagataccaa

SEQ ID NO: 227772 - DNA, 392 bp, Homo sapiens
gagaataattcagcgttgatggcaaaatctcaatgatgaagtttatcactaaaagaaaacaacctatgctgtgaaagcagagatgctctagaatctacaggtcttttcctatgggaaaataagagaaaaaaagactgtcatcagaatcattttacagcattgagactatgttgatttcaaggtcatgtttgttgcagcttcaaaagatgctggcaaggaacgaggtactctagaaacctggctgttgcattattaaatattttgtgtatagtttcggacattcttaacccgtttggtgctgtggacctctttggcagcctggtgaagcctatgtacttttctcagaattatgtttttacatgcataaaataaagtatgcaggtttacaaatc

SEQ ID NO: 227773 - DNA, 408 bp, Homo sapiens
ctcggtctttcaaagtgctgggatgacaggcgtgagccaccatgcctggcctacaatactatttttcataactgcattgtgttctaccctgtggccttactgtgatttaaacattcctttaaatatgttataatcagctgtttctagtttttcattatcataaagtatactacagtgaatatccttgtatatcaatatttggcgttatctattatagattcctagatatggtattactgtgtcacagggtatgaacacttgtaaggtttttgatctgcattagcagattgctttccggaaagattatatcagtttgtactcatactgtatgttatttttgtttgctactttacaagtttaaaaatagaaatatataaagtaggaaataaaaaatttaaactctcatta

SEQ ID NO: 227774 - DNA, 317 bp, Homo sapiens
atcatgtccctctaaatgcaagtggatgattgtgccaataagccaggagagaaggaaacatcttcagtggtccagtggcacattcaaaattgtacaatgacatgacattaactcaaaaatgaagtttgaggttctgggcctttgatggactgcatctattaaaaacaaaaagtggtgtctcatgcctgtaatcccagcactttgagaggccaaggcaggaggatcaattgaggccaggagttcaaccagcctggacaatgaactgaacacaaaaaatgcgaatttttatatttttttgtgagatcccatctctacca

SEQ ID NO: 227775 - DNA, 1267 bp, Homo sapiens
ctcagtaatataggttcaattttggaatgaaagttgggagatgaatataattttacctgcagaaatgagctgcctgtctagcacaggggtcatcaagttttaatgtaaaagttgaaatagtaaatccagctttcaggccattctgtctctgttatgatgacttgactctggcattgctgcccacaagtagccagggaaaatacatgaacaagtgggtgtaaaacttatattagctactatcggcagggggctggatttggcctctgcctgtggtctgcccagctctggtctagcctacctcttctgagaacacattctgtaattaggattacataagacaagacttcactctactgacaacagtatttatagttctctaaagaatcgaatgaagtctgattttctgagtcacaatggaaatattaaggtgggtggttgtgaaagaaatcccaacattagaaaatacaggcattctaaagattaatgtctgggcaaaagaacacactgtgtttttctactaaaaaacacaaaatgagaaacgagcatgatggggaagtggccactacccggaccctcttgcctatgccccacatttaccgtttgcctgggtttagagacactgcccttttccaagagccagaggccccaaatggaaactttacccttcctttttgctatctatgaatcaacagaaagattcctcctgtgactctttgactcctgaggaggacaatgcagcgctccaggctgttttctccagcacgttcatggtgggtggatgagattccctctccatcccagcacagtggtgggcttgttcaggcttggcaccatcgaccaacagccccaacccgcctggacaataggaacattcaacaatctgtaagttggaggctcaactcatttgtcttttacataactacattctttttttccataaggagaatacttagctaggacttaaatctttctataagcatattgttagctagttggcatcagaaagtctaaatttatgccctctaacaaccaattcaactgaaaacatatttgtcaagcaattacataactggagaaaagagctgatgttctttttgcatagttccatctaattttgaatgacacctcttcttgtccctgctgatctctgggcccatcccttcagaaagcccctgtgctcctgtttctaatcgtgaatgcggtcgaagtgcaacttcgacggacgcattcatttgtaataatcttcttcatagtaatacccatcata

SEQ ID NO: 227776 - DNA, 1227 bp, Homo sapiens
ctcagtaatataggttcaattttggaatgaaagttgggagatgaatataattttacctgcagaaatgagctgcctgtctagcacaggggtcatcaagttttaatgtaaaagttgaaatagtaaatccagctttcaggccattctgtctctgttatgatgacttgactctggcattgctgcccacaagtagccagggaaaatacatgaacaagtgggtgtaaaacttatattagctactatcggcagggggctggatttggcctctgcctgtggtctgcccagctctggtctagcctacctcttctgagaacacattctgtaattaggattacataagacaagacttcactctactgacaacagtatttatagttctctaaagaatcgaatgaagtctgattttctgagtcacaatggaaatattaaggtgggtggttgtgaaagaaatcccaacattagaaaatacaggcattctaaagattaatgtctgggcaaaagaacacactgtgtttttctactaaaaaacacaaaatgagaaacgagcatgatggggaagtggccactacccggaccctcttgcctatgccccacatttaccgtttgcctgggtttagagacactgcccttttccaagagccagaggccccaaatggaaactttacccttcctttttgctatctatgaatcaacagaaagattcctcctgtgactctttgactcctgaggaggacaatgcagcgctccaggctgttttctccagcacgttcatggtgggtggatgagattccctctccatcccagcacagtggtgggcttgttcaggcttggcaccatcgaccaacagccccaacccgcctggacaataggaacattcaacaatctgtaagttggaggctcaactcatttgtcttttacataactacattctttttttccataaggagaatacttagctaggacttaaatctttctataagcatattgttagctagttggcatcagaaagtctaaatttatgccctctaacaaccaattcaactgaaaacatatttgtcaagcaattacataactggagaaaagagctgatgttctttttgcatagttccatctaattttgaatgacacctcttcttgtccctgctgatctctgggcccatcccttcagaaagcccctgtgctcctgtttctaatcgtgaatgcattccagcacaaacataaccaagagcc

SEQ ID NO: 227777 - DNA, 438 bp, Homo sapiens
agtaaatatccatagtctttgctgtctgtcactaaaggtcagaacagataccaagatgtaggaggctgatagcaccagtgcagtttggagctgaaatctgccctatagtacccccagatgagagcaaagtcctctttaaaagctcgctaagaccaggcacagtgactcacgcctgtaatcccagcactttgggaggccgaggtgggtaggttgctcgagcccaggagttcgagaccagcctgggcaacgtggcaagatcctgtctctacaaaagatacaaaaattagccaggcgtggagacgtgtgcctgtagttcaacctacttgggaggctaaggtgggaggatcacttgagcccaggaggttgaggctgcagggagctgtgattgggccattgcattccagccggggcaacagagtgagaccctgtctcaaaaaa

SEQ ID NO: 227778 - DNA, 406 bp, Homo sapiens
gaagtggtttcgaagtaataagtagaaacaaaaagtaacctaacctcttcaagataagcagcagaaccagcaagagtgctgctgtgctgtgtgaggaaaatcaattatacagaaggcaattaaacctgtcacttcaaaactgtcaaatacaaacgaatggtttgtccttaaaatgaaaatagtgaatcattccacgtggaaaagaattgcttcatatcatttgaagaacttcaaaataaaatatctctagtgaggccctacacacatattaagctagcagaaataggctggaatgataaaatttcatgttggtcaagctgtgggaaaaccagcatgcctcacacccctggtggggttgtatattggctctgtgtgtctggaaagtaatactgtaatatgcaaccag

SEQ ID NO: 227779 - DNA, 725 bp, Homo sapiens
  misc_feature (330)..(330): n is a, c, g, or t
cggatcccaatgtagtgtcaataagttttttacgagacctcattcaaacaggggtaccaatgatcatggagaagactttgaattccggaagcactgattggacaggtgatgaaccagcttggacaaccgcttgtcaaccaactgctgcacacctgctgcttttggcctccccccctataaccctacccgatgtggctgaaatgctctgggagatcatccggttgaccagaccgactttttgtcgatggttagaaaattccttaaaggtttgcccaaggaaacaaccgtgggagccgtcaccagtgacaccaccaacaacttacgaacttnccacaagccaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaaga

SEQ ID NO: 227780 - DNA, 693 bp, Homo sapiens
  misc_feature (109)..(109): n is a, c, g, or t
  misc_feature (118)..(118): n is a, c, g, or t
  misc_feature (177)..(177): n is a, c, g, or t
  misc_feature (184)..(184): n is a, c, g, or t
  misc_feature (195)..(195): n is a, c, g, or t
  misc_feature (298)..(298): n is a, c, g, or t
catatctacccttggaacaccgggattgcaaattgaagtgtcatgaggtttctacgaggcctcaattcaatccggggtaagccattgtccatgaagaagcctttgaatncggaaaganctgattggccaggtaatgaccaacttggacacaagcttgcaagcaagttgctgcacacntgctgcntttgcctcccnccctataccttatgtcgatggttagaaaattccttaaaggtttgcccaaggaaacaaccgtgggagccgtcaccagtgacaccaccaacaacttacgaacttnccacaagccaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaaga

SEQ ID NO: 227781 - DNA, 557 bp, Homo sapiens
ctgtcaagctgtacacttaaaatttgtgcaccttactgtgtatgagttacgccttttaaaagaggaatggattactagcagtaaacaggagatgcccacatcctccacgaatatgtcagctccaatttaggctgacagacaggctatgtccatggcctaccaccaatggtatggctaaaattccatgtagatttggagtaaggggggaaaaatggagttcagctcctggctgaaataattacaaactgggttttcatcaaactcaatgccggctggggcattagaacgtagactgagctgctggacaattcttcattgtgtagtattgcctggcattcccagcccctgctcagaaatgtctgactgcttcccaatcaccttaagccaggaacaagggacggagcaacattcttcatccccgcctctcagaagcctccccgtgtcctctgcagtcattaccctcccctactgaaggtaacctctactctgattttgataaccatacgttatttttgcttgtttttgatcttcataaacatggaatctctcaggtatac

SEQ ID NO: 227782 - DNA, 725 bp, Homo sapiens
gaagacatttattttgagacaaatatgagtgaccaatggcccaaggtacagtctcaagaggtcctaagaacatgtacctatgatggtcgggctacagcttgggtttatacaatttagggagacataagacaccaatcaagacatgtaagatgaacattggttctgtgggaaaggcaggacaattccaagcggggatgttccaagtcataggtgaactcaaggatcttctaatgggcaactggctgaaagttattgtctaaagacctataatcaatagaaaggaatgtctgggatgactaaggcaggggtccccaacccttggggcacagacagataccagtccatggcctgttaggaactgggccgttactgcaggaggtgagctgcaggagcaaagcttcacctgtatctacagccactccccattgctctaattactgcctgagctccgcctcctgtcagatcagccatagcattagattcttacaggagcacaaaccctattgtggacagtgcatgcgagggatctaggttgtgcactctttatgagaatctaatacctgatgatctgtcgctgtctcccataattccccaatggaaccctctaattacaggaaaacaaactcagggctcccactaattctatgttatgatgagttgtacaattatttcatgatatattacaatgtaataataatagaaataaagtacacaataaatgtaat

SEQ ID NO: 227783 - DNA, 532 bp, Homo sapiens
ttatggcaatagaaacagctaagtcctttgagttctcactgtattcccataacaggtataagtgcttaacacacacgcgatcatctaatccttgcaagaactttgtccagtaggaaatgttacattatttctgatgagaaaactaagggaggtagagagatgttaagggacttgtatacaataagcaagaaattcaatcccagacacccacgaataactgatgtgatactatgaagaaaacaaaagatcacaagatggggtgtgcgatagagggaagctatttttataaggaggttgtcatcatctctctggagttacacgtgcgtttaagccaaaatgggtaggagacatgtacacatttaggaagagatatattttctgtgcaaaggccctgtggctggataagaccagtttagaaattcttatctattggagcctaaattcagtgatctctctgctttataaatgtaaaatcactaactgtggggcctctagcaaataaaacccaaagccttggtgacaggaggacagc

SEQ ID NO: 227784 - DNA, 514 bp, Homo sapiens
ggtggaggcctcccggggccgggcctgcctgggatggctgcacttgggtccccagctggagcagggcaacggggtccaggagccagttcccctcagaaggggaacgtacagacatgcagaccctaacagacccactcattttagattcacctctccatggggtgaggaacagagagatcgtatcacctgccaacgtagcccagggaaagaaaagctgagtctgcaaacagggccagcagaaggtgcaaactgctgcccctgttctgttactccctccacccagagccccagtgacaaaaagaaagagaagctgggcttaactataccagaattcacggcagggcgatgtcagccatgtttcctgagcctatcaaccaccgccaccagcatcaccaacaatatctaccagtttttacagattttagtgaagaaatcctacagtaaaagattttgaaaaatgactttccccaatgtatctcttgaataaatacggacattgatatgccttattatt

SEQ ID NO: 227785 - DNA, 234 bp, Homo sapiens
agttgggtctgtaatttaagaaatgctaagataacatgttcttaagttagaatatgatttataatgatcaatttctagaagtctaaaaaagatctcttagaactgaaagtaggcattaaaactttctgagtgttcataaatacaatatatcatttattcctaacactgttaaatttaagatgatgtgattcaataaagttatttgtgttaaaatcaatgattttaacatgaatt

SEQ ID NO: 227786 - DNA, 426 bp, Homo sapiens
cattaactgtggctaattatttctttatagcttagagtggaggcacatctgagttgctttggcactcacagttacaggaagggagggagggcagcttaaatacaatatagaacccgtggggagacgaagggaggagcaatttattgcaggttcggcatccccaatccagaatctgaaacgttttgagaactgacatgctcaaaggaaatgttcactggagcattttggatttcagattttcagattagggatgctgaactattaaggataatgcaaatattccaaaatccgaaaaaataaaaaatccaaaacacttctggtcccagcattttggataagggacattcaacctgtaatctcagcctagcttctgaagcataaaagcatagcagcagacaaacatgcaaataaacttatgtccaaccc

SEQ ID NO: 227787 - DNA, 428 bp, Homo sapiens
ttagttgtgtaaaggtttaaaaacatgatcacgtgatcaagacttttttcccccacttaaaaagagaggaagatgtaggataggaagaactttggggctgtgtgtggtggctcatgcctgtaatcccaacactttgggaggccgagatgggaggatcacttgagctcaggagtttgagaccagcccaggcaatatagtgagacccccatctctatctttaaaaaaaaaaaaagaactttggatggctggtgattgcatttccaatggattatgtcttaagtattatacaagttttatgagattaagaggaatgtgagatagcatgagtgaaatcatggaaaaatctacaaaatctatactgactattagaaaaacaactgcaatcacatgttgtaattgcaaatttgaaaacactactatcctgtgtg

SEQ ID NO: 227788 - DNA, 371 bp, Homo sapiens
ttagttgtgtaaaggtttaaaaacatgatcacgtgatcaagacttttttcccccacttaaaaagagaggaagatgtaggataggaagaactttggggctgtgtgtggtggctcatgcctgtaatcccaacactttgggaggccgagatgggaggatcacttgagctcaggagtttgagaccagcccaggcaatatagtgagacccccatctctatctttaaaatattatacaagttttatgagattaagaggaatgtgagatagcatgagtgaaatcatggaaaaatctacaaaatctatactgactattagaaaaacaactgcaatcacatgttgtaattgcaaatttgaaaacactactatcctgtgtg

SEQ ID NO: 227789 - DNA, 288 bp, Homo sapiens
tctcaaaaaaaaaaaaaaaaaaaaatcttaggacccagtcacagagccacaccctgctgcagaagaggctgccaaaggcagtccttattctgggtgatcaagtgcccaggaaaacatcaggagtttgctcctgaggaagagaaaggagagtggatgccagggccagctccaatctgagacacacgtggcctgcctggaccacatggtcagcttcaggactctgcccacctccctgatgcatccccgacccctttcgcaccctcactcagttccagccacatggccgtc

SEQ ID NO: 227790 - DNA, 306 bp, Homo sapiens
attctcctgcctcagtctcccgagtagctgggattacaggcatgcgccaccacgcccggctaattttgtatttttagtagagatgaggtttcaccatgttgatcaggctggtcttgaactcctgacctcaggtgatctgcctgcctcggcttcccaaagtgctgggattataggcgtgagccaccgtgcctggccagctacacttatctttatgaaaagttcttctctttcactattcttgtcattgtaggcttctagttctttcacctcttttttccttctcttaactcccttctgtcatcctcc

SEQ ID NO: 227791 - DNA, 542 bp, Homo sapiens
ttttatatcaactttaacatttacttacgactttgttaaattggtaaaattctttttcctttatctgttttgtaatcaaagaaagactattagactgaaaagtgaatatcagttttcctaatagttactttttcctaaaaagtcttttcatttaacatttaagagagaaatctaatgttatatgacttatcttttgtacataattatgacagaaagttacaggaagtatttttaaaaactaatgtgttgagtctcaataacataagttttaaaaataatttaacagccttagttaccctaagtctgcttttcaacaataaccaaaaaaaaatcttccatgcagtgtgcccttgctcccatttcatatgcatgattgattttaaaggctgctttgcagaagaactccagaatccagctgctaagacttatattacattgttttcaaacataagaaaaaactcactgatccttaacatacctctgaaaaaactatacttctccatctaaccaatggagaaactaagggataagaaataaagtac

SEQ ID NO: 227792 - DNA, 690 bp, Homo sapiens
aaaattcatcatgataaaaggctggacgcggtggctcatgcctgtaatcctagcactttgggaggctgagacaggtatatcaccggagctcaggagtttgagaccagcctggccaacgtggtgaaaccccgtctctactaaaaatacaaaaattagctgggcgtggtagtgggcacctctaatcccagctactcgggaggctgaggcaggattgcttgaacctaggaggcggaagttacagtgagccaagactgcaccattgcactccagcctgggcaacaaaaccaaaactccgtctcaaaagaaaaaaaaatcataatgaaaatgaagtgaaattgcctaaatgagtccaacttgaatattagaaataaagttgaacttttatataattgtgaatagcttaacatatttaaattatttgcaaatagattgtgtttattgaagaatcatattggctagatgcccattttcatttactaaaatgaatcaggaaaatgcaagatgatattttaaaacttttgctaatgtatcaccagtataactttccttttaaaattaaggtgatagtaacaaaggaagttaggactttgatcattttaaatcagttaaatcactgaaacgtgggaaattgttttacaaaacttttattgattacactttaaggtattaaaaagtactataaagctatca

SEQ ID NO: 227793 - DNA, 716 bp, Homo sapiens
caggctccttgatgacttgtttattgactaacaacatggacaaggtaaaaccaagagacaggtactacttatgaataacacgatgtctgcaaatctctggacagctttccctgtctggtcccagcttcctccatagtcactgccttgccccagtgatggaacacaggtgtcactgccagcaatggaagtcctattcttattgaatccagtctctctctatccctgccaagaagacttagcattaccatttgctgaaatcctggtagttcatagatttttggacctaatcaagcttcatgttcgaaaagtcttaattattgccaccactgcagagctctctacttgttgcctccagaccaagtagaaaacattacttccattgttgttttgacttttgctgcacatccatttcaatttccacaaagagcgcccatggcacagggagtctagatgaagactacctttagcctgtgtgggcacaccactcggacactttgaattctggtatgaagtccacatctccagccaagactcctccttcccttataacactacccctttctggggtcctcattgtccttttctatcatctggtcttgatttgggctactgtagtatatcacatgtttgattcctttgaaccacaaagggaatgagttgggttctcaatcccatacctcctaaaatgctcctagaataaaaacaagtaaattcga

SEQ ID NO: 227794 - DNA, 395 bp, Homo sapiens
agaattgttctatcgtggattttgcatttctaatgagcaactcagtagattgtcaaccacaatctaagagcatcactccaaagccactccctaaaagtgtggggattttaaatgagtatgtctagagaggctaatgtttccaacttagtagtaaagtttatggcattcctgggaggactttttttaattttaatttaatttaatttatttttttatttttatttttttgagacccagtctcgttctatcaccaggatggagtgcagtggtgcaatctcggctcactgcaacctctgcctcccaggttcaagtgattcttctgcctcagcctcctgagtagctgggattacaggcacacgccaccatgcccagctaatttttgtatttttagtaga

SEQ ID NO: 227795 - DNA, 216 bp, Homo sapiens
aaaacattgtgtcccaagaacttcatttaaaaagctgggtagtggtgcccagaaagttgccattttaaacatgtgtatacacctctcagaagagctcgttaagaagaggaacaatgtgtgatcaaaaaagtggtcagtgtgaaggtgcttgctgggtgtacgacaggccaggtaagagaacctccaaagtcttaaggaggaaaattccaacacagt

SEQ ID NO: 227796 - DNA, 244 bp, Homo sapiens
atccaacccagccctttacaggtaccctgtagtttcctggtttccaaacttcaactcaatgattattaaaataatgtttctagggtacataaagcacttgtacctaaacctggcataattttttttaactattccctttatgagagaagcacttagctaaatctaatttttttttttttttctgagcttcctcagttcttccattcccaggataagctcaatgcttaggcatcggtttccacta

SEQ ID NO: 227797 - DNA, 413 bp, Homo sapiens
tagtaggttgtttactacagtcaggtgaattaatatattcatcttcttgtatagtttaccttttttaaaatggtaacatctgaatctactctgttggcaaatttccagcatataaaacaatattatgaactatagtcatcatgctgtactttagatctctagacttattcatcctatatgcctgtaactttgtatccccccattctgcccccttccccactcccatgccctagtcaccaccgttttctgttccttcattttgactttagattctacatatatgtaagatcatgtagtatttgtctttgtgtgtctggcttattttatgtagcataatgtctagatttacccatgttgttgcaaatgacaggatctcttttttaaggctgaacaatgttccaacatatatactg

SEQ ID NO: 227798 - DNA, 461 bp, Homo sapiens
ccaaaaagttgggagccattcaatcgtccatggacaggtgaatggataaacaaaatgtgttatatgtattagatagaatattattcagtcttaaaaaggaaagaacgtttgatacatcctgtaatacaggtgaaccttgaagacattatcctaagtgaaacctgccagtcacaaaagaacaaatattgttggattcctcttacatgaggttcctagagtagtccaattcgtagagacagaaagtggaatggtggttgccagaagacgggagaaaaggagaatgggaagttagtgcttaatgggtgcagaatttcagtttagggtgatgaaaatcttctggagaggaatggtggtgatggttgtatgacaaagtaaatgtacttaatgtgaaagaactgtatacttaaaaatgattaaaatggtaaattttgttacgtataaaacagtttttaaaaatagag

SEQ ID NO: 227799 - DNA, 318 bp, Homo sapiens
ttgtgtgtgatcttttctgtcttccccaacttgtaaactttttaatttaaaaaaaaaaagaagatctttttccctctctttcccttcacctggttcaacctgcctcctggttgttttttgctgtttggtaaagaataattcatgaaaagtaaaaaagtttttaaattgcttctaccatggatgagcagaacaatagcagaaactcctattaggttggtgcaattacttttgcaccactctaatacaaatttaaataaattaaaggaatttaactaggcttctcttcatttcctatgtcaggaaactattttcaacatt

SEQ ID NO: 227800 - DNA, 445 bp, Homo sapiens
agcagcctaagtaaaagataatttctagaagtggttgattggcttcagtgtgaaatgccattcggaagtcatggacaaggaaaaggacactggaccaggtaactcaggaaccattagtaaactcagagcagtttctgtagaatggagactaaagtaaaaaattaaagggttcagaagtagatagaggaaatggcattagcaggcaaagaatatgtactgacgtggtggtgatgcagagagagatgagagaagggaaaaagtggagaagagggagaaagggcaaggtggaaagggcagacaaagaaggagaaataggccgggcctggtggctcatgccttgtagtccctacacacacacaacacacacagagaaaaattagataggtatggtggtgtgcacctgtggtcctagctacttgggaagctgaggcgaacggattacaag

SEQ ID NO: 227801 - DNA, 276 bp, Homo sapiens
tcgtctcgaggatcccctgttgaggtgtggcaggcaaagaatatgtactgacgtggtggtgatgcagagagagatgagagaagggaaaaagtggagaagagggagaaagggcaaggtggaaagggcagacaaagaaggagaaataggccgggcctggtggctcatgccttgtagtccctacacacacacaacacacacagagaaaaattagataggtatggtggtgtgcacctgtggtcctagctacttgggaagctgaggcgaacggattacaag

SEQ ID NO: 227802 - DNA, 226 bp, Homo sapiens
gatcatgtcatttatacccgtattgtttctagttgaaacacctctgtaaagtcaactaacctccctctcccacctggtacccaataaacgtgaaagaggagaacatgatttccactcttcagatagatttgctttgtaacttctagctccagggataaccaaggaatgatacagaagatatctcgactttaacagaactttacccctctgaggtcccagggaaggt

SEQ ID NO: 227803 - DNA, 508 bp, Homo sapiens
agaaaaaaaccaacaacttcttagcataaaggcagcataaataaagttaaagaaggtgaggtcactgagagacaaatatttgtaacagactgaacagatacaaaattagaattcagaatatatgagtaatttctaaggataaacagaaaagcaaaaaacagaaaatatttttaaagtatattctcaaacagttcatgaaagatgagatggagtttcgccctgtcgccaggctagagtgcagtggcacaatctcagctcactgcaacctccacctaccgggttcaagcaattctactgcctcagcctcccgagaagctgggactacaggtgctccaaggtgcttgagtttggaaacatgagacaaaaccagaaacagagaccctgggagagtctgtggtctccatttttccgctgagcaaaccacaggcttgtgttctgcctatctcccacttcgcacatgtacagcattgtagaatatttacatggataaggattctatgatatagta

SEQ ID NO: 227804 - DNA, 149 bp, Homo sapiens
tctcgcttctctcctccccactcagcctcaggttggcacctgctcaggtctcttctcacaccctcaccccaacctgatgacactcagcctagcatcagaactccccactgggcttctctttgccaaaatctttcccacacaggggtccc

SEQ ID NO: 227805 - DNA, 442 bp, Homo sapiens
agactagtaaaaacagataattcttcaccactagactgactgtacaagaaatgtgtaagggagtcctatatctggaagtgaaagaatatctaccatcataaaactgttccaaaatacaagtttattgaaaaataaaagtatgctcaactgtttataatcacagacaaatggaagtaactatcacaaagtcgttaaatgggccaggagcggtggctcgcacctgtaatcccagcactttgggaggctgaggcaggagaatcacttgaacccgggaggctgagggtacagtgagccgagatcatgccactgcactctagcctcggtgaccgaaggagactctgtctcaaagaaaagaaaagaaaaaaacaaaaaactggtgaatatgtgtaagaggcaagttgaggtcaaaatacggaaacagaacctaggtgtgcaaaccggg

SEQ ID NO: 227806 - DNA, 580 bp, Homo sapiens
atcaagtgtattagactgaatcatatgcagttgttgattttgacagtttttgatgtacaaaactagcagtttctcatagctcaacctagtagctttcttctgaatgatagggaacctctgccataatgagatgattttttccttcaaggaaaaggaaccacttagccacataagtactgataagaaacatgctcagcataattcctctgtagcatgacctcctgagtgctcaaattgtattataccaggaaatttggcttattgtgaagttcaatggttttgaatttatggcattttaaatcttaattatctgagctgctatcatttaccactgatgctttagtctcacatgtggaggacaagcaatgtttagtgacctcttcactgcatcccatagcacattcaatgtctgggaaatgttctttgtttgacaacttctgtactaaaagtgttgctgcagtagctttgtgcccctgtcagtcttggtagccccttaagatttggaaagtaaatgaactgaaatcttgttttcaatggccatattaaaattctttttttttttcctgtttcttctaaacca

SEQ ID NO: 227807 - DNA, 444 bp, Homo sapiens
agtaatggttcaagaacattcttcagatccatggttcatggtttctctaggagtggaatttgggatcagggagtatacctgtcttcaggtttacaagataatgtcaaactgctttccaaagtggtttataagatttcctatggctccaccatgcttgccagcacttggtattgtcagctttatcaatctgatgatttcaaaatggaatctaattctggtgataactggcattttcctaattactaatgaggctaaatacaggagtgactcaaacaatttaacaactagacatagctagtacagtaggactccgactaatccaggtattctttaacttctggtgtgagaaggtatgtaatctaagaacctcatgtagccagggtggcacttgggggtctcaatgtaatgacttaccaagcagtgcataatacttaaaaaaaaaaa

SEQ ID NO: 227808 - DNA, 467 bp, Homo sapiens
tcaacttaatcacttctgtaaacactagatcttcaaatgtggtcatagtctgagctactggggattagactttaacatatgaatttttggcgggacacaattcagcccataacatagaacatgagaaaagtagaagaatccaggatgacaccaggatttttgacctggtggagtcatcgtttgctgagatgggaggactctggcagaatatcagttcagtttgaatatgttaaatttgggatgccccatagatatccaactgcagatgttgagtaagtagccaaaagctcatatctggggtttggccgagaggttggagctggagatacaaatctgggggtcattggcatagagatgctattaaaagctaggagactgggcaagatggtgacgggagtgagtggcggtatgaaagaggattaagaaccgaggcccagagcactcctacattaacaggtcaaaagaag

SEQ ID NO: 227809 - DNA, 450 bp, Homo sapiens
gtctcaaaaaaaaaaaaaaaaaaaagtgaaagcttactagacataatgattaataataataatgattaataataaacattttggggatttagctgattttattaacaccatttaaatatcagtctaggtgtagtgatagtataacatactggttaaaagcatgggcgctacctttacatttatggtcaattgatttttgacaaggttggcaagatacatcaatagggaaagattagtcttttcaacaaatggtgctgagacagcaggttatccacatgcaaaagaagaaagtggatgcctgcctcatagaacacatgcaaattaacttaaaatggatcatagtcctaaagtaagaactaaaactataagactcttacaaaaaaaataaaatccttgtgactttggaataggcaatagtttcttagatatgacaccaaaagtataagcaaa

SEQ ID NO: 227810 - DNA, 331 bp, Homo sapiens
gcatggtggcacatgcctgtgatcccagctactctggaggctgaggcaggaggatcacttgagccctggagactgaggctacagtaagctgtgttcatgctactgcactttagcctgggcgacagagtgaaaccctgtctcaaaaaaaaaaaaaaaaaaaagaaatgagatgattctgaatgcatgaacgcagtgtatgactttaccatgagcagcatgcctgacttgactccccagagcagctttctgcactggggacttccttaatggaagctggtcaaataattatatttactatcaatttgacttaattgtaagatttcccttcctg

SEQ ID NO: 227811 - DNA, 501 bp, Homo sapiens
ttagaatactaaatcaggctgggagtgctcagaagaattcagagcttctgaatttcagactggtccacacttgactcatctggctatttaaagtgaatgtagcttcagaattagggaacttgatatcgtgaaccccctgcaaatccgcagcagagcagagatgcctagattcttaatccaactctgtcatttactgacaatgtaaatgacagggtttggctgtgtccccacccaaatctcatcttgaattcccatatgttgtgaaaggaacctggttggaggtaattgagtcatgggggcaggtctttcccatgctattcttgtgatagtgagtaaggctcacgagatctgatggttactgtaagggggagttttcctgcacaagctctcttctcttgtctgccaccatatgagatgtgcctttaaccttcttccatgattgtgaggcctccccagccacgaggaactgtaagtccaataaactcctttcttttgtaaatt

SEQ ID NO: 227812 - DNA, 373 bp, Homo sapiens
ttcagagttcattcgatacataatttttgagggtctcctgtgtgcagggcactaggacattggaaatatagcagtaaaccaaaaatacagacattctgattttatgaagcttatatcctattgagacaaactaaataaataaataggaggtatcagtaacttacaaaattagtgtgatttgtttgagaagccagctttcttcctaaaacgtaccactttttgagaaacgggggtcatgtgaggaacatgtaggaggttgggtagattcagatgagatatgtagtgaacaggctttgggtggcatgaggccaccaaaggcccagaaagagacactgagaggagtgacagaaatatggaggagagaagctctcaa

SEQ ID NO: 227813 - DNA, 519 bp, Homo sapiens
ctttcaggttcatatttagtcacatcttataatgaaacaaaccgtctctagaacgtatgcatttgagcactccagtactcgagtatccaaggaaggtgaaccagcccaggagtcctgtaaacagccatccttccaaattaaccgaaaccgttaacgtcagagcttgatggaacaatcacccatcattttaaacaaaatcatcaggctgagtttgaccaagagcccggatttaccacctctgaattaggacataggaccctccgagggattttacaagccattctgaggaacattttgggtcttgtgctcaaggaaatggcttcttcaaggattccacaagataagttataccctcagttctttgctttacatggacaagagctttgacctccaaaactgggtgaaatgagacatttgcttttatttgtttttattttaagcagctcttcatatgtataatttccttttgccccattgagaagagtacattataatttccagagaattcaaactttcttt

SEQ ID NO: 227814 - DNA, 635 bp, Homo sapiens
aaaaacaagtaaatacatggggcttgcaattatttagggaaagaagcagggcgggagtaatacacattcatatatatgcttttgtgcatgtataaaatatgtatgtaagactacataagaaagtcataatagtggttgccttgggagacaggtctgatgtggaagacaaagtctcatctttttgtactatttttagtgggatacatgcagcactgcattaggatgtttcaataacagaccacatagtacagtggtcccataagactatcaagccgttatttttactgtgactgtcctatgtttaggcatgtttagatacacgcatacttactattgtgttacagttgcctacagtattcagtacagtaacatgctgtgtacaggtttgtagcctaggagcaatgggctataccatatagcctaggtgtgtagtaggctatgccatctaggtttgttgagtatactctgtgacatacatgacatgacaacaaaattgccttacagctcatttctcagaacatgtccctgtcatgtgacacatggctgttttttgatggaaataactgggaaaaaaaaatcgactcttgttcctaagggtacataaatgttgaatgcattataactcatgcttatgc

SEQ ID NO: 227815 - DNA, 434 bp, Homo sapiens
tcactcaacctttggcctggggaataattagaaaaatgaatgtttcattcccttgagaaggctttttctttgtccactggaacccaatactggcgctgtggctgtgttttagagagtgtctagtggcgctaacttgctaaatccatgaggtttatcactgttatgcacagtgcccaccaagtgttggcaacaagcaactcgtaaatgcattttggcaattactatgaaattttcagtgtcatatgggtcttccacctcctaaaagcttttgtcctgatgaaagcttttattttaactgtagtttttccctaatagggctctatttcaaactttaacagttgtaattatttgtatcaacgtgcaatcccacacttaaacaaattggagcccactccagaacaaaattaaaatggcttcaaagaatgacagaaaaa

SEQ ID NO: 227816 - DNA, 362 bp, Homo sapiens
cggccagaggcagataaacatggtagcctatcttcacagtttgtacttttcctagatgtcagatggggagtggattagcaatggcctcagtccctagacactgtgcaataccctgatagtcagtcttgtatcccgccccgaggctccactcccttgacaatggatctgaaagctttcttgtactcagaatcatcagatggaaaggcccacccttgtagtccctgaccaccatgttatgtagatggctgctcccagtagtaagaaatccatgaatgggaagatggttcccaggaacattcacccagcaacaaaaaaattaaacacaaattggggcttgaatttttgtggcaatcaatgactga

SEQ ID NO: 227817 - DNA, 414 bp, Homo sapiens
cgaattattccaggagtaactcaataggaaacataaaatgttaaagctggtaggttcttaaacagaaatctgtctagtttcttcatttataggtgaaaaactgaggcaaggtattggtagaagaaatgagctggattccctttatcttgactcttagatttttttcaataatacttagttcttagtttttcttaagtgttttttaattaaaatttttttcgatatcatagtattcagtcatataaccacctttgtacttatttatgtgttactcatctctaggatggtaatttccattctttttgtttttaaagatgaggcaggagaatcacttgaatctgggatggaggttgcagtgagccgagatcacgccactgcactccagcctgggcaacaagagcgaaactccacctc

SEQ ID NO: 227818 - DNA, 455 bp, Homo sapiens
aaacctcatgtcgaattgtaaacctcagtgttggaggcagaacctggtgggaggtgactcaatcatggggacagatttcccaattgctgttctcatgatagtgagttctcatgacatctggttgtttaaaagtgtgtagcacctcctctttgctctcttcctcctgttcctgtcttgcaagttgtgcctccatctcttcaccttccactatgaccataagtttcctaaggtttctgaagccatgcttcctgtacagcctgcagaactgagagtcaatgaaacctcttttctttataaattaccagtctcaggtagttcttaatagcaatgtgagagcagactaataaaacagccaactgatttttgacaaaagtgccagcaacttacattggagaaaggacaacctcttccttaaatgatgctgggaaaactggatattcataatgcagaaaaat

SEQ ID NO: 227819 - DNA, 553 bp, Homo sapiens
gccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtggaagttctccaaaaatgatggccaacatcctggcacctccaggtgtgagaaatagctttgcttggtgaatgggataatgtttgtcaggatgcagtttagacagtcccaagttggaggcaggccttgagggcagaagattctgtgaaccttgggggacagcttttgggtactcacagatataaaccctgtgcagaaaaaaagaagtgattgttttcaggatgcttataaatcgagtgaagcaaaagaagaggattctgtgtctgccatgagatgaacgccctgctcttcacgaaggtgtgcctctaataaagagagccaaagccagctgggtctcaccagattcctatactttctcaaggatgttgggggaggttaatcctttatcgaaactaaagactggtttat

SEQ ID NO: 227820 - DNA, 398 bp, Homo sapiens
acacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctca

SEQ ID NO: 227821 - DNA, 435 bp, Homo sapiens
taaataacttgcactatctcaatcatgagtgttacacagttctacccaagaggcattctcctatcagaccaacatccagacctactctataaaccactgccctacctggctttccttcagtattttcacttccctgtgcctttctttatatttcttattgggcatgttttttcaaggcataggcaataactgcatccctcacttactataactatgtcatcgtgaaggtcacttaataatcctcagtctttgagcattggttttccaattgcatttatggactctaccagaaacttttaaaaggctcaaatcgatagttttctgattatggtccctctgaggggattctttttaggcttctctccgagatcttgcctgctttcctcttgtacatttctgtgagttttggtcattttgttggatttgttagtaact

SEQ ID NO: 227822 - DNA, 274 bp, Homo sapiens
cttaaaacactatcttttcttggttttgtttttttccttttttttgagacagtgtctcactgtgttacccaggctggagtgcgggaactgcaggtgtgtgcctggctaatttttgtgtttttttaagagacagggtctcactatattgtccaggctagtcttcaactcctaggttcagtccttccaccttggcctcccaaagtcctgggatttgctactgataagtacagttttttttaaccctagtttttatcagtagcaaaacataatagtt

SEQ ID NO: 227823 - DNA, 441 bp, Homo sapiens
cagaaaaaaaatgtggaaagaatgaataacatatctgtctttttaaaaaactgtcagctatttttcagagtggctctattattttacttttccactagcaacttatgagtgattgtattttttacatcctgaatagcttttgctattgtcacaatttttaaaagtcattttgataggtgtgtagaaatatctcactatggttttatttgacatgtccatgatgattaataatattgaacatgtttcatggattatttgacatctgaatatttttcttgttaaaacgtccattgatgtcttttgtccattacctaattggatcatttgcatttttaaaaaaatttgctgttgtgttttgtgtcatctctatttatttttgtcggttttgatagatgtttatcaattgattgattttttcaataaaccagctttttgtttcac

SEQ ID NO: 227824 - DNA, 579 bp, Homo sapiens
cgcatcattatcaactgattacctattagaaatgcaaataattgattcccacctactgaagccgaaacgctaggaatggcatcggatgattctgatgtaaagtaagggtgtccgccctgaaagcaggtgtgacttatctccgttttccaaagagcaaactgtgacctggagaagttaaataacttgcccaagatcacagccaattaatagcaggacctgcttccagcccagttcttctggacctcaaagtactctgggaatcagggtcttttgggttgattttacctaaacagcgtcccagtgcttctcctgagcgctgctttctgaatattaccctaaattgctctccaggccctgggatcctcacggacacgctctatccctccaggtttagactcaagtgatatggagcttaagctctccctgacacttcccattgcagcccagtgtctctagagggacagctcccacagtaatgcagctgcaatgagtaagatataaaagctcataggctttcatacaggaattccactttaggaagtaaaagcaccatgtcaaggttaatagaaaaattttaaa

SEQ ID NO: 227825 - DNA, 406 bp, Homo sapiens
acttccttacagagtgggctgcagcaattttcgagatgaacagtgagagaaaaggggtgttctacctaggcatgtctacagtgaggggtcaggttatggagtttttatgaaggtttaaggaatttggcacagggtcagggttagttgttttggacaacaatctgaatagctttatctgttcctgggaatgttcaaggccctagcttgggttcaaaccagctgggaaagaccttctgttggccagatgacagagcagtcaagaccctctgatttttggtcagaacacagaaaaatgtgaaggaaactgggggaccctacatactcatagtcaacagtactggattgttcacttcgaaatttgttaacagggtagatctcatgttaaatgttcctaacaccatttttt

SEQ ID NO: 227826 - DNA, 499 bp, Homo sapiens
atcctttatccaatccaataagaatcaaagaatcctttgattctttctggatttactgaaggaaaaaagagtggcagagataaaccttggccagtcatgctaatgtcacttaatttgacatttgatacctgagatcttgtgactctgtaatagtaagtaatatgcttcttctgatctcggctcaattccccaatgaatgaaaatgctgtcagtatttatatccttctgctgaagtacatacagatttttaggcatcagaccttgatttaagagtcttttaagctctattttacaggagaagacctggtaggagtaaaaataagtacatgaaagccagaatgcctggttgaaaatttctcctctcaatttaggtcctgttacttaatctctataaaatggagataatgacacttaattccgtgaatcttaaataaatatatgtaaaatgtctgaccttcaacaagctttaggctattaaatgattttcactcctaaaatc

SEQ ID NO: 227827 - DNA, 522 bp, Homo sapiens
cttcaggacagtgggctcccttctggcccaaggcaggtccagaattactgtccaggagccaaggctttgaatcagggacctcaagagcccgcttgatgttctaccccactatggctgcgcctgtacctaaggtgcaaaagtcccctttacttttccctctacttttctccagcataaggagtctctccccatagccaccatggctggaaatgtgctgagtctcatttgaagccagctagtctcagagtctcacagaaggcccactgcatacctaggtatcgctggtatcgctggctatttggagcttaagagctcttcaatcctctgacatcttgattgcagcctttgagagaccctgggccagaggatccagctattgccatgcttaaatttccaacccaaatgtaactgtgagataaatgttgttttaagccactaatttttttaattactgtattaattttaacagataatacaataagagttttaaaataaaaattttgatattacaataaaaaaaat

SEQ ID NO: 227828 - DNA, 547 bp, Homo sapiens
tggctctccggagactctgtcccgcgcgctcacctgctgggtgggccctctagaagagtcaacacctttacttatttttgacccatagtccccatcctgcatgcccgattctttacaaatgttaggcggaaggtgggtggaaactgagaattcagcaaaaccctattttgtgagaaaatacttccttgctttggaaaactgaaaagaatatttcaccaccaccaaaggctggtgatggagcaatgagagaggaaggcaagtggtactcttaggtttccaaatttgcctccatcatgcccagctgagaatcccgatagaagggctgtgatttgcagggtagtccctccgacattccaactgtccaagctgcggctagccacctcctctgctctcctcgaatgtgttatttgcattgctgcgcgtgctccgagctgcagcaggggtcctgcggctggagtggatgaaaggccccttccagcccccaccgccgccctgcgtctcggtctcgctcggaattggcctaagttcagccacagggcgcggccgc

SEQ ID NO: 227829 - DNA, 370 bp, Homo sapiens
caccaggtaggaatagaactgtgtatgttttgttctctgttgtagttagccctaatctcgaactgagtttgccacctggcttgtgcttgataaacacttttactgaatgactcaatgaatgaagactggtatgaggatgccctcatgcctcctcacttctacgctccactcactgtatttctccaaagattcagaaccttggtaaaaacaaggctcagaaaatataccctaggtcaacttctcaagacctccaaaaggaacagggaggtctacctgaattttagaagcttgtacaactggggcactatacaagcttttcagaaaggtcttatacccacatcttcagtactcaataatatgttacctgctg

SEQ ID NO: 227830 - DNA, 264 bp, Homo sapiens
atacattttatgagttcaaatatttttcagaagaaatcagtaaaagcattgaaaactattccagcaaataggaagcactttaaaccaaggttatggatgaaaatgtgtgtgtatcaaccccagtttacttctgggttgcacagaatagagaaatcttgatttaatccagctaagaattttcaaatagtatccattttgttttgttttaaacagctcttcttgcaatggtagaggctcttcaattaaacagagatggtaacaggc

SEQ ID NO: 227831 - DNA, 441 bp, Homo sapiens
tctgtggggtgcatggcctgtgtgaagactgctcagtcaggtacctttagctcttaggttctccacagatagagttagtgtttccatttcttgtttttctttagtgttttgtagtgaattctgagagaatgggggcagaagtatcttttcctctgtcctcttatattcatcttggtatctctaacagctagctttgaattattttaggtcattaactgtatattaatttaatatgtacagtgaaactaaaaaagaggaaatagtcatcttaatctctgatatacacacataagatttttttttgagacagggtcttgctatgttgcctaggctggagtggagtggtgtgatcatggctcactgcaggctcaacatcctgggctcaagcagtcctcctgcctcagccgtcgacgcggccgcgaatttagtagtagtaggcgg

SEQ ID NO: 227832 - DNA, 549 bp, Homo sapiens
gggccagacagcccctcacagagccaattgtattccttccagctcagccgcaggagtttctgaggatgaggaaatgggccacacgcaagcaaggggtgggagctggcaagatttccgtgccctccccccaagctatctgctggacccaagctctaggaagaaaagctttgtgaaaagacttctggcttcactaagacacattaaagaattaattataaagtaaagctgaaggagaaaattaattttagaaacacaagaggttacaattttttttttcctggagatgggggaggaaacacagttattttcgttttcatcctgggggcaagctgggagctgtccagtcgataacctggccatcagaacaaggtttgtaattaaaaggtcagtgacctggaaagccagggccccactcccagagcttctcagtaatgacggagctattaaattaagactgttatgaaatcaatgctaaaaaagctttcatggtaacgagattccattcaaggacatgcaaactacctcatgaaatagacgtaaatgataaaa

SEQ ID NO: 227833 - DNA, 484 bp, Homo sapiens
cctcagcctccccaaagtgataggattacaggtgccagtcaccacacctggcccatgatggattttcagatgacctcttttacttctaatctctccaaagagagatattcttgtttttaaggtcaatattgtcataatagtcatgatgtcctcacctgaatgttgtaggtgtcagaaagttgtttcaatagtaatatgccaccaggcagaccacctaatctttaaatccagttgtagcactcaatttattttctgtttggggcactagtgcactgagccaagtcaacttgtccacttttctaatatttcttacagctaaggaggaactgttggtcctttgatatcctagaatgctttctacttgtggaaatgctttttaccctaatacactgattatattgtctaaatgtctaaacagggattctctggttagaagtgaaatgagagagtgacccattttcagatttttagagattggctcccg

SEQ ID NO: 227834 - DNA, 421 bp, Homo sapiens
tctttgctgcctctgccctgaatttcctattgtttggtggacatctctgcttgatgtcctgctggtttttaaaactcactttccagctacaagaaggctgtggctggccgggcgcggtggctcacgctggtaatcccagcactttgggaggctgaggcgggcggatcacgaggtcaggagttcgagaccacggtgaaaccccgtctctactaaaaaatacaaaaaatcagccgggcgtggtggcgggtgcctgtagtcccagctactcagagaggctgaggcaggagaatggcgtgaacccgggaggcggagcttgcagtgagccgagatcgagccactgcactccagcctgggtgacagagcgagactcctctcaaaaaaagtcgacgcggccgcgaatttagtagtagtagtagtaggc

SEQ ID NO: 227835 - DNA, 461 bp, Homo sapiens
acagagccaaactctgtctctaaaaataacaataaaagaaaaataaattgtttattttctttcctttgcccttctttctgttctcttcaataccggcaggggagtgttacagaaaatattggtgttaaccctggggagggagttcttgtagctttaacccagatccagactcctctttctgcccacatccagaccactgagcttgaaatagagaagggcccacccagtgcctctagccctgtgctgtccagtgtggatgcccctggccatctatggctttggagcactggagtgtggttgggccaaattcagatgggctgtaagtgtaagaacacactggtttcaaagacttaatattttttaaaaagaatgtaaaatatcacatcatttttctattgattacatgttgaaataatattttttatatattgggctaaataaaatgtactatcaacattact

SEQ ID NO: 227836 - DNA, 584 bp, Homo sapiens
cccgagtagctgggactacaggtgcccaccacgcctggggaattttttgtattttttgtagagctgggttctcaccctgttgcccaggttggtaattggaaggttttaaacagtctctgtatgtgagagtgagcacatctagccatccagtgaggataggagtctccatgcaaccgaatgtgatttaatgttgttcctctctaggactcatctctaaactccactcacaggtcagaaaacttttccaagaccatgtctccacattttgagtttgaaaaaatgagatcagggtcttacagatgttttgggattgtagaagataaagggagtaatatgggtttggaagaccctgttattcatgacaatgcagaagggactagagcaatgcttatgtttttgtgtctgtgaaaagggggcctactggaagggaataaagtcaacagatgcataagagaccaagatcttcaggcacatggaagcttgtatttatccactgtctacaattcccagtgtaagcagagaccagtgtacaggctaagaagtactgaaactttctttgacttaggaaattgagctgcatcttg

SEQ ID NO: 227837 - DNA, 501 bp, Homo sapiens
ccccaaaagagattaggttaaccccaaagtagactctggctacctttacttggaaagtttatgtttggtgatctaccttcacttcatcactctatctcgccatcagaggaaacggggccttctggacaagaagagaatagttacagaaaacaagaaggctacgtgttcaagctttgaattcaacttaaccccattacacctggtccctcggatcccagaggacatgctttgcacattattcagaagttacagagttcaaatataaacgtagatgactcttttgatgcccttgaggttggcttttatgcatcaaaaaaggttattcagaggttacttagctttaaaaattaatatttaatttactaaagttacaacttaaaaacttcgcttaccgccaggcatggtggctcatgcctgtaattccagtactttgggaggccaaggcgggcggatcacaaggtcaggagttcgagaccagcttggccaacatggtgaaacccc

SEQ ID NO: 227838 - DNA, 517 bp, Homo sapiens
gggagcaagaaaaagggaaaacaagaaaggaagggcctccttcactggctgcctttgtcctgacacctcctttatttgagttactaacatggggttccagaaggtatttttccataaaaaaacattgaaatcattagctgaactggatagtctactccattatgtcttggataggttctgaccttcacacatggccccggagaataagaaactgaagaaagcagtttttatggcaaaaaaaagaaatgtaacgaggaaggacatatctggcttggtgagccaaggttttgcatgagagacagctttggcagaaaatatgtttggctgcatttttttaaaacccaaatgaaatagctttattttactaagtcccttgggtaaaatgtgtatgtttttacaatatatattacctacactattaagtagaaaaatgtcagtagcaaattggcacagcttcttagactcctaatatgtatgcctagtgttccattattggaatgctaagcttgtgggagtt

SEQ ID NO: 227839 - DNA, 763 bp, Homo sapiens
tgcccagtctggtctcaatttcctgggctcaaccaatcctcctaactcggcctcccaaagtgctgagattacaggcatgagccaccgcgcccggcctctttaatgactgatttttgtgtagactccagcttgggtgacagagcaagaccctgtctcacatacacaagaagagagaaatgattaccagtgtttgctattacaaataatgttctagtaagtaagtacacttatacatatttgtatttttttaatataaaaatttgaaagggaatgtggagtcttaggaagatccatatttaaaattgttattttatgatgctctccaggcagactatagaaaattatgtaggttaagaatgtttctaggatattcaaaatttagtcctcttttaagagtaggtaatgaggatggccacccattgcaacatgggttgaaaaaatagagtcatccaaaaccatctcatggaattctgattgagttgttgatgggtttatgacttatatttacaccattagaatataacaccttaagggtaggtgggcactgtcttattcccagcatttttcctggtttagaatactgccgggcacataacccacacctaataataagtatttgacttttttttttgagacagagtgttggccaggcgcggtggctcaagcctctaatcccagcactttgggaggccaaggcaggcgaggtcgggagtgcgagaccagcctgaccaacatggagaaaccctgtctctactaaaaatac

SEQ ID NO: 227840 - DNA, 513 bp, Homo sapiens
actattttgtgacaggtcaacactagaggttatagaacaagattcaacaaaataataaaatgaactagatacaatttcagtggccttgtgaggcttttcagaataaaggttaaccaccaaatcccatttatactcattaccttcatcatcttctgttaagacaagcccacaatctgctttcttcccttcttcactgccctaaagttattgctagtactaaattttctatttcttttctcctctcattgttatgactttaaggtacagaaaggggttgatctacctctttcaacaccctagaaaattataataacaggcttcaacaacctatgataccaagcagaagaaagaatacctggacttgaagacaggtcttttgaaataaaacaggcagataaaaatttaaaaagaaaaaataaaggaaaaacaaaataaatgaagaaagctacgaaaattgtgggacaccattaaacatatatttgtattatggacattctagaagagaagagaagg

SEQ ID NO: 227841 - DNA, 317 bp, Homo sapiens
aagctcgccatcatagctaagtgtgtcactgggaaatgtactaactatagcaactgaacacttctctaagaaaatatacatgtttttacagctttcagctcctttttaagtgcatatttgtgggttccaaaatgtttccatatgtcttcaaggcctgattttggttatgagcctcttgtctattttcatgtactgaggggaaaagatgcaactatttaagagttaaaataggaatatgtaagttgacataaaatccaaaaagagattcatttataactagaaaattttgttttagttatttagttttaattacactt

SEQ ID NO: 227842 - DNA, 891 bp, Homo sapiens
accccttgccgctccatgcagtctcccttggcaggtgtggaatccaggccattagtgtgagctgaacacagcctgccaggtcgagtgagcagaatgagctcagtgggctgaagcaaaaatttgggcaaaggcacgactggccacagaggtttccagccagaaaagcaacaccccaaagatcccataataataggagtgcaaaacctgttgtaaactgtgcatgccagggatctaggttgtgtgttccttatgagaatctagctaatgcctggtgatctgaggtggaacagttttatcccaaaaccatccccagccccatccctgtccatggaaaaactgtcttccacaaaacctgttcctgatgccaaaaaggttgggcactgctattctataccgctgtaggatgactatagttaacaataatatatagtttcaaaaagctagaaggaagacattgaatgttcccaacacaaagaaatgatacatgtttgagatgatggatatgctgattatcttgatctgatcactatacatgatatgtattgtaacatcactaggtaccccatgaatatgtacaattatgtgtcaagataaataagtaataaaataaaaagctttatcttattccccaaaaaaagacagcttgaggaaaggaaaaaggaagattactagcagagttgtaggctattgtctatggtactttactgcatgaagaaggtacagaggctgaatggaagaggggttgtaaaactggagtatgggctttcctttcacatggagctttgtttaacagaagtctagaaagtagatataagaatcattatcatggttagtttatgtcaaaactatacatactgtcttattatacttaattaaatgggtaatcatttg

SEQ ID NO: 227843 - DNA, 323 bp, Homo sapiens
ctcatttgcaggtggtgaccctacacccaggcaggactgtaaatccacgctgtttgcctgtgactgatttgggatttggatttctgatctggctgagtgatgtgtaaaaacctcaagtagtcaacagctccctattggctatgcatctgaggggctcaagagcattgtttattccagcaagtgtctggaatacattatactggatgaattggctcctgctactcccgttttggagaatatgaagaattttatactgtgctaaaataaatgtactttgtgcaaataactttcctaaataaaaaattttgaatatgactctatct

SEQ ID NO: 227844 - DNA, 505 bp, Homo sapiens
tgaaatgtggagagaaagtaatttgaccacttgcttgccctttgctgttccccatcatcaaccactgtcttcaacagcggagggtcccagatgctgcagggagggggagaactgcagggagttcaaataaaacattcacatttcacttcacacacactgtcccttagactttctcttcctatttaagcacatacatccaaccacactcaatcaaatccctgactgctccatgtgagagttctgcttccagcatgacgtggtctgaaagttcatctgaagacagctgctcactcccgggggctaacaccgccccttgcatgctgatgtccttgtagtcattggtctgatgccacaataaataattcctaaggctgatgctctatttctgccctgagactctcccctttttctccaagctgtgccccattccttgtcttagtccaggttccctacactccccaggccaatgcttttgaataaatcttgacgtcattgaatgaaaaag

SEQ ID NO: 227845 - DNA, 566 bp, Homo sapiens
atgttggccaggctggtcttgaactcctgacttcagatgatctgcctgcctcggcctcccaaagtgttgggattacaggcataagccaccatgcccggccccatttttcttcatagcacttatcattacctgacattatatattcactttcttattatctgcctctttagatgagctccttgaggacagggagttggttttgttccctgctgtatccccagcctcaagaatagcacttgctcagcagagtagcgctcagtgagtatctgctgagtgaattctgagctttgttgaggttcatttaaacatttagagcactagttcacattcctgcagtttgtgggtgaagggctactaagtatttgacagtttttccggaacctgtttctgatcaactctgctctaaagagcagagtttctgctcaacagtttctgatcaacagttgctctaaagaaaactttccacttttggaattgtatttgaagcagcaaacaagggctgctgggggactgtatgtcttgttcattttccccactcccaaaacactgatgatagaaacctgcac

SEQ ID NO: 227846 - DNA, 482 bp, Homo sapiens
aaggaaagcaaagctgaggagaaaatccattgatccctggaggaccctcacgtggcattggtactttggatcacaagactgccccacgggcagaccccccaactctgagccagaccccatgtcttgtatagattacgagtacacagaaggtgcatttactgaggctgtgcttctgttttgggtttacaaatgtcatcaaaatggaagacccagctgaagttaatttgttggatgcctttttctctcaattcactggaaaaaaaaaatgtttaactttttagcttccaagttttaatttctaaaacaggtttcttgtggtattttgcaacgattttatcatcaagcctggtgataaattgtttttaaagggtaatgatgtattaatgtacctttgaatttacgattctcagtaggaaactaacccaagacctaaatgttttcttttctagagaataaaaaagttaagtacatgtttccttctg

SEQ ID NO: 227847 - DNA, 263 bp, Homo sapiens
aaaaatttgctaggtgttgtggtgcacagtcctacccactagggaggctgaggcgagagaatcagtttgagccccggagttcaaggatgcagtcagctgtgatcacgccactgcactccagtctaggtgagatagtgagatagggggagcaagaattctgtgttcttaatcactgtactataatgagatagtacatttgctttttttttttgagacggagtctcgctctgtcgcccaggctggagtgcagtggtggatctcgg

SEQ ID NO: 227848 - DNA, 438 bp, Homo sapiens
aagacgtgcctccttcctttttgccttctgccatcattgtaagtttcctgaggcctcctccaatcatgtttcctgtacagcctatgaaatcatgagtcaattaaacctcttttctttataaattaccaagtctcaggtagttctttgtgctagaacaaactaatacagtccctcagcttctttggtgcctaaggtccaccatagcatgtgtatttcaaattgcaatttactgctatttcctgaatacactccactctttattttagagagtcagtatctctgttgtttaagttgacataatctaatgtcagaagcaagatgcaaaggctccaagccttctttgttacttacagttacagcactgttatccaaacagtaacaaagaaagcctttggaaggctttcaagtatctggcgatacttgaaattgtgtatgata

SEQ ID NO: 227849 - DNA, 336 bp, Homo sapiens
agaggtgctgatattaggtaagtttcttcagttgagcatctattgtccattttttattaaaagtaggccttggctgggcgtggtggctcatgcctgtaatcccagcactttgggaggccaaggcgggtggatcacaaggtctggagttcaagaccagcctggtcaacatggcgaaaccccatctctactaaaaatacaaaaattagccaggcgtggtggcaagcgcctataaccccagctacttgggaggctgagggagagaactgcttgaacctgggagatggaggttgcagtgagtcgatatcacaccgctgtactccagcctgggtgacagaa

SEQ ID NO: 227850 - DNA, 453 bp, Homo sapiens
aattttccattttaaaggacaagcacagtggctcttgcttgtatcccaaaactttaggaggccgaggcaggaggattgcttgagccaggagctcaagagatcagccttggtaacatagtgcatctctttttaaaaaaacagaaataggctgggcatggtggcacacacctgtaatcccagctactagggaggcagaggcacgagaatcacttgaacctgggaggtggaggttgcagtcagctcagatcatgccactgcactccagcctgggtgacagtgagactccatctcaaaaaaaaaaaaaaaaaaaaatagaatcaggaaacagatggactacagggtcctgttttcagagggtatgtcttgttcactcaggcagttcttaggacatagttggtcctatataaattttccttgagttgaaatgatgagtacctttgaacatggacagca

SEQ ID NO: 227851 - DNA, 553 bp, Homo sapiens
gccaaacctgcagctaaaaatagatatcctgttgttagagtgaaaaacatttgcttagagcataattcattagcatcttttgcttaaataagatgcttggaagttaacctttgattcagatatttttaagagaagtagaatatggtttctctgataacataacagtcctataatttgcatttataagatttggaattggaatttagaaactgaaaggtggatttttgctgtataatgatagaattcaaaattgacgaaccttttctttcataactggagatcacctcattataaccaataaatattctttatcctgctacagtacaatataaacctcttaaacactgttatatatttgtttatagaataatattagatattaaagggacattttaacatgcaaaatactaagaattaactggattgttattttcctgttactgaaatagatctgttttaaataatctgctgttttaaatttgaacgaatattacaaaaacaacttaacattccttaggatttctatggatatcaaactgaatatacctggttg

SEQ ID NO: 227852 - DNA, 489 bp, Homo sapiens
ttagatgtagtttgtgatttcataggccccaaatacatatctaattattttacccaaatttatattgcttctatttttattgtggtcataagtacagttatgaatagtctgttcaatacctttgcctatttatctgagtttatatgttttctgtcaattctcaatctaaaattttaagaaagatttggggacttggagtccttcccctggctgggaattgctcctcacatggccagtggcagaatgttatctttatcagatatcaggctaccgtcaaagaatggcccactgctagacatttcagaaattaacacagaagatcttctgacttcacctactgttggcgtctgtgtttcacagttttcttgcaacctacactaaaagagtgtgtcccaaatcctcaaatatcacagcacaccatccaaataaaacatgtattaggaatgagaaaaatatgcttatatctattattacctagtcatactttaa

SEQ ID NO: 227853 - DNA, 539 bp, Homo sapiens
ctggagacatttttccctgccctaaaaatggaacacataggaacagaaaaccaaacaccgtatgttctcactcataagtgggagttgaacattgagaacacatggacacagagaggggaacaacacacaccaggacctgttatggggtaaggggtgaggggagggaacttagaaaatgggtcaataggtgcagcaaaccaccatggcacatgtatgcatacctatgtaatacacttgaacgttctgcacatgtatcccatttttgtttgttttgagaaattttttttttaatgggacacaagagaaggacagttcattttcagtctcccagtgttgtcaacccctgtaatacctgaagctataacagccaacttggaatcatgaaagaaaccagcctcagtggaaaagccaacctgctgaggatggcagagcagaaagatgggagacacctgggcccccaggtaatgaggtcactgaagacatgctctatctctagattgttgttatatatgataataaatgcttaaataactttggat

SEQ ID NO: 227854 - DNA, 455 bp, Homo sapiens
  misc_feature (75)..(75): n is a, c, g, or t
agctttaggcaggcaggtgttggggagaaacttacagtggcccagaattaagagtcctggctcttcagggcagcntgagtctcttatggggccatgggaccaaaggggataacactggccttgctcctttgagcccgagggtaggtgagcggacaggagccagcctgcagctgggccttgggtcctgtcctcccctctggatctcagagctctgggagggagtatgttgagatgttcacagtggggaggactaaaggccctactcttgggcccagaagcatagctgccttcacaggaacatgcggagggctgttacaagtagcagggagatgggcttttaaaaaagtgtgtgtatataatttgagtgataattatgggccaagcagtgcttcccttatttgttccccaaggagtcccatgagctagaatggttatccccatgttgtagttgacaa

SEQ ID NO: 227855 - DNA, 490 bp, Homo sapiens
gttgcaacatttttcatacaaggacagtacacacattatagcaatttgatgagcacagcttgctacattccaaggaaatttgctttaacatttcttgaggagaaataatgttctgaggaattcttatttctggcaccacttggtcattcctaattatttacagaaaaaagcagaagttgcaactgcatgctacatgtctcaagctacatagccacattcctcccagggctcagggaaatttagagttcgaacagctttaagtgaattatttaatttcacaacatatacacagtgaaatgattatcgcagttaaacaaaataacatatacctggccttcaacagtagcttttttttgggtgataatagctactttagcaagatttcagtatacaatacaatattgttaactttagtcctcatgctgtatgttagatcttttagatttactcattgtacctaacctaactgcaaatgtgtactctttggccc

SEQ ID NO: 227856 - DNA, 461 bp, Homo sapiens
cagtcgtggtatccttgagggcaggcattggttttttttttaaatttattacaatatttagcttattcctagtagagagcagtcaatggatacattttccaaattgaattgacttcatgtaagtgaattttttaataaacagcaaatttacacggtgaatattaccttttcagaatctgtttattatattaatattgatttctcaacattatacctctattaaaaactctttgttaatgaagggttttgacactaaaaaataaactaatatatagcataacactgaagtttaagaaaattattgtatgaaacattcagtaaaagcaagcacttactaccctgtcagtccaaaatgtaatattgtgcaatagcctttaaattgtattgttataaaaatgttgcttaactgggcccttaggaattaataacggttctaaaaataaactaaatggattattttc

SEQ ID NO: 227857 - DNA, 387 bp, Homo sapiens
tttggtgtgtcacacctattgtcttcatgcctcagccagaaataagaagagtcctcttcaaaactttgttaggctaggtcagaaagttagatgagggatgaatactgcttcagtccgttttgtgctgctgtaacaaaatccctgagactgggtcatttataaaaaacagaaacttacttctcacagttctgggggctgggaagtcctggatcagggcagcagctgggctgatgacggctgctccctgcttccaagatggcaccttgaatgctgcatcctccaagaaggaggaatgctgtgtcctcacatggcagaaggcagaagggcaagggggcaaaaggggaccaactcccttagtcaagtctctgtggaagggcacctaatcca

SEQ ID NO: 227858 - DNA, 270 bp, Homo sapiens
gtgatttgaagggaagatggaaagtggccctttacctccagccaaaaatgtctgtcctatacatcagcagaggctccaaaatccctgtggattttgaagcttttgagtccccaggatgactaattattatgcagtttcctcagaaagggaatcagaagataaggcctaatggctgggcacagtggctcatgcctgtaatcccagcactttgggaggccgaggcaggaggattgtttgtgctcagaaatttgagaccaccctgggtaatat

SEQ ID NO: 227859 - DNA, 167 bp, Homo sapiens
gttctggcatacttctcccttgtcttaaacttctaccgtcctttaaacctaacgaaaccattgatcctattaccttatactctgatccttttgatacgtgctttgtcttctgtgttcaactcaaaacacacaattgtaatactcatttcattgcattcatgttaact

SEQ ID NO: 227860 - DNA, 890 bp, Homo sapiens
ttcatctggagaagagaataccttgcaaaataatgaatgacattgatgaatcgttcatggcatgtgtaaacttaaggtattttcactttcaaatcagaatttgttgagtatgttactattctatataaatatgattttcaaacatttgtttattaagcatatattgtgttctaacaaaacatatatgttcgtcaggattttgcaatgcaaatctttttagaaaaagttatattgttcataacatgtaagataaacataccctgtgagactgaccagaatagatatgagaagtcttctatgagtaacaaagtgagtgttttcctgtaaactgagacccatcacaatgcaaaatacattgcaaagactggtaagtatatgagaagaaagaagcctaaaattagaggagctgcaatgcacactgaaatcctgatggttatatacttaaaatttcttgctgcttggagtttcttgacttacaaagtttatatttggattcagtaattggccttgggacatttgaaaacaaagctgttgatttgaaaattaacagtgtgaaactggacaatgcatgcagaatgttgcaagaccaagtgaatgactactaaattagccatcacttcaatttcaaaccatattcagtagaaaattgatttatataatatgtaaaacaaagacatttataagaacacaatttcctatgcttggaacttttggaagagaagataattattcttcaatctacttaatattccattaaaactaattactatgcatgaccattgtgtaatgattctagtcattcctcagaactccaatctgagtgctcaaaatttgtccctgaatcagtttcatatagttacctgaataaaagaaatcagaagttaaagttt

SEQ ID NO: 227861 - DNA, 279 bp, Homo sapiens
ttttcttttccaaagctgtctctattcattgtcttattttattttataaaggagacaaacacaaataaatgaagtaagtggcttactcaaattatcaagtaccttagtttttatgctaattagattctagttctatgtttttctgccccgttttcactacccaggtctaattatttattaaatataattgatatttattggatagcaccttcaggatatgcttgcctagcctcattactgcacataaatacactttccacatgctgactttgctttgta

SEQ ID NO: 227862 - DNA, 2723 bp, Homo sapiens
  misc_feature (475)..(475): n is a, c, g, or t
  misc_feature (483)..(483): n is a, c, g, or t
  misc_feature (611)..(611): n is a, c, g, or t
aaaataaagaatagtctccatatgcaggttgcagaccaagtaaatgcagcagcaatggcatgcagaatttgagtgttctcaaaccaggccacatgatagggatgtattatttgtgactgtgttccactactcaaggaaattgatcagctcttccaaaaggacacccatgatcatattctgctcttttctgcaggacagcaaccacttagtttttaatgacaggctcaatattataattgtagaaacatctagaaaagtgaaattgtatgcgtttgtcttttcttttcagttctgtgcctatttcatactgtagataatattgacagttcttagattaggataaatcaaagaacccatgccagccaaggagtaccacataagcacttttgctgatgggtgaagccgaccatccatctcagcaggagagagtaaccttttcaacctaaaccacagtcagggaagctacagtccacancttcccanagaaatgtggttagagggcatctctctttctggttgggtagctcagtctaccaaactgcacaggcatttaatatttagagatgacttccagaagaggaagtttgtcttcagacatgaaaacaataagncctctgagatacaataaatacatacatacatgaattgtttatcttaaagcagtgattttcaaaaatcgctttaagaaacctcagttatatataaagagttgttactttatagcagaggagtcctttggccagtaattttggtaaatatgttgcaaactcaagcaggtttctaatactctaggacttatcaaatcttctgttatatttaagctttgtgaatcttagagagagagatagagtgcaacatttgtcaaaattatttaaccataaaatcaatgtattcatttcaacaatctcatgaaaccaacttttctgtgaaatatgctttggagaatatgttaagatttaattctttcttatagaatacaatatggatctatatgatgctaatttggtcatatacatgtaaaaggaatgacattttgttaattaaaattttttggtaaaaataattaaagtgatatttgatcagatttttatataggactagtgttttcccttcgtgtgtgtgtatatatatgtgtgtgtgtgtgtatatatatatacacactcacacaatattgtgtatatatacaatattgcagctactggttattgcagcatatttgctctgtgaaatcatcacttttactatttcacattctgagcacatactcttcttgttctttttttctttgtcttccaattcattatttgtgttctctgatttcattaagagttcttatttttgatctagttatctccctctctatcagggcaccctctatttctatctgtattaaccctctgaaaacaggaatacacagaggccactccaaacatggacatttgcaatgcctagaacattgtgccagtggatatgtgaatgaattattccctgtcccccacctgcacattattccgttttcttgctcattgccactgtatcagaagggcctttctttactcctaaccatattagcaccatcttgtcacatgtctttccctacctcttatgatctagatcattaattctggagttttaattttaaggtatactatatgggaaaaggaggcacctcaggagttcatgagaaatagcatgaaaagcttgggatgcttattccatggaacttaagacatttgctgaggttccagagtattatcaaaaaatttaagaagaaaaatcagatttttaatacaaagagcacatcatagatgtggtttgtagtttgtagacaaaaaataaaaaaataaataaagaacaattaaaaggcaacactgaattttaggatataaattataagtacttgaaaaaaaaagcaatgttgttttattttgtccagtgcaatttacataattgattggctacccagggtccattttccttttgcattattctaccccacccatccactccatgtgctgtggagaaggtagaccacatccccagctgggaagagagggcagagttgatttaaattaatccatattttgtatcccattgggcaggccttgattaaatagtggcaaaaataaaattacttttaattcttgctgggaatcctagatctaaagggctctgcctctaggcatatatgagacccagaattgttgtaaccattagataacacactaaaaaaaattatcatgcacagttaaaaaatcacagacaaatacagcaaaatcatgactgaaccatgacgtttcacaactctacttataacttaagccactttgtactgagcattggttacttccagcagaaaccatcctaaatgataatacaaatatattggaatcatctaatacaaatatatatagaatcatctaactgattcataatcacttctaaaccattgtttatatctccttttagaagatcttgtctgtttttgcccgaagtggacagatcacaaggtcaggagtttaagaacgtcctgggcaacatgatgaaaccctttctccactaaaaccacaaaaattagctgggtgtggtggcacgtgcctgtaaacccagctacttgggaggctgaggcacgagaatcgcttgaactcaggaggtggaggttgcagtgagccgagatcgcgccactgcactccagcctggagacagagcaagcctctgtctcg

SEQ ID NO: 227863 - DNA, 541 bp, Homo sapiens
  misc_feature (505)..(506): n is a, c, g, or t
  misc_feature (517)..(517): n is a, c, g, or t
  misc_feature (529)..(529): n is a, c, g, or t
  misc_feature (531)..(531): n is a, c, g, or t
gatgccccgggctgcaggaattcggcacgaggagagaactagtctcgagttcttatttttgatctagttatctccctctctatcagggcaccctctatttctatctgtattaaccctctgaaaacaggaatacacagaggccactccaaacatggacatttgcaatgcctagaacattgtgccagtggatatgtgaatttgccactgtatcagaagggcctttctttactcctaaccatattagcaccatcttgtcacatgtctttccctacctcttatgatctagatcattaattctggagttttaattttaaggtatactatatgggaaaaggaggcacctcaggagttcatgagaaatagcatgaaaagcttgggatgcttattccatggaacttaagacatttgctgaggttccagagtattatcaaaaaatttaagaagaaaaatcagatttttaatacaaagagcacatcatagatgtggtttgtagtttgtagacacnncacaaccgttntcacctccccananaaggccccat

SEQ ID NO: 227864 - DNA, 530 bp, Homo sapiens
tgtgatccagggtctgaactacgtctgagtggggtctgggcggctgtgatcatggggttcaaattgcgtctgagtggggtgctaccttctaaggccgcaggtgagactcacgtgccctggaacattccttgaggcagccagaccaggagggcgggggctgttgcctgacgtgccctcggtggcatagactgagtttattttcattctcctcctgaccacgttggccaccgagaaactcttcatttcctaaatcagatgtggacttgctcatctcaggacccacgggctgccctttagggaccaaaacacatgtgtcagccaagaacgagcaactgcaaataaaatcctgttttcttcttatattgttgagaatcggggccttgatttggttcccagattttaaaaacaagtcagagctgccacgattcagataaaatccaaactgtctcttacacctctaattatcagcttgccttctgggtaaaatggtgctattcaattattggtttttgttcacttgtcaaccacca

SEQ ID NO: 227865 - DNA, 541 bp, Homo sapiens
agcttgccgggagcaggcactggcagaggctgcaccagatggctctggctgtccccgctcctcattaaagcagccgcccgagggctgctgcccacctgaaatgcagaggtagctcacccagccctgctgagggtactgtgcccagccaagctgctgtccttagatacttggcctgctcagctgtgccctggaggcccctaactgaggtctgaaagccagaggccagtgagggcaggactggatacagcctcctctctgcatggatgggatgttgactgaaacccagagaagaccagagacaccgtagctctccctcgactcacacagcaaatgtcttgagacccggaaacagcagcgccatgccaaacccacccctggaacactgacctgtctgcatcttccagcaccccaaacctgggtgaggtgtgtgggggcagaagaggggtctccgtgatgtaactatgccctttgtaatagatgtatatgattttttaaaactcaagcagtgtaaaagaaagcagataagtgatcttcccgcgaa

SEQ ID NO: 227866 - DNA, 485 bp, Homo sapiens
aaggggtgtgtgagagataccaaggaggaaactcacaagacagggacaccaggaagcagctgatctttgctcagatgtcactttctcagtaaggacttctctaactttccgatttgaaaatgaaatccacagcctcagtaccatcagtgatgctatactgttagtttactttttaaaaatttgaaaatgaaaaggtgacatttaagcaaagacaaaattttaagaatttaaaaatgtgtttattattgtctctcccattggaatgcgagttctaccaggaactgcttgttcattcctgaatctccagcctggagaacagggccagcacatagtagattctaggtaaatgtttctaaaataagatgaataaatgagtcagtggagagtgggcgaaggaatgagtgagaaagcacatctgtcaagacgtcttgctcccctcggggagctgggtcctactcactgcatttctttccctcttgccacag

SEQ ID NO: 227867 - DNA, 333 bp, Homo sapiens
caggcccgcttcctcaggactctaaactctagcatttatttttttgttaaacagctttagtgaaatataactcacaccggatgcggggctcacgcctgtaatcccagcacgttgggaggccgaggcaggcggatcacctgaggttgggagttcaagaccagcctgtctctactaaaaatacaaaattagccgggcatgctggtgcatgcctgtaattccagtgactcgggaggctgaggcaggagactcgcttgaaccagggagacagaggttgtggtgagctgagattgtgccattgcactccagcctgggcaacaagaatgaaactgcctc

SEQ ID NO: 227868 - DNA, 337 bp, Homo sapiens
tttacagggtgggtgaactaacggaactaaatcgtttgtggagaaagtccggcccgggcctagcactgcaaacgcttagcagcagctcatgtcacaccattgccagggtccaggatcaagctgggggtgggcaccgctggggcgaggaggctggcccagagctggctgtggcatcagggtggataccaccataacccctgacacaatggcagccggtctcatgcattgggatggcacctcttctttttttttgagacagagtttcactctgtcgcccaggctggagttcagtggcatgatctcagcccactgcaacctctacctccctggttcaagc

SEQ ID NO: 227869 - DNA, 292 bp, Homo sapiens
ctggtgtccaaactgtcacaaagacaaccactgccatattaagcttctaatactaagaaaagtgtcaggtatacggtagtagatcctgatgaaactcttcagaaactgtttctgcactttacctcatctggcagctcttggtgtgcgctgaggtaatatattaaatttgtggtgtaattagtttagaaattattcccctagggaacaaagatggtcaagagacaaagcttgatctaaagttgacagcctgggagacaggccgaatttggaggtgttaccgtagcatatgtgg

SEQ ID NO: 227870 - DNA, 172 bp, Homo sapiens
ttacatcagtctcatgaggaaaatgtcttatagatttggaaatcagatctcagagaggtttttcatctgcccaatgtcagtttaaggtcgatctaagactcaaacccaggcttgtacattttacattccaatgctctttccatactaaactctgctttttcgttgtcataca

SEQ ID NO: 227871 - DNA, 345 bp, Homo sapiens
caacacgactcctggcctaatggactgataaggtaaacaagaagaaagacacaggcctgtacacataatagaaattgggtgtgtaccagcctgggcaacatggcaaggctctgtctctgcaaaaaataaattagccagaggtagtggctcacacctgcagtcccagccactcaggtggctaaggtgggaggatcacttgagcctgggaggttgaggctgcagtgagccatgattgcagcactacactccagcctccagacagagcaagatcctgtcaaagaaaagaaagaaaaaagaaaagaaaaggaaggaagggagggaaagaaaggaaagaaagagaaagag

SEQ ID NO: 227872 - DNA, 477 bp, Homo sapiens
ccttgagaaagaagagcaggctaaacccaaagttcgtggagggaaggaaataataaccagaccagagataaacatgatagaggacagaaaagctatggaaaaaaattattgaaaaccaaactaggttcttcgaaaagattttaaaaaactctgacaaacctttaactagattgactaagaaaaaagactcaaattattaaatcataaatgaaagagtagacattactactgactttatagaaattaaaaaggattgtatgagaaaaccatgaataactgcataccaacaaattggataggctagaagaaatggaaaaatttctagaaatacagaaaccagaaaaactgacccaagaagtagaaattctgagttccagctactcatgagcctgaggcaggaggattgcttgagcccaggaggctgaagctatattcactgcactccagctagggcaatatagcaagaccccatctctt

SEQ ID NO: 227873 - DNA, 1881 bp, Homo sapiens
caggtgtgagccaccatacctggccaatttttgtgttaattcatctgaattcttgaactccaagtttgtgtaagatgcaagcccagcatttccattcattacttaacagacaaaaaactttttaatcatgtcactcttctggagagaggacatttttcctactccaccctgtaacattcagtctcctgccagagtttcctctcattggccaaacccaggcagaggccaaatagaacagaagcttagaaaaaacagcctgcaggattggcttttttgcagcccagagcagaacagggaaaaggtgagaaatggacctgggcacaaacaggcctaggaccaacacaatattctatcccctaacaaatattccctgactgcaggtagccaacacgctgtgctcagcttgctattacagaaatgtgttagacacagtccctggtctgcagtcagagccactgacaccgtaactacacagattaacaacagcaccagttagacgatgtgtaatgttaaaagacagatacaaaccagtaccatggaaacactgcatgtgttcagcggtcacagcttgctaagggctactctattgacaatgcaggtatagagagtggcaaaggggtgtatcctatccataaaacccgaattcctcagttcatcaggacttttctcaggacaaaaaagatgttaccctccctcctctcaaaaaagaggattcagtggtcaaatacgtgttgggaaccctgagctcatcaaatttttctgtagcacagagtttctcactgcctaataggctaatgtgcactggggccctgcgagtgagatatacagcctgcagcattgtctggattcatctgaccgcacaggacaggagcatcaggagcctattttggcatttgctggactggggggagcagagagccaggcagcaggcaagaggcagaagacagaaggaaacaccaagaagaggagaggctcaagggctgagagaggcagactcaagtctccaaaaaagcctcccatccaaggcgcctgtgctgtgggccggcaggggagggtgcaagctcagaagaggtcactgaacttggcaatgccaaggtcatcgataccttcccgagagcagtgtcgggcagtggggcagaaaccagaatcccgagtggagatgtgacagggaaagctagcgagagttggccatgggtgtaaacccctctagtgacatttgccaatgagaccaaaggcaggcggtgctgaggagggggcagggttggagaagtgtgcttgttggttggtttcaaacagtgggataggagggacacttagcaatgtttacgggctaagaaggaaatggcgaagagtgaacatagaagcgtgaaggaaagggaggggccctggaggagaggctgactacagacagtggctttagaaagaaacaggacccctccttccctaactcaggaaggacacacagggacaaatggacagacagaaggggaggaagagaggcctcgtgtctttattttttccctgacatcagaggtaagagcatctggaagtgagggtaggagctgggttggaaacttaaacagagggtaaaaatttaagagcaggccaggcgtggtggctcacgcctgtaatcccagcacttcgggaggccgagatgggcagagcacttgaggccagtagttggagaccagcctggccaacatggcgaaaccccgtctctactaaagatacaaaaattagctgggtgtggtgggcacctgtagttccagctactcggagactgaggcaggagaatcgcttgaacccgggaggcggaggttgtagtgagccgagatcgcgccgctgcactccagcctgggccacacagtgagactccgtctc

SEQ ID NO: 227874 - DNA, 500 bp, Homo sapiens
tccaagaggacacactcagccacccacctcatgggactgctatgagaatgactgaaataattaattgtgaagagctttgtgcccctgggagtaagaacactatgacacaactggagaaactggttattttaccaaggcttaggctggaatggtgtgctttcctttaaagaatcaaacttgacttatggagccaataaaagcctcttgggaaaactggcctcatacatgtctacacagtccctgtatagggttcctgacctgtgatatattataaaacaagaaatttagttccaatgtatccaagctgtcccttcggaaggtgatcagaagagagaaatgagtttggaaaagaaaaggaatagctgaacaagagcaagtgatttcagaaatctaaaccctgagaaaacatgggtaacagagaagaacttctgctgtgatatctacttctgcagggagtagagaaacagaagtagaaggtaaatctgaggtaagccagaact

SEQ ID NO: 227875 - DNA, 328 bp, Homo sapiens
tttccatttctggtagtgacattgggcaaagttgccttaaagagctgttagagttctaattcttatataattaggtgttttagaattgtgacttgatcagggccccaagattatccgggatgatgtcatttctaagatgtaatctgatacgaaaatgaatttaaagagtaattttaaattaaataaatttaaagataaaaggaatgatttgaggctagtacacctaggactaggacctttggtcttctgattaatattatgaggcatggtatagtagatggagctttggctctagcataaacacaggctcaaattccagtcccatcac

SEQ ID NO: 227876 - DNA, 606 bp, Homo sapiens
atataaacatttgcacagaccgataacaggccaaaatatatgaagcaaaaactgaaggaagaaatagttctacagtaatagttggaaacttcattaccctactctcaataatggatagaagaaccagacagaaggtaagtaaggaaacagaggacttaataaacaaactagatctaacagacatacacagaacactctatcctacaacaagagcatatacattcttctcaagtgcacagaagacattttccaggatagagtgtatattaggtaacaaattaagtttccatagatttttaaagatatcatacagagtatcttttctgactacaactggataatgttagatatcagaaatagaactaaaactggactattcacaaatttatggaaattaaaaaacatactgttaaccagtagatcaaagaagaaatcacaagggaaattagaaaatacttagaggtcagctgggtgcagtggctcatacctgtaatcccagcagtttgggaggccaaagtaggaggattgctggaggccaggagttcaggacctgcctgggcaacatggtgaagccccatctctattaaaaactttaaaaaagaaaaa

SEQ ID NO: 227877 - DNA, 341 bp, Homo sapiens
cagggtttcatcatattggtcaggctggtgtcgaacacctgacctgaggcaatccacccgccttggtctcccaaagttctagaacttttaataaatagaattttacagtatgaactctttgtataaacctttcattcaacataatatttttgagaggcatccattttgttgtgtgcagtggtattttgttccttttatcacttttgagtaaggttttattgtagaaatgtgccacggtttgtttacccattttcttgttgagtggacactttcctgttgagcaatctctttcaatatcttgcctagatgaataaagctactatgtgcattcacatgcaagt

SEQ ID NO: 227878 - DNA, 453 bp, Homo sapiens
ctgtttcaacctcagccctggggtgagtggggaaagagcattgcatggctccattgctaaaggaagctcagatcaactctattctttatcagcctgagattcagcctctcaccgttatttttctctcctgggacttaaaggaagggggccagcaacctgggattactgttttttacctccacagggttgctgaccttgcctaaaagactaatgtaccttggaacaagcattttctgtttctttagtcccagtacctgcttcgaggacagacccccagcctcccaagaggatgctgctgctgagtagttgcactgaagccagtttctatcattctgttcctggattcaatgcatgatttctctcatggggcctccaaccaagttcctttctccttagtgccatgagtaatcaaaacccaacatgattgttttctgttaagaatatacaccaagt

SEQ ID NO: 227879 - DNA, 466 bp, Homo sapiens
cttctacttaacacattttaggaaatgcccatctgagaacctaaagattgtttccaccacatatttccatcaaaagtctcaaagctgctagtctgttttcctagatttagatggagtcatctcaaaacagcctcacatttataatatatatggtattttttggtctcaggctttatggttttaaacatcatttgcctcgcggtcaggtcacttagagcagtattttccttctctgcattatctgtccattagtgggcagagaaatcaacttggtggttacaacctaaatgtttttaaaaactgaaataaaactatcatcatagtaaggatatgtattacttcacaaaagtgtatgtgcaatgttgtttgtgtccatatacaatcacactgtgtgtgtgtgtgtgtgtggtcacaacataaaatacttattcctatgagttgcaataaaaaacaagtgaaagccact

SEQ ID NO: 227880 - DNA, 528 bp, Homo sapiens
catgtgtggctgctgagtacttgcaatatagcaagtgcagctgagagatgaattttacattttgtttaatttttattttattttattttattttttgagacagagtcttgctctgtatcccaggctagagtgcagtggtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctattggacagggagctctaggcaagatctgccattaagttatgtaatcttcagcaagtcgcttcacagcagagtcctcccct

SEQ ID NO: 227881 - DNA, 483 bp, Homo sapiens
agtccatttatgcaaacgaaggattgaaattgctgagctctgattggcctgcacaactgagctctgattggccaatgccactgagccctgattggttgatagagcctagctctgactgtctggttctggtgtactctggcaaagcctcaatgttgaaaaatatttgtccaggtatattacatgggctcagggagaaaaaggcatatttaagcctctgtattcaaacactaatctgtaagctttgggaaaagtataagaacaagccagacatgaattatgaagccaggggatgtgctttgagatcctactaccatagggaaattcttgcaaaggctgaaggacagaggcttgtatatcagtgcaaggatatgccctcaaacagattggtcatagataatgacaaacgccagacttgtaatgaaggtttagcagcagcttctgatgcaagtcattaaaaccagtgtcaccgtctgcagagagtgt

SEQ ID NO: 227882 - DNA, 428 bp, Homo sapiens
cttggtgtcccacagtgctgggattataggcataagccactgcacccagcctccttatatttttatatatgtcatgaaggatagattagataatacgagttttttatcagaaaaatgagattgttttgattatatttaaacctctttcctcattcacacaatctggactttttttttttttttttttttgagatggagttttgctcttgtcgtccaggctggagtgcaatggtgtgatctcagcccactgcaacctctgcctcccaggttcaagcgattcttctgcctcagtctcccaagtagctgggattacaggcacgcaccactatgcccggctaattttgtatttttagtagagatagggtttcaccaatttgaggccagcagagacaacatagtgacatagtgagatcccatttctacaaaaa

SEQ ID NO: 227883 - DNA, 370 bp, Homo sapiens
ggtgtcgggttgccagatttggcaaaagaaaagtaagttttacacgggaatactcacactaaaagattagcccttgttgatctgaaatccatatttaactgggcggcctgtagtatttactgtggaaacactatccctaggggcaaatgtttcgcaaggcaaattttgattgccgaagagaccagaaatcctggttttgtgtcatttcttggagcacaagtgagcagttggagatgctgaatctgcaggcgccacagaaaggtgtttggaaggcagagaatgactctttccttattaaaatccactgcaatctatatttccttagatactgtacagctaccttcacaaattaaaagtttctgtatactta

SEQ ID NO: 227884 - DNA, 554 bp, Homo sapiens
gaaggactgaacgtttataccgccccctcacaaatccttatgttgaatctctaatcccaacatgatggtatttggaggtggagtctttgggaggtgattaagttatgagagtggatacttcctgaatgggattagtgtccttataagaagagctcagagatgtagttagttccctttccaccatgtgagaaaacagcaggaagacagccatctgtaaatcaggaactggatcctcaccaagaacctgaccctactagcaccctgatgttggacttccaacctccagagctgtgagaaataaatgtctattgtttaagctactcactttatggtattttgttctaacagcctaaaatgactaagacattccccttagtctgagagatattccttttggaacagaaaacaagagagacagtatagtgtggtggaaagagtgttgactttgcacaagagagacctgggttcgaatctcaacttttctatttaacttttagctacataggtgaatttaacctctttagcttttgtttctccatcagaaaaaaaaaaaa

SEQ ID NO: 227885 - DNA, 486 bp, Homo sapiens
atttagacattcctttcctccattgccaaatacttaatttgagccaaattatttatccttccagtatggtgctaaatttatctaactatacttttaattttatgagggcaggggctcaaactcatatttattagtgtcttttatgacatgtaatatagtgagctgtatgggaaaaaattttgttaaagcttatattattaaggaaacaataaactaaataacttagcagaaggttgttaaatttccttctgtatttgttttatttatttattttaaaagcctctagtgggataaagcttcttttgagtatgttaagaataaagggattttgaacaaatggtcagaataatggtatgttaggcatctgtggctgaaaaataatatttctaagatatcatatgtcccaatgattctttattccttatatctgttgttcttaaatgtgtttctgcaataaaactgtttaagtattagagactggaataa

SEQ ID NO: 227886 - DNA, 535 bp, Homo sapiens
acattttaaaaatatagtcctggaacactatcatcatgaaactcttctagcttttggaagagattctaaactatttagagaacaaagaagcaacatcatagttgcttgacaggagaggcattactttaggactaaactgataagagagaaaatgcaatttaacagataaaatgacatacattggtaacaatgcctgactctgagtgtaacaaatactttgaaataatatcttcaaaaattgaaacaataaccagaaaacatcattttataaactgctgtgaaacaaaagcttcttatattctcctcttgcttccaaagagaaatagccataaatgtttcttaaaatagtgggaggtaggttatactggactgatgccgaatgtcagaaaatttacgcacccagctaatgaaagaaaacataaaacagcaagtcagcaagaaaatgtgactctaactttcaagaagtggaaaagcaaaacatcatgttgactgaacatgttatacttgaaaagcattaaaccatcattcacacaaa

SEQ ID NO: 227887 - DNA, 603 bp, Homo sapiens
ggggattgtttctggaatgcagtagataggtgtcaggtatgttactatttctataatgtacaagacagttccacacaatgaagagttgtcccttgtcacatacagcttttgaatgtccctgtagatattaatgttgatgaaaaacctgttataaattacttcagtgtttgtcatgttttaaatgattttttttttagtatagggtgtttcttctgttttttctttctttcatgactgacatttttgaagagtacaacctagttactttgcagatttccctcaaattgaatttatctggtgttttatcatgatttgattcagatttgatttttatgtaggaaagccacagaagtgatgtgcttttcatgcttgtcaggaggcacattatgttgatttgtctcaatacttgtaatgttaactcataccacttagttaaggtggtatctgctggtttgtgtgttttacatattaattaataagttaataaatattagggagagattctttgagactgtaaatatctctagtttaggatctagtgtttatacttgcctgaataatttattaataaaatagctttaatttggttattgaaaaaaattc

SEQ ID NO: 227888 - DNA, 450 bp, Homo sapiens
cttttttggttgtaagttttctagatctttctaatcatttttttaatctcactgccagaggaatgaactctgggcctagaagctaaatagtcaattctcattaaagcctctccggctacctctggtatattcttaaatcagatttgctgaaaactactggcccagagccaataacaactgtgaggcccaaagtaatcattggcttaaaattaaaaatcctcactggctctacatggaaaataataaaagttggttttgcttgacagttaccattatagttcatgtgactaatggttaaagagatttttagacccaaagtatatttctgtggactggacatcaaagaaacataggtaccatctacccaaaacatacccttttgtggctttatcataatactcaaaggttacaacggattgaaaattgtgtgagaatatgtgtcaaaatgga

SEQ ID NO: 227889 - DNA, 1241 bp, Homo sapiens
cgggctcctgagtctagccatctgccggtctcggcctcccaaagtggtgggattacaggcataagccatcatgcccagcctatacctttactttcatcattcccctgtggtttaaagctaggcccttctagcactatcttttgtctaactctttaaggaacattctggacttaattttttcttcccatctgtccttcaatatgacactggatagggggcttctgggcaattaaaatttatcagtataaatcatggttacatatttagttgttttagaatgttgtaattacataaacctgcagttttaaagttgaatatagctttatactttgataaacttcattttttgttttataaaatgagtttatacgggttgtcaacttactagcaaaatcttacaattgaagagactttaaaggacaagtactcccacatctcacccaagaacaaatgttccttccacacagtgtcttcctttagcagttagaacccactctcatgaaatagcatatttttctgtcagaacagttttacccagtgttacctttgttatatgtatggggactcactgactatcttgagatccagtcatcatgtggtattgtgagatccactatattctcaagtactagaaacctgatatattaattgatatgaagcctgaaaaaaagaatgactgtagcaattggattggtgatgagggaaactggcaaaagtgtggaagttaatagctgctgccattcacttacagctcctgggtgggtgatccaaagagttgttgaagctgagcaggttctggctgggcctaggtatggaagagagggagtcggttttagttggctttttttcatcattgtttttgtttggtgtttactacatgactttcactgtgctagggatacaaaaatgaataagaagagtatcttaaaaaggcagaattgttttttcctactggaattttgagcagtcttagtatttcctcagtgtgtttgttccaaaccagaagcattattgcttccttttatataggtagtatttaacttaaatattaaaccaggtaattaaaatcattgatctgtataagtcaaaaaggcttaggaaaatgtaaattattttctctctgtgatccaattcttgtgcttttttttcctttaatactttattctggaaggattttaataagtaatgaaagtactgttaatctttttttttgttttggatatggagcctgggctctgttg

SEQ ID NO: 227890 - DNA, 1042 bp, Homo sapiens
cgggctcctgagtctagccatctgccggtctcggcctcccaaagtggtgggattacaggcataagccatcatgcccagcctatacctttactttcatcattcccctgtggtttaaagctaggcccttctagcactatcttttgtctaactctttaaggaacattctggacttaattttttcttcccatctgtccttcaatatgacactggatagggggcttctgggcaattaaaatttatcagtataaatcatggttacatatttagttgttttagaatgttgtaattacataaacctgcagttttaaagttgaatatagctttatactttgataaacttcattttttgttttataaaatgagtttatacgggttgtcaacttactagcaaaatcttacaattgaagagactttaaaggacaagtactcccacatctcacccaagaacaaatgttccttccacacagtgtcttcctttagcagttagaacccactctcatgaaatagcatatttttctgtcagaacagttttacccagtgttacctttgttatatgtatggggactcactgactatcttgagatccagtcatcatgtggtattgtgagatccactatattctcaagtactagaaacctgatatattaattgatatgaagcctgaaaaaaagaatgactgtagcaattggattggtgatgagggaaactggcaaaagtgtggaagttaatagctgctgccattcacttacagctcctgggtgggtgatccaaagagttgttgaagctgagcaggttctggctgggcctaggtatggaagagagggagtcggttttagttggctttttttcatcattgtttttgtttggtgtttactacatgactttcactgtgccccacctgtgaggaactgggagatcctctgaacagaatagccaccaaagcctcccatctgctagagacattgctttgtaaacatcccaatatgaaaggagttgtgtgtagtgaagtagaaaggctgctcttccgctcaaatatcagctc

SEQ ID NO: 227891 - DNA, 927 bp, Homo sapiens
ggaaatgcaagacacatctcttctatccccagaccccagagactcaggctcagcatggtgagaaggctcatgagaggcaccagggaactgaggccctctaggagagaacagagtccagcctcatgcagagcacgcactgcttgggcagcttggctggcagaatcacctgtgcaattcatgcatatgcacacgtgttctctgcacaggtgtgtgcaacaaaatgtatgcgtgaaccacctgaaccaccctcagatctgcatcctcattaccctggtccagggcccgggccaaaggaggcttaagtaaatatttgttaaactgagctgtttattcatgatggccatgtctgagtttcagatccttcaacgagcagagtgtaccctgcacttctgttgtatttggcacagaaactagtgcagtgctgagcacaaagaaaatttttgctcattgaatcattgaatgaatacctgttagtagataaaccagctttgtggaggttaaataaaccagcattgtggagggctacacagccagtgagtcactggggcagattaatgtggaatttggccagtggaagatctatttcaacccctcatcaacttggagactttgaacctctatccaaatcataaaacagtcccttcactttaatgcttcagattcgtgagttaagacatatatgtgagcatgttggaaataacctaaagattcaccagtagacgagttgaataaagtatgacacagctgtacaaaatccagtatccagtatagatgatgttatagaagaataatgaaatgagccaggtgcagtggctcaaacacctgtaatcccagcactttgggaggctgaagtgggtggatcacttgaggccgggagttcgagaccggcctggccagcatgccgaaaccctgtctctactaaaaata

SEQ ID NO: 227892 - DNA, 374 bp, Homo sapiens
gcttattgttaagaagagtgtgtggcccaaccaggaaacagacattctaaaggcatagggtccacccaggagcatggtggacccagatccctgaaagatgggaggtgctcaggcacacttcctgggctagttgaggagtctggatatttatttatttatttatttatttatttattgagacagagtctcattctgtcacccaggctggagtgcagtggtgcaatctcagctcactgcaacctccacctcccggattgggttcaagtgattctcctacctcagcctcctgagtagctgggattacaggtgcccaccaccatgcctggctaattttcgtgtgtgtatgtattttgttgttgttgttgttgttgttg

SEQ ID NO: 227893 - DNA, 273 bp, Homo sapiens
ggagctaggaaaaaacggtgaaatactgatggccttgtccgagtaatttacaagtagaaatgagagggtcatggtcacttgcagtgtttatgaaaaacaaaaataccaaagatagtgggacaagtatacaactaactaaccctctcaccaactactatatatagttagatttgcggagctttctgggagggaaccctgtgggactgcaatggaaaggtcacggagaggaggtgagtgttaagcagagttttctcaggggttatgtaacaaaac

SEQ ID NO: 227894 - DNA, 238 bp, Homo sapiens
tcaattgattgttcagaaattggttacaatgctagaaaacacaatttaatttaaaagttaatcaaaggtctgtatatagaaattgctaccataaaaatagaggaagaaggtgtcttcaaatctaggaatctttatttacatttttagaggtatatatgtctatctggagaattcagtagcattcatcatacttatattgcttgacattagctattagcacttggaaaccattccccac

SEQ ID NO: 227895 - DNA, 265 bp, Homo sapiens
cctcaagaggaggcagtcacagagggaagtagaggccaggcagcctgcgaatgatcaatgtggtacagggctcctgtcccctctatggccacctctcaagttgttctttcctaggttctttattaaatgtgatagatttatccaaaacagttatgaattcagatcctaccaatctgatattacaagagctcacataggggaaggaatggagtttaacagtaatgttgacaaagaaaaataaagtttttaataaaaggtatcaaca

SEQ ID NO: 227896 - DNA, 712 bp, Homo sapiens
  misc_feature (645)..(645): n is a, c, g, or t
tcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaatcttcttccatacaatgtcatgctctacagtgatgctccagtgagtgaactgtccctcgagctgcttctgcttcaggttgtcttgccaagcattactcgaacagggacacacgaggcagtggctgaaggggctggtgcgagcgttgactgtgaccgccggatacttgctggatcttcattcctaanttattgggagaccaggaagaaaatgaaaacagtgcaaatcaacaagttaacaattatcagcaagctc

SEQ ID NO: 227897 - DNA, 470 bp, Homo sapiens
cttatctgttaccacttacaaagcttaaagaaaaacatcttcaaaacagctagagaagaatggcacactacatacagtagaataacaacagggatatatccatgcagtggaatagtgctcaacaaaacaggaacaaactattgattcgtgcaacagcatagattaatctcaatagcattatgctaagagaaatcatacaaaagcatacactttagattccatttatataaaattctagaaaatgtaaaataatctggagtgacagcagatcaatggttgtctgtggatgggaatggagggaaaatggattataaaactgaatgagaaaattttgggggttgatataaatatttgttatcctgaccatggtgatagtttctgaggtgtgtacatatgtgaaaattgatcaaattgtacactttatgtagctaattgtactttaattataacaataaagttattaaaatggg

SEQ ID NO: 227898 - DNA, 401 bp, Homo sapiens
catttctttcccctaatcccaggtacctcatgtgtatttgaagtctgaactcgacgccttcctcgcctttccttcaccagggtaagtgacccatgctacataaagatttcctaacaagtgctgccttccactgtcagatcacagttcataaccacagccggcaaagctgtgcgagccgcagcctctggaggcccgggaactgctctcagcccgtctggtttgtctttcagtgaagtgaaggctgggtcagctccaccacctcgacctggggaatgtgtttttgggaaaaccaagtaagagcgggagggagtggtacagcagcactcagccctctgggatttagttcaggtgcgtttgagctgaaaggattttgtttttcacctgtctgcatgttcttaaaa

SEQ ID NO: 227899 - DNA, 329 bp, Homo sapiens
tatgccatcccattatcagacctataaggactggtggaaagattagaaagtactaaggccagatgaatacccaattgatgtttgtctgtaataacatgtttcgctcatcaaaatgtccacactcaagacgacagttccacaaggtatcctcttacaatatttacaaactatttccacaacatccgttctcattgttttttataaagtgaaagaaaggcatcagaggctactctttttttctgaatcaaagaaatggttttacaggttcattaactactttctaaattatttggtaggggtattattatttccattcaatttctttactt

SEQ ID NO: 227900 - DNA, 621 bp, Homo sapiens
agagaagtagtgtattcagaaaacttactatctcttttcggctgggtgtggtgcctcacacctgtaatcccagcactttgggaggcctaggtgggcggatcacttgaggtcaggagttcaaggccagcctggccaacaggatgaaactttgtctctactaaaaatacaaaaattaggtggatgtggtggctgcacctgttgtcccagctactcaggaagctgaggtggggagactcacttgaacctgggaggcagaggttgcagtaggccaagattgcgccactgtactccagcctgggtgaaggagcaagactctgtctcaaaaaaaaaaaaactctcttttctgggttacctagtcagtaattccatgtaacttaaatagtcacctgccttattaacatagtatacagatctttcaaggatctaagttgacttcttggctccatattacattgttctgtatataaaatgactgagataatattagacaactggttcagggtggtgacttactttagtaattgttttagaagttgttttggaatacagttttatcctgttgtctgtgcacaatttgtagtgtaagcatgcactggcagtcctttcataccaacacatttg

SEQ ID NO: 227901 - DNA, 541 bp, Homo sapiens
gtctgatgcttttgttcacatgacatgttttctgagcacagctcatgcccaaagtaggaggatgtggtcaccctactgtgctggaaacaggacaagttttctgactgtggtcattgcatccgaaagagaatgctcagtacagcaccatctacaggcgtatttgtgagaacgtgtgactttcaaagataatcgctgaaagttcacttccttttcattttatttttttgtgggggagggatgtgtcgggttaaaaggtccatttcaaggccgggcgcggtggctcacgcctgtaatcccagcactttgggaggccgaggcgggcggatcacgaggtcaggagatcgagaccatcctggctaacacggtgaaacccggtctctactaaaaatacaaaaaaattagctgggcctggtggcgggggcctgtagtcccagctactcaggaggctgaggcaggagaatggcgtgaacccgggaggcggagcttgcagtgagccgagacagcgccactgcactccagcctgggcgacagcgagaccccg

SEQ ID NO: 227902 - DNA, 600 bp, Homo sapiens
tcacttttgcttcgtgtattttgaagctctgctgttaggcacataagcatttagatttttacgtcatattgattggtccgttagacaatgtgatataaacttctttatccctggctgcgttaagatctaccttaatattaatatagccaattcagctttcttttgattaatgttagcatgtaatatatatttctatcattttattttaatctatttggtttttcttatacttacagtatatttcttataaatagcatataattgggtcttgatcttttaatgcagtctgctcatttctgtcttttaactgggattttatagtgtttacatatattatttattatttatctgattggataaataaaaacaggatggaaaatagacaatcctaaccgtatcaataattacattcaatgtaattcaatgcagttagcattgaatgcaattatttaatgtaattgaataattattgccctttcctcttgtcctgtcttcttttgcattgagttatttttttgttttcatttaatctcatttgttgtcttattagctattactctttgctttgttattttagtggttgctttaggaattatagta

SEQ ID NO: 227903 - DNA, 402 bp, Homo sapiens
catagattgtggtgataatgtcacaaacatatacttatgtcaagttacatgcattaaatatgtacagctttttatatgtcaatcagacctcaaaaaagtgctttaaaaaatagttctgggtgttacctcaaaagaaaaataaaacctctactggaagtaagcaaacaacccaataaaaaatgagcagaacctgtcagcagacactttaccaaagacagtaagaggatgacaaataagcacatgaaaagaagttaaacttcattagtcagtagtgatttttttttgtttgtttgttttgagacagagtctcactctgtcgcccaggctggagtgcagtgagctgagatcgtgccattgcactccagcctgggcaacaagaacgaaactccatctcgacaaata

SEQ ID NO: 227904 - DNA, 325 bp, Homo sapiens
gatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaact

SEQ ID NO: 227905 - DNA, 580 bp, Homo sapiens
atttggcaccagttttattgagctagtttgttggccatgcctagctgagaaatagagaagtggagggagatggggggatgggagagcttttcctcatggcacactctgctccaggagtctgtatacaggagtgtggagaaaaggaagtgttaccttgcaggaagttgcccccaaagcaagggcaggaggtgggggtgggggacttggcctctgatggaattctggaattctgatgagagaggtgctagcctgacctgaacaggagatgctgacaggcagtgctgggcatgttgcacagagatggctggttacacagccccgtggcaggatcccagagtgccgagaccagctgggtcgtggagaccctaacccagtggcgctagaggaattaaagacacacacccagaaatacagggtgtggagtgggaaatcaggggtctcacagccttcagagctgagagcctcgaacagagatttacacacatatttattgacagcaagccagtgataagcattatttctatagattatagattaactaaaagcatttcttatgggaaataaagggatgtgccaaaat

SEQ ID NO: 227906 - DNA, 435 bp, Homo sapiens
ccccacaacccctgcccttttcccctgaagccgtccatacaatctaggaagaattgtctgaactttccctgaagcaggtcttgagatgcttatgtaagaagtcctctcctttgtagggacatggttgaagctggaaaccatcattctcagcaaactattgcaagaacaaaaagccaaacaccgcatgttctcactcataggtgggaattgaacaatgagaacacttggacacaggaaggggaatatcacacaccagggcctgtcatggggtggggggaggcgggagggaaagcattaagagatatacctaatgtaaatgatgagttaatgggtgcagcacaccaacatggcacatgtatacatatgtaacaaacctgcacgttgtgcacatgtaccctagaacttaaagtataatttaaaaaaataataaaatta

SEQ ID NO: 227907 - DNA, 419 bp, Homo sapiens
gagccgagattgcaccattgcactccagcctgggcgacagagtaagactctgtctcaaaaaagaaaaaaaaaaaagcacacatgaacatgtattccctcacattggagctcacttcaccaccacagataataagcataaatttagagttgtctcttttaagtctgtgtcctacatcctgcaggagagctctctatggcaagggttgtcttttgcaagtcatttatattctagtagcaccagcggtagttctgcactcaaacctcctgcagtggctcttccccctcatgccaagttcatgactgcatctagagttcatgtgtttgccccagtgaggaacactagccatggtccaggtcctgagagccaagcctcacagaatccttggcaacaaagaattccaccactaccccttggaccc

SEQ ID NO: 227908 - DNA, 823 bp, Homo sapiens
agaaactatgtagtgaaattacatagtgatttttcattctcgcagtaaaaatttcctgggattttttttttttaatgggtgggaaactacctggaaatagtggatgccagagtcttaaacagaaggaatgaaataataaagatcagagcagaaataaatgaaatagaggccaggaatacaacagaaaagttcaacaaaacagagttggtttttgaaaaggtaaacaaaattgacagacctttagttggactaaccaagagaaaaaaaagtcaaaatacatgaaggagacattacaactgataccatagaaataataagatcataaaagactactctgagtaaatatatgccaaaaaattgaacaaactagaagaaatggataaattcctaaaacatacaacctatcaggaccacatcatgaaggaacagaaagtctgaacagacctataatgagtgaggagattgaatcactaagtcaaaacctcccaacaaatagaagcccaagagcagacagcttcacgggcaaattcctctgaacatctaaagacgaattaccaccaacccttctcaaacttccaaaaaactgagcaggagagaacacttcccagattcattttatgaggccagcattacccttaaccaaagccagataaggacattgtaagaaaataaagttacaggccaatatccttgatgaacagatgcaaaaatcctcaacaaaatactagcaaactgaattgaatagcacattaaaaggagcgtacaccatgatcaagtgagatttttcctctgaatgtaaaaatggttcaacatatgcaaatca

SEQ ID NO: 227909 - DNA, 440 bp, Homo sapiens
aacaaacaactctggacacaccacctttaagagctgtgacaatcacttgcgaaagtctgcaacttcactcctgaagtcagcaagaccgtgaacccaccagaaggaagaaactcgggacacatctgaatatctgaaggagaaaacactccagacacaccgtccttaagaactgtaacactcactgcgagggtcagcggcttcattcttgaagtcagtgagaccaagaacccaccggaaggaaccaattctggagacaattggagctttgaaaactatttaactaaattatagtgggttcagtataaaagattgttttcttccctcccttctctttttttttttccttattcctatcctgctatagtattttctgccatgttatgcacgtacatttaaaaaattactcaccaatccaataaaaaacatactgctgccttatt

SEQ ID NO: 227910 - DNA, 108 bp, Homo sapiens
gccatcacaaaaaaaaccaatggccagtcagggttcactagaggagcagcaacatccaagagaggatcacaatgaaaaagcaagaaatgcctatcctttttatttctt

SEQ ID NO: 227911 - DNA, 257 bp, Homo sapiens
caggttcagacatttggtgtatgtgcttggctgaggagccaatggggcgaagctaccatctgtgggattatgactgaacgcctctaagtcagaatcccgcccaggcggaacgatacggcagcgccgcggagcctcggttggcctcggatagccggtcccccgcctgtccccgccggcgggccgcccccccctccacgcgccccgcgcgcgcgggagggcgcgtgccccgccgcgcgccgggaccggggtccggtgcg

SEQ ID NO: 227912 - DNA, 401 bp, Homo sapiens
ggagccattcctccaacaccctcccaacagtcttagcaggaaaaagcagcccatgagctgtccctttcatactgtaggtctgtggtccaattagcttgcttcagattaattcagttaaaacacctcaagctgaatctgtcgaatgtcttttttttttttccatgggccagatttattttgttaataggatcaacatatattatatacaaaggtaaccattaaataattataaacaaataatttcatgacatattcccagccaattttgcatctcctgccagatacaaaacatttacttttcataaatttacagtgagcaatttgataaaaccagtgaaagtggggatattttcaaagcagctgcttatgtgatgtgattagcaaaatctcccctccccacc

SEQ ID NO: 227913 - DNA, 443 bp, Homo sapiens
ataggtgattctgagatgaggaaacctgaacagctattacataatgtgcagcctcactggtagtcaggaaaatgcaaatggaaacaggtgtcatctcacactcagcagattgacaaaacattttggagtctgacatcaaggatatgaagcagtgggaactctcaggcactgctgatggggatataaattgacagaactattttggacgaaatttggtgctgtgtagtgaagttggagataattatatgctgctgtccagcaatcctgcatctatgagaattgttacacacctgcaaaaggggacatgggcccgggtccttgaggcagcattgtttgcaagggcaaataccaggaaattgcctgaacatttcaaatgttagtaatgttataaataaataatgtctttgtactaggtagcaattaaaataaaggatatttatagt

SEQ ID NO: 227914 - DNA, 118 bp, Homo sapiens
gggcaggagccaagtcgtctgggcctgagtctgccaggggacttgaggctggacttgcttccaacttttcatctgttgggggagaagtagtcccaggaatacaaaggtcaagccctga

SEQ ID NO: 227915 - DNA, 452 bp, Homo sapiens
attttcataaaggtcaactaagaaatgtgacaaggtttgtgaactataaagcactaaacataactgtgcatccctacattttaggagttacaaaacaaagaaaaacagttaacaccactccaccaaatgaatagaggaaatttagtaaagatgtcaacctctctgtattggaagaagctccttgttgcttgtcttgaccctgcctcccatcgctgaggagtctagttcacctctaagccaagtaggatgagagtatatttggtgtctgagctcatttttgaatctacttcatttgtgttaccacacattattcattccccctgttcaactatctactaagacatttaaactggccaagaaacatctatctagcaaaattttggctgagagtgttcctccaaatagaataatctatttctaaattaaaccagattagcaaaaatgtgaaaaaa

SEQ ID NO: 227916 - DNA, 283 bp, Homo sapiens
  misc_feature (240)..(241): n is a, c, g, or t
  misc_feature (271)..(271): n is a, c, g, or t
ctacacattttacccaggccatctttattttctcttctcagcctccctgaggggggactattacctccagtactggggctgacacacatgagcaatgaggccaggtggggttgtccatagacaccttctgcaaaggccaatgttggtgctggcaaaaagaaatgaagtgtctagcagtgagctggagattggatcacagccgaaggagtaaaggtgctgcaatgatgttagctgtggccnntgtggatttttcgcaagaacattaataaantaaaaacttcaa

SEQ ID NO: 227917 - DNA, 554 bp, Homo sapiens
ccactcagttaatagtccactgttttggcagccctaacaaaccaataaaatgagttacctggtgatcacatgaaacgtcagctgtgatgacaaaaaggtgcccttaagaacacaaaacaactggggtccaccatgtggaagcagaagcctgcaaggagtgaaactgcaggaaaggaagaaatgcccagtagaagagaggccccaggtgctcgctctggcagtacatatactaaaattggaacgatacagagaaaattagcatggcccctgtgcaaggatgacacacaaatttgtgaagcgttccctatttttaaaagttaaaaaaaaaattttttaaaagacaggaggtcccaggaagccctgctgcctctctgcccaccctctccaggccaaccctgctaccaggaagaaattcacagggccaaattactcagtcatgtgtattgaggccagaaatgcattatttaattttttgcagcagatgtacctttttaatactgttttgtttcaggctaaaattacaatattaaaatttaatattcaaacattagcat

SEQ ID NO: 227918 - DNA, 405 bp, Homo sapiens
aaatgttaaaatggaacaatacaggaaaattaggcattattcattatatatatggaaaacttaattttacatttgagattttagaggaatatggattatcgaattgaatatacattaacattcaaattctattacaaaacaataccataaggaaaattatcctgtgacagaaatgcttctcattctgtagctgataccctctctattgtatatgaataatttctgtgtagcacaatttctgtataataaatgtagttattttttatgtatatgttaacatttgacttgtatttatcccagctacacccttcaccttaggggtttgcagggaatgacaaatcaaacatgtttttgtttgtttgtgcagaaatgttttgttctcctaataaaatgaattattgttta

SEQ ID NO: 227919 - DNA, 499 bp, Homo sapiens
cagaaggatgatgggaaggcacatgcgagagctgatgccaacagcctagaagggcatatatacatcttgttgtagaaggtgctgctgagggcatttatcaaatatttagaaagtgacttcctttacagaagtcacctggggttcaaaaatgaaagtaaaataatctggcaattgtgaaagctttctgaaaatctttctcctccaaagtcctaaggaaatttaaaccaatcatgcccatggtcagatgaacagattttaagtaaatctaagaacatcccttattattttttattttgtttactagaacatatttaaacgaactgagagtccagagaaagtaggttattatagaaaacatttcccttcgcccttaaaatcactggatttgggttattcactttgaagttctactatgatccagtttcccatcaaaagggaagcacttttagccactgaaatctaagaggactttcttcaatggcacccagcagaaaaggaa

SEQ ID NO: 227920 - DNA, 403 bp, Homo sapiens
tttatatcttctgccaaacatacttttcaaacgttgagtcacctcatgtcacttctccactcaaaaccctcgaatggcttcccatcccttctaagtgaaaaaaccagagccttaattaagacctacaaggccctgtatgatctgtccttctttttggacctgtctttgagtgctttccacattctttgttttctccagtcaccttggtgtgcttgtcaaacacccccaagcactcttagtcttccgatcctttatactagcagtcctgcctggtatattcttccctagatattcaagtgacacataccttcacttcatttaggtccctgttcaaacactgtcttatcaaagaggccatctttgacccctgcaaataaaagaggattttctttctttctctttt

SEQ ID NO: 227921 - DNA, 824 bp, Homo sapiens
agttgtccgggtgttgggaaccctgagggggcggtcttgggagcctgtgcctgggaaggatatttggaggcaggggcccagcagcgggagctgagtccggtccggcatggcgtgtccaggggacttttcgggactgagtgaggggcgccaggcggggaggctcaaggccctccgccggtttttacctattttctttctttcttttttgccttccgcagggaggcagaatctgggtaatggaagggagaatgggctcgctatctgcccagagcttccctggactgcaggaacccgtcctataagcaaccccgaaacttcggggcccgaggaccagggaagaccccctttccttgctgtcttgacagggttgcagaagccaaggagttcggcagggagacggggctcctggggtggttaaggacgcggtgaccacccctgggcgggagctgactcccgcgggcccggaggctctagctcactctacagcaaatgcttttgttcccggaggctgccctgggggaaagacgccccttacccctgccttcgaccctggagagcccagtgcccgcccgggcagggctggagcccgagtcgccccaggcagagtccgccgaggcctggggtgggagccgcgacttctggatctgcctccgagctcagctagaagactgcgcgcacctcgtccggcgccgtccggcgcgcagaagcgggtctaatgtttataacgttaataatgacagttagggagggctgtggagccgggaaccaagacctcatcccgccgccgcccacgtctttgatcattaaagaaacagacaactaat

SEQ ID NO: 227922 - DNA, 397 bp, Homo sapiens
ttttggagcacttagtagtttccaggatcttccaggcttggcaaggaatgaggtatgaccacaatcccagttctggccgatggtatgtaggcagagccaatggaggcaaacagcctctcctttcccttctttccttcttgccacctgggatgaggatgtgaaggtgaatcttcagggaccatgcagagcgggcaacacgctggagatggcagctgagtgagaagatcaaaggagcctggttcggacagttgacatcaagattgacacatgagaaacaagatggactttgaaggaagacaaccacaacaactcatagattacacagtaaagatgcatttaagccagcatctctcagaataattccctaataaaaaaagtacttgttcataaaaaaaaa

SEQ ID NO: 227923 - DNA, 340 bp, Homo sapiens
caccataaatgttcctttatttttaatttcaatttttttttgttagcaactactgtgtgccaggtgctttatgtactaagttattcatttattcttcacacaagcctatgaagcgaggagtgtcttctccattttcagatgaggtgacaagagctttggtgacagcacgggcacaaagcaggtaagtgactaagccagagttccacacacaaagctgcctcccagagctgcctcccaggggcttttctttatcttccctttagtgctaggccaagagattccagcaaagagctgaaactaagtatgagttgcacactgagtacatgggtgagctctgaca

SEQ ID NO: 227924 - DNA, 464 bp, Homo sapiens
atgagtgtccaggggcagcctctgaaccctccttgtcttgatcttggccctcttacctgctgtgtgatctttctggactcttgctaattttctgaatctgatcctccaggcttccagttaattctgtgaactatctaatactttgacaacaaatgcctttcctgattaagttagagtccatttctgttgtttgcagtcagtcagtactacaataagtaagaatttgtgctctttgccactatgtataacatttattttgagaacagtaggtagatggtaaagtgaaaatgaatccagacgaagactctagatacgtaagtgtgatatagatctttctgaacttgctcatcacaaaagggacatcacttaataagggaaaaatttaaattaccagctaacattttattaagtactgtaatagtttcctacagctgctgtaaaaaattattaaaaacttggtggct

SEQ ID NO: 227925 - DNA, 208 bp, Homo sapiens
cattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaat

SEQ ID NO: 227926 - DNA, 389 bp, Homo sapiens
aattaatgataattaccgtgtcccccccacccccaatttataaacagccaataaaaactcattttggtgagtttgatatactgttcataaaatctgatggctgggcacggtggttcacacctgtaatcccagcactttgggaggcccaggtgggtggatcacaaggtcaagagatcgagaccatcctggccaacatgggaaaaccctgtctctactgaaaatacaaaaattagctgggcatggtggtacgcagctgtagttccagctactcgggagactgaggcaagagaatagcttgaacccgggagacagaggttgcagtgagccgagattgcaccactgcactccagcctggtgacagagcgagactgtgtctcaaaaaaaaaaaa

SEQ ID NO: 227927 - DNA, 477 bp, Homo sapiens
gaggatgacctaagaaggtgacctggagtcagcactgagccttctggttggaaaacagtctagggcccatccctttgctatctttaaagcctcaactcactccccctgtatttattggcttgctctgagctgtgcttgactggacgccagtctctaggacccaagaatttaggattccttgtggaacatcgtcagtggaaggggccaggaggatcttagcaagaggaacagtgaaccaccttccccataagcccaaatcactttcttgtgtaaaaatagagaatggctgctgcttaaatgtctaataaagaaacaaacattgtcatacccctatttctctgtcacatgaccatattgagttgctacaataaggtactgtccacaaaaaaaaagtagtactgaaagtcaaagttctgggcagctttgtttaagatattttttaaagcgagtccttttatactatctgggctcttatac

SEQ ID NO: 227928 - DNA, 1529 bp, Homo sapiens
  misc_feature (1166)..(1166): n is a, c, g, or t
aattagttgaaagttgcccttgccagttacatataattggtgacttttaagttatttgtcacctggaacagacataacttctttagcatacaattcagatacaactgtcattgaatttatgtttccataaaattggtggtagaatttttagcattaggtaggagaagaggacagggaaagacagctgtgtctcaggcactgtactgttttacctattttgttaaatcctcacagcaaccctgtaggtaggtgttaactgaagcagagaggttagataacttgctcagtgttacacactgatgataaatgacagagcaagaattcaaactgtaatgtttcggttcttgttatcttttattcatcgcctttattgtttcttttctttctttctttctttctttttttttttttcttttgagatggagtcttgctcttgtcgcccaggctggagtgcaatggcatgatctctgctcactgtaacctccgactcctgggttcaagctattctcctgcctcagcctcccaagttgctgggattacaggcgtctgccagcacgcctggctaatttttgtatttttagtagagacagggtttcgccatgttggccaggctggtctcaaactcctgacctcgtgatctgcctgcctcggcctcccaaagtgctgagattacaggtgtgagccaccgtgcctggccctccttgctttattttatgattccattcagtcattagtcttgtcggtttttaaaaaaaggttttattgagatatgattcacatactatacagttcactcattaaaagtatacaattcagcttttagtatattcagagttgtgcaaccatcaccacaatatcagaattttttttttttttgagacggagtctcgctgtgtcaccagggtggagtgcagtggcaaaatcttggctgactgcaacctctgcctcccaggtttaagtgattctcctgcctcagcctccgcagtagctgggactacagaagcttgccaccatgcccggctaattttttgtatttttagtagagacggggtttcaccatgttggccaggatggtcttgatctcttgacctcgcgagccaccgcacccagccatattggaacactttaatcacctcccaaagcaatgccatactcattagttgtcncccctaacctcccctctccgtgtcctaggaaacctccttttcttccaaaaattttagcacgtattttcatatgttagtgtgtagatcaattcaaataatagatacaacaaatactgtaatatgttgtgtaccttgtaattattccagctgtattgcagaaatattttataaatttaatagggctgggcagttttttttggaaatgcttgatcatttgcaagtactacatgctcttgaataatatattttcatttttagaaacatttagaatatttagtgtacaacccctgtctcccagtaattctgctgcccaaggaaatcagttactttattttttcttttcatttcttagctatagtcttt

SEQ ID NO: 227929 - DNA, 400 bp, Homo sapiens
tggggacagctgttctagaggacaaatggtagtcatataaaaaagtttttaaagtatacatgttttggatccatttatttgaccaacagaaatttatgttaagaaagtaatttaggatcaatgtgaagaattgactaagaatttttcatctagttatcacttatgaaaaattgaaaacaacccaaatgtccaaaaatatgggattagttaaattatgtccataaaatggaatattgccattctaaattatattatggtatggtatttattgatacagaactatatttattatatttaatttaaaaagcagtttgcaaaagaatgtatccaatatatgatccagtttcttaaaaataaatacaaataaagtagaaaaacaacaaaatgtaaaaatacatat

SEQ ID NO: 227930 - DNA, 637 bp, Homo sapiens
ttccacctgaggaatattaagcttgcacagttaagtgatttaacaaagatcccaaaaatagatagtggcagcacacaccaggctaaagaaatttattaaaagttattgctatgtgaggaattgtataactgatttttttaatgaaggcatagtttgaagttgaattggagcactgtcactgtacttggaaaccaatgaaggcaaggaccatatttttgggagggactttattctccagctcagcacattgttgagtagaagaccctaaaatacaccatacatgaaaactctatctgtcatgtgcccatgagatattatttttttttaagtcactttctaaaacagttgagatttggggatttgctgatttactattttcacctgagtgatactagtttttcacatagtatatttttccagtaaagagaaagaaaatacctctaagtcttggctgctctttctattacaaggaaaggaattgggtttccataaataacttaagaattaggataatttcaatttatttgtacatacctttgtaatatgatttctcaatttaaatattattttcagtactatagaatgtgcttcctactattcaaaactcaacttgttttaataaaggagtattgctaga

SEQ ID NO: 227931 - DNA, 395 bp, Homo sapiens
ggttgaaacagggtcttgctctgttgaccaggctggtctcaaactcctggcctcaagcaatccttccacctggacctcccaaagtgttgggattacagacatgggccatcttgctgagccccgaattacttttgattcaaaaactaataactgtaacaagggcaatgcaaaaatgaaattaactcagagcctgataattgacaacagtgccttcctgtgaacgtggtcaatgactataaagtcagtacacaactcctttaagatgtttatctcttcaggaaacaaagatgaactgagggatgaagccatcagttattgctcccatacctaaaacagtcaagcgaattactaccaaatatttgaagtggcttaataaatatcaatactgaaattaa

SEQ ID NO: 227932 - DNA, 427 bp, Homo sapiens
agagagagaagaaacaaatcagcaagagtaggctgcaatctgttctgtatattcaaggaacccttacatgaagaaacagtgttgttcctacatctgagctgtcttataaacatagcttgtgcttttgcttaaaataaaactgttaaaataggaaagtcaaatacttgctcaattaacctgctgattagtgatcgacatcatgtcaggtaagagagtatttagtcatgccaaactgtcctccagaaagtttgaacagatgcacactccttgcagcagtacacaaaattgtctgtttcccatgccactgccaactcccagcattggcatagttgaacatttgtggattgcatgaatgaaataaatttacatgtataaatatgcattttatttacaataaaattttacattaaaataactgtacaatcat

SEQ ID NO: 227933 - DNA, 484 bp, Homo sapiens
agagtgacaggagaactgggagcgagtccaatcatttacattatttagggccttgtgtgtaggccatgccgaagagtttgaattttattctaattgctatgaaagacgtttagtagctttcaaactggagagtgagataagcttatttatgatcactcttcgctgctgcataaagaacaaactgctggaggccagagtacagatggggaaactatatgtaatcaaacctcttagccctactcatcccaggcaggaattccaatttaaatcactgcctttggcaacagaaataaatggcatactgccaaaattatcatggctaaacagaatttttatatattcaaagcactggtctatgcctgattattcatgtaagaacacatgggtattttcctcgaaaacaatgtggcaatccacaaatgaatatattatcaaagttatacatgcataaggtttcaaaataaaataaaatcaaagccttcta

SEQ ID NO: 227934 - DNA, 605 bp, Homo sapiens
tccacatgtaactgatttatcattttcttagacctcttcatttccgtcatcgacgttgaggatattgtttaggaggctgctttttaatgcccccaggtttagttgctccccaatatttaacagcagaggtggtgtcaaggctccactgagacagggatgctgaacctcagttcgctacctggctaaacacctcacccttcacatcagagcatgtcggtgggtgggagtctcaccaagggacacgttctcccatgccctgggttgtaaggatgctcttacatgagagacattaaatttgaggttgctaacataagttccatacaatgcaaccaggcctgttcagtgggtggtcagcaaatacatattaactgtcagagtgagtgaatgttcacctatttttatcttatttttgtactgtcatggaaaacaaatgtttatcctataaaacaattgtccacacatcgttgcttaaagaaatgcttcccctaagctattatgccaaattggtactgaacaaataaattttaaaatggttattttcaaaatcgtaactttgccttgtgttgcagaaaaatataactatttagataaaaataatttctaaa

SEQ ID NO: 227935 - DNA, 508 bp, Homo sapiens
gagggcacggcaggatggcctagggaggacgggcgagggcctatcagttacaagaggaaggagaaagaggatactggttttcctctgcataaaaaacgcgatggattctcaagaatttattgaaagtctgtgtgtccaccatagtccaggatattttggaatattcaagggaaatacaaatccaagaatttagctcaggaatcagcatcagaacagaatccccgaagagtaaactattcatggaaaacagtagactgataacatttgaaaaactgatttcccatagaaacaatagttactgtttgacgaattatacaacgtagacctaggtcgtgcgatagctacaaaatacctaaggaaatggactaggtcgtaacaagaaaaagtgatatcaagcccgggcagaagggcgcattctcggcgcggagggcggagcctttcctggagtggcggcggatgacccgggctcccgctcctcacctcggcgtggggcgcaggcggcggccgc

SEQ ID NO: 227936 - DNA, 172 bp, Homo sapiens
ggcacagagtttcttttggggaagattaaaaagttctggaaatagatggtagtgatggttgcacaacaatttgaatttaattaataccacagaactacatacttaataatggttacaaggataaattttatgtttatatattttttaaaacaataaacaagaaaatccaata

SEQ ID NO: 227937 - DNA, 515 bp, Homo sapiens
agctcagatggcccccaagagcccccagctcctgttcactgctcttccagttagtgacccccgtgtcagcatcattgtcagagttcctgggcttgtgggggctggagaagggaaggcgctgaggagggaaagatgagtgcaggttttgttgaaaccacccgacccgcgttttcagggggacgaggccactgccttggcccaaggacctgcaggcttgggggaccccctcgatgtccactgggctgcggatgaaacatcacactgtggtaggaaaggaaggggagcacccccagacgggggggtcctgcagagaccccaaccccttacctacctagttgagacacccatggggagcagccccaacagcatgtcggagtccctaggcttgcggggtcatgctctgttgagggcccttcctctaactggcgagcttgtttacagctgagctcgcctggtcagatgggcccagtggctttatctaataaaggctggacatgtccacttcatgagcatcc

SEQ ID NO: 227938 - DNA, 434 bp, Homo sapiens
actcagttcccttctcctcagattgaagataatggcttggttttggtataggttttttatcccccataaatttaatagtgtatgacaaaaattaagtgattatatgacaggtccagtttgctttctcttgttttcttttctccactgcttcagtcagcataaagttagtcgttctgaggttcagtcagttctagtccatttgccaatgatcccgaggctccttttatggtctgaaaagcgatattcatatctggaaagcatccagatcataatgatactctagctcatgtttgtcagacatagctacaaaaacagactataaaatattaaaagtaacagaattatttttctataccctcaaaagaacttaacaaaaaccaacggaattcttagacttgtatgaccaaaaccatattacgatatatgattataat

SEQ ID NO: 227939 - DNA, 747 bp, Homo sapiens
acatgcatttcctgtttattgtgggccagtactcttcaaatattttacctatttaatcctcataatgattttgtaggtcagtattaatatcatccccatcttaaagatgaggaaattgggacacagaaaggttaagtaagttgccagagtcacctagcagaacttccctttggagtagactattgtttaccaaaagtgacctgatagaagccaaggactcttccctcctttcctcaattttacttccaactcaccaactacattacacagcactctgtatttcttttgcattacatggtgtggttccttttgggaggagtggggaagaggtaatagtacactagaaagggtgagagctttgtggaattatcttttagcaaggaatagcttaactgatagccgaactgcaggcaaagggaggataaaagcacagaagaaacataatggtcatcaaattataattaacatcaactattttctgccttgaataaacaataaaagcctatttccacatattactgcaaaacctcaccaatttagattgctacagggaaggcttcggagaaagtatgctaaagggtaggttatggaaggtccgaccattaaaaatctgaattacatctcattttaagagaaatgctatttcattcaagtacagaatacacaataacacaattggaaactaagtcaatagttaaggattttttaaagatatgtactttataataagtctgcaattcattcatt

SEQ ID NO: 227940 - DNA, 498 bp, Homo sapiens
tcatcacgtacttattttgatgataattcagagttactatactgggatttaactaaacgtaacttttgtaggagtcacctatgaaatagacttgtgaacaaatggataatgttttctgcttacatagagcctttaaaaacagaaaatagaaccccagctctttgtgcccctccctttcttaccacagaaacataatggtcatcaaattataattaacatcaactattttctgccttgaataaacaataaaagcctatttccacatattactgcaaaacctcaccaatttagattgctacagggaaggcttcggagaaagtatgctaaagggtaggttatggaaggtccgaccattaaaaatctgaattacatctcattttaagagaaatgctatttcattcaagtacagaatacacaataacacaattggaaactaagtcaatagttaaggattttttaaagatatgtactttataataagtctgcaattcattcatt

SEQ ID NO: 227941 - DNA, 1591 bp, Homo sapiens
gtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaaaaggaaaatcagtaattttgcagtggagacatatggccaactccaccttacccaagtggctgaaagtcactgcaccagtaatggcacaaaccaatgtgagatgattcctgatatgatacactaaaaagggcactgtctcttctgcatgttgcagacaaaaagtgggtaagctgaaactgaaactaataattaggcaatgtcaagcaaatacaaattcaggttgacagtctgcaaaataacatccatgtactcttcaacaatggatcgaccctagctactcaggaggctgaggtggaataattgtttgaggccaggagttccagatcagcctgggcaacatcatgcgaccccatctctaaaaacatctttttaaaaatgagccaggtgtggtagcatgcacccgtagtctcagctactcaggacctgaggcaggaggatggtttcaacataggagatcgaggctgctgtgagctatgatctgctactgcactccagcctgggtgacacagcaagttcctgtttccaaacaacaacaagaaaacaaaacaaaacaaaacaaaaaatagatagaatagtgacaataaaaatggagaaaaagtaggctgactcaggaaatgcttagaaagtacagccatacctcaaagatattgtagatttgattcgagaccaccacaataaagcagatattgctacaaagtgagtcacacaaattgttttgtttccttgtgaatatgaagttatattggctgggtgtgatggctcatgcctataatcccagtactttaggagacggaggcgggagggtcacttgagcccaggaattgtgagatcaacctgggcatatagggagatcctgtctctatttaaaaaaagaagctatgtttacactacactatagtctatttaaagtgtgaaatggcgttatgtccttaattttaaaactcttgatgctggctgggttcggtggctcatgcctgtaatcccatcactttgggaggccaagacaggttgattacttgaattcaggagttcaagaccagcctggacaacatggcaaaacacgtctttaaaaaaagaaaagaaaaa

SEQ ID NO: 227942 - DNA, 706 bp, Homo sapiens
cttctctctccttgtcaggtacaagagaactctgcatttgtcttctgcccacaacttcgttgaagaagtggagaggccaagcaactccaaggctgtttggaaggagagctgggctctgcctcctgggagagttggaggacatttcttctctgtggagtgtgaagggaggactgccctattccttgtctgctagtgcttgcccctgggagccagtgcatcttatcccttttaattctcgctggctcccaggggcacgtattaccatcccattttacggatgcagaaactgaggcactgagaagaatgatttcagaccatacagtcttccaagtggcaaagcctgggcttgaaccaggtctcctgacctacaacttggcagagagagggacaaccaccatgtccccttgtccgtggctgcatccagtgccgatttaactcagcacttccgggaagcccctttctcaccctggccccaggctcgttcctggggaagattcagtgattgggtcttactgaaggggctcttgagtgctgagagctccacgagaggaagaagatgcctgggtgctgagtaaggaaactgacatggaacacctgccttccaccaggcagggctgctgggaacaccgtgggcattttctcacttcattttcacaatgaccctacgagcaaaccatgggtgcagcaggaagacatgacacgggac

SEQ ID NO: 227943 - DNA, 701 bp, Homo sapiens
cttctctctccttgtcaggtacaagagaactctgcatttgtcttctgcccacaacttcgttgaagaagtggagaggccaagcaactccaaggctgtttggaaggagagctgggctctgcctcctgggagagttggaggacatttcttctctgtggagtgtgaagggaggactgccctattccttgtctgctagtgcttgcccctgggagccagtgcatcttatcccttttaattctcgctggctcccaggggcacgtattaccatcccattttacgggtgaggagactgagtttcagagagttgttcctgtatagctgtaaatatgggaggccgaataggatgggttacatcacctgcaactagttttatggccaacaggaattcattttcctggttcttgcaaagcggtggataaggctgggaattaggatgccctccttctactctagtcatgccagtttggcctctgctctataaacagcccttgttcttttctgtctcctagattctctcacatagcttccccaacttggaatgccactctccctcccaccagttcaactcctgcatacctgaaaggcccagctaacctcttcccacaggaaccttccctgcccactctagctcttggccatctctccctactctaactctaacaattgcattctgtgccataaaatcaaactcttcatgacagtac

SEQ ID NO: 227944 - DNA, 370 bp, Homo sapiens
agaaagtttggctcccatttctcactctcacaccgaccaggactgtaataatcaatgacttgttgaaggccttgttgccttgctaccctgagtcctcagtgcctagagatgttgtttgatatttgatgaatgaacaaatcctatttcagagaatcccaggaagtcagagatggaagggaactagtattttaatgacatattttctggttataaaacttggagaattcatacattggaaaattacaaaactgttaaggaggatgaggagggcattcaccatgtagtgatggggaataatcactaagacaaaagagcaaggtgcagaatagaatatgctgccatttgcctatatatatgtgtgtgtgtgtgt

SEQ ID NO: 227945 - DNA, 301 bp, Homo sapiens
ggggggccacagtgagtgaagcgaactgagatcctggaagtctcactgtggagaaagcagtaattttatcagagaaggcccacaggtgtggaaaacactaaaggaaagaaatctacctcttgacacaagcagctgtgactccaaaagaatgggccatgtgaagttctggctccccatttgccttctgccatgactgtaagtttcctgaggcctccccagaagacaagcagattgccagcatcatgcttcctgtacagcttgtggaagtgtgaaccaattaaactctttttctttgtaaatt

SEQ ID NO: 227946 - DNA, 229 bp, Homo sapiens
cttcactgcacctggcctaaaaatccacgtgtaaaggtctcaaagttatgtgcatgccatggaaaatattcttaatttcctgtcacgtgtctgctacaaacccatcaaattcctacggcttggggcccagagagatggtagtcacacaccttgcagaattcctgaatctgaaagctgccccttttttttctgagacaaggtctcgcttcatcacccaggctggagtgca

SEQ ID NO: 227947 - DNA, 515 bp, Homo sapiens
ggaagactgtgtggttttctcaacactgtcctgatggagccctgaccagcaagcgtgcaatgcccctagccctaatgtgccattaatgataggttaatgtacagtataatgtttttgggactacgggttcattacacttctgagtgtgaggtctttccacagagcgcccaaggtcccattgcattatatcatgcaataaaaatacccttttcgtatcacacactaataaactgtatttgaaatgctgtctgagggcactgccatcttgtctataggctgtgcacaagtgcaacagttgggattccttttttctattttgtggtttagttacatggaattctaaacccagaagtctgctcattcttgttttaaatggggagcaagttgggtctttagggctgaggctcagaggaggggctgcttactgagtggtgagggtctttaagatgtggagagcagcctttaattctctactgcagctgtcaggagagccagtcacataaaaacaaacaaac

SEQ ID NO: 227948 - DNA, 257 bp, Homo sapiens
aggctggtccttgaactcctagcctcaagcagtcctcccactttgacctcccaaagcactgtgattacaggaatgggccattttttccagcctttagctatgtttctgtagctagactcttacaaagcttccaaatttgaggtcaagttgttttaataactcctgaattaaaagtaatacatggtcgggcatggtggctcatacctataaactcagcactttgggaggccaaggtgggcggatcacctgaggtcagg

SEQ ID NO: 227949 - DNA, 634 bp, Homo sapiens
tctactcttttctctaaccttatttttttctcttagccgtatatcctggcgatcaatccatagtcctatgtaaagatatttaatatttcttatttctaggactatgaactatttttgtatcttctacactaatctgagctgggcacattaggcatgtaataaatactttttgaaagtgaatgaatagtaatttaaaatagttgatgactaatgcacttgttacagtcttaaaatatattttaaacaaataaataattgtctaattccactttcagaagaaataagaagttcttattcctgtttgtaatttttttttatcatttggtaattttgaaatatttaggtttagcaaaaaattaataggctcaggttttaaaaagaaaatgccttctgcttatgactgttatggtatagaattttgtgtcaatgtagagctccttcagtatgtgtaatttggcacacaacccctttagttcgtcagcatttggcacatcggggatacctaacaaattgtaggtaaatttgtttatttatttattttttcccttaggtaaatttatttgcagttctgcctttgtgtatagagtagagctctttacatagtattatttaaagtgtaattgcttgactaagg

SEQ ID NO: 227950 - DNA, 639 bp, Homo sapiens
  misc_feature (577)..(577): n is a, c, g, or t
tctactcttttctctaaccttatttttttctcttagccgtatatcctggcgatcaatccatagtcctatgtaaagatatttaatatttcttatttctaggactatgaactatttttgtatcttctacactaatctgagctgggcacattaggcatgtaataaatactttttgaaagtgaatgaatagtaatttaaaatagttgatgactaatgcacttgttacagtcttaaaatatattttaaacaaataaataattgtctaattccactttcagaagaaataagaagttcttattcctgtttgtaatttttttttatcatttggtaattttgaaatatttaggtttagcaaaaaattaataggctcaggttttaaaaagaaaatgccttctgcaaaaggaacaatatggtatttttaagagttgaagaaaccatattagttcctggtttatgactgttatggtatagaattttgtgtcaatgtagagctccttcagtatgtgtaatttggcacacaacccctttagttcgtcagcatttggcacatcggggatacctaaccaaaatgagggttggntaaattaaattatttttcccctagggattatttaaaggggaaatatgcttggctttggtggc

SEQ ID NO: 227951 - DNA, 873 bp, Homo sapiens
tcatttctgaattcttcattcttcatttctggactttacagctatgaaagaacaagacaaaggaattcagagctttcaagaaccaagtatgtcaggatagttgtggaaaacagatctttttctcattttctttgagatgaagataggcaacatttgctgcccattaaataccttaaaagtatacaggtgtatctgcaggattctttttgctgcttttaaatagtatattgttttaaaaggtctgtttttatcttgcctttacaattatatagacttttattgactagctgatcatatagggccttagtatagactaccatattcgccagcatttaagaaatagtccccttccctccaggagagtatttatctggtactcccatattatggattgaaggatgagacaagagactgagtattgctaatagttctgtgtgagcctgcagtgttaagtaaaacctattgagtgcacaaaaaaatcatgttacaattactacaaaatagagaaaccacctaggttaccaagatgtcaaataatggattaatggaagaaagtaatgtacctccttggtagcctacataatccaccttaatttgttatttcttatttaactattttgctatgtcttaagaaatgtatattaagtgaaaatggatgcataaaaataaaaaaagagaaatgtatatatacaagctacatgaaaattggtcctgggaataaatcaagaaattcaaccaacaaggctaccagttatttagtaaataccaaagagataggtggagtgcagtggtgcagtctgcaagctgcatctcccaggttcatgccattctcctgccccagcctcccgagtagctgggattgcgggcggccgc

SEQ ID NO: 227952 - DNA, 779 bp, Homo sapiens
ctttttctcattttctttgagatgaagataggcaacatttgctgcccattaaataccttaaaagtatacaggtgtatctgcaggattctttttgctgcttttaaatagtatattgttttaaaaggtctgtttttatcttgcctttacaattatatagacttttattgactagctgatcatatagggccttagtatagactaccatattcgccagcatttaagaaatagtccccttccctccaggagagtatttatctggtactcccatattatggattgaaggatgagacaagagactgagtattgctaatagttctgtgtgagcctgcagtgttaagtaaaacctattgagtgcacaaaaaaatcatgttacaattactacaaaatagagaaaccacctaggttaccaagatgtcaaataatggattaatggaagaaagtaatgtacctccttggtagcctacataatccaccttaatttgttatttcttatttaactattttgctatgtcttaagaaatgtatattaagtgaaaatggatgcataaaaataaaaaaagagaaatgtatatatacaagctacatgaaaattggtcctgggaataaatcaagaaattcaaccaacaaggctaccagttatttagtaaataccaaagagataggtggaatgtagcagtacagaatatcacagctaagatatgagtaggtagttccactccctcctaccccacctcagtttttattaagaaaatttcacgcatgcgaaaagggagaaagag

SEQ ID NO: 227953 - DNA, 521 bp, Homo sapiens
gtgaaattttctttatcatttgtaaggctatttctagatccgtgaactgcaagttatatttttatgcatttttccccaaggaattggaaaaagtctcaatatcaatattctattctatatattcttttaaaaatcaatgtctgaagagggaagttgtaatgtaggtgtagagaatgtccttctctggctcagagtattaggaagttggactaggcattctgtagggcccagggctcctcttgactattgtagcctgagtcttcataccttccctgaacactctccattgatgactatatagccctttatttatcctttccctcatcagcatgttgaggtgtcacatttcctcagcagtcttgctggcgtgggtgtcatgtgttgtggggaggccggggtggggtcggggtgtgtgcgggatggtcctttttctgctgtccaaggtcctgaagatgtgtttctgtgtttcctgaaagtttctcagtttcccaaatgcaagtttgagattttatttgtttttg

SEQ ID NO: 227954 - DNA, 479 bp, Homo sapiens
tggcaccagctccttcctaattaatggcctctgtttttgaactttattttgctacccactggctcctgcagaactcttgcatggctggcttcccactgtgttttaagacactgtctctggcctcagtcccagccctaccgtggatcatttcttcagttaaagaaatatgaaaattgtttgaaacaactgggatacactacttggagaaaagaagatccaaggagcccatatcaaatgtctaaggcccctagataatcgaaatctagaagaaagtctagatttattatgtggctccagacaggatattagaacaaatgggaaaacactcttctgcccaatatcgagaactttccaaaattgtggttgtccaacaatggaatatgctgctactataagtcatgtattttctgtaattgagcatactcaagcagaagtgtaatgactacttcttgggaatgtagtagaagtgattcttgaat

SEQ ID NO: 227955 - DNA, 411 bp, Homo sapiens
cttactaatatggtatgccttctgttggtacctatgactcttaattaatttttggtcctgttgagatttctggtcaagagaaattccatccccccaacctcctccttgagctgtttttcctatcctagcctctcaggcacagatctagccatttcccccgacttttagactgttatgcaaggcgactacatttagagctggtcactctgcattttgtacacattgaattaaagatatagcataatacattctgggcatgcacacctgcactctctaggctttactagttgcatgtttgctccttacatcatagttttaggtttatcaagcaattggcttcctctctttgtgcccccaggacagctgagattagcaggggccagtgcttctccacagaatttgaaggaacta

SEQ ID NO: 227956 - DNA, 472 bp, Homo sapiens
ggcctctagggatggaggtgcaatgacagacttacaccgtgattatctgatagtgggctacctccttcccagttgcttcataaagacatggaatgatttcccatgaatgatattttaaaaagaattactttcgtatggtcctgagttatatataggcatagagatgtatgtacatacatatgcatatagagagagagacagagagaaaatgacaaagcaaatgtaacaaaacgctaataactagagaatctgaaggaaggatgtacaagagttgcctggtatactaaagatttcaaaatctgggagaagaaaattttctgcattatacagaacaaagtcacttgagggaggccaggtgcagtggctcacacttagaatcacaacactttgggaggccgaggcaggaggattgcttgagcccaggagtttgagaccagtctgggcaacatggtgagaccctctctcaaaaaaa

SEQ ID NO: 227957 - DNA, 385 bp, Homo sapiens
ttctttggttttcagaactttcccctgaaagacacccagccttgtcctcaccagccactgctctgttcaccaacctcttccttgttaaaattcccttttgcacagggtgcggtggcttacacctgtaatcccagcactttgggacactgaggggggtggatcacaaggtcaggagatcgagaccatcctggctaacatggtgaaacccccgtctctactaaaaatacgaaaaattagctgggcgcagtggcaggtgcctgtagtcccagctacccgggaggctgaggcaggagaatggcgtgaacccaggaggtggagcttgcagtgagccgagattgcgcccctgcactccagcctgggccacagagcgagactgcctctcaaa

SEQ ID NO: 227958 - DNA, 360 bp, Homo sapiens
tttttttttttcttttttgagatggagtcttgctgtcacccaggctggagtgcagtggcatgatctcggctcactgcaggcttcgccccctggggttcacgtgtgtttctaatttttaaggccctactttaatttctactgtcactaaataaaaaagaacaaaagctttttcttttaaaaaccctagacatcatgttcctgcttctgctggaaaaagagacaggatatcaccatctcaaaccagcacctttcagcaactgaagcctttttgtcctcaccctgagtgttaagacaatggctccctcacacgtcacaggccctggaagtgctacaacagctgaatgggttttcatgggacat

SEQ ID NO: 227959 - DNA, 559 bp, Homo sapiens
ctctcaaatgtgccctatttttctcctcacccactatgactgctcagaaacaaagggtggggtgatggtgagttacaatgcagctgcaaggactgtcaaattattggtaagtcagggagtggaaacagtgatgagtgaaattgaccataaactatctacatagcataaacatttgtacgtactcctaactttgcagatgacagttttcattggggtctttcatgacagaagccaagtttattgtatcaaacataataaagtaattcaaacataataaagtaactgcttacaagcacctttcctttgtcaacccagcctttgggagcatagcatttttttttttttttcagaataacatacagtgtacagaaatatgctacattttgatgacacaggccaggtgacttacccgcaagggtgcagaatctgatatgcttgtctatgtatgtgtgtgaaaatagaaagcatacaagtataacgaaggcacccgttctcagagcacactcttctttgagctccttgtccttaggctcacagggatgtcaagttggggtgcttc

SEQ ID NO: 227960 - DNA, 601 bp, Homo sapiens
taatgataacaataataccattaagaataataccttcaagccatggttaaataaagtagtgtaaagcaactgagtgaaacaatttatagacaaaaaaggcattgtagaggaatatctaataaaatgaaaaaatataaacatgcatattaagtaaagaaaaagctgtaaattggtatgtttagtttatcgcatttgcaaaatatatgtagaaaaatctgggaggaaacgcaaccaaatgttaaccagttattagtaatcttcaagtgggagattatagtggatttttcttttactgttttgactctgtattttataatcatctttacaattagcaatattattttcttttaggagaaagtcatatgaaagaacagaatgtattcagcatgactgagcttgtcataatcgaagactgtgctgtgtttctttgttaaacctaagtagtgagatgagttcaggcagaaaaccatctggaagatgaatgaatgaatgaattcatgaatggatatacgaataaatgattgaatgaattctaggagttggtatttaatatatagcaaacgacaaggtagccaggaattatggctttgctttttgtttt

SEQ ID NO: 227961 - DNA, 328 bp, Homo sapiens
atgctaccactctggaatggtaaagtgaaggagattcgtagggcaaggtttgggatcaggggtatggggctcccatgccttctctggtcatgtcactcccccagcatcttgatgtgttcaccaacctggaagctctccaaatgtcatcatttagggtttcttatggaagttttatctgtgggcaatgattaaatcattggccaccagcaatcaattcattctccagctcctttccctgtgctagagattagagggaggtgggtggaatgttccaagcttctaatcaaggctggtttttctggaacagccaccctcctgaagctaccta

SEQ ID NO: 227962 - DNA, 143 bp, Homo sapiens
cagcacctctgatggttttctacagcccttggaattcaagccagacttctcccaaggtccttgaggacccccagtagccatgcctctttcctccctgctccttctgctccagccactccagcctccccacagagcaagctctt

SEQ ID NO: 227963 - DNA, 2561 bp, Homo sapiens
ggacctctagtacatactgactcctacagttgctatgtagactgtggtttcaagcactgctaaattatttaacatgtgtatctatgctgtgtttatgacctacagaaaagaaatagaaactggctgtgataggttagtcttctatatcattcaagtaattccaaaataattcaaactatgagatctatattttcagccaacctagggaatatttcatccattcatatgtcaaaaagttcatgacatgaacccctagactttagttgactttaaggcctgtagcacaaacagcagaacataagttaagtacattctattgcaaagcagaatctaagaatgtaaacacacttttctacattgtacttcccagccctaaaacttggagcatgttattttccacaaactgcccatcttccactaattttttaaaaaaatttaatggcttcagataaagggcaatgtagcacaatacacagccaagaaacaaaagaagtagtcttatttttcccaattaatcatcatgcataaatctacatattagcaacagatcaaatataaagttctatggctgcccagtaaggtaatgctagagccgttaaatatgcatgctggtgggggagggaaccacattccaatcagaagacttcagtaatgtataagatgacacaaagtaaaaactcaaggcaggtccctttttaaatttttatcatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtg

SEQ ID NO: 227964 - DNA, 3169 bp, Homo sapiens
gcaacaggtgaaattagcttaattatatatattttattgaacccaatgtagtcaaaatattatcacttcggcatatgccacatttaaaagttgagaaattttacattcttttcttcgtaagtctgcaaatctaattcagatgcaaaattttcctcaaaaatacttaactgtatttagattacataaaatcaaagatacaaaagtagattaatataatcaagtcgttccaagtatgcttaatattctatcaataactgaatttaagtcaattacaataaaaactttagttcctcatctcactagtcccattccaaggactcaacagccaaatgccactactactaggatggttcagcttcaggcagaactgtggccgcttacttcagcacaactcaattcaatgagcacaaactaaataaaaatcattttctttcccctttgtctcctaagatagctattttctaggccccttaactaaaagagtagctgtcattttctctactgcctttatcgctacatggtaagatattatttgtcactctattacacaaatgctatcagggcaaaggatgggtccactgtgttcacacttcaaactgcaagaaactacagtctacatagcaaactgtaggaagtcagtatgtaactaagagggtttcaagcactgctaaattatttaacatgtgtatctatgctgtgtttatgacctacagaaaagaaatagaaactggctgtgataggttagtcttctatatcattcaagtaattccaaaataattcaaactatgagatctatattttcagccaacctagggaatatttcatccattcatatgtcaaaaagttcatgacatgaacccctagactttagttgactttaaggcctgtagcacaaacagcagaacataagttaagtacattctattgcaaagcagaatctaagaatgtaaacacacttttctacattgtacttcccagccctaaaacttggagcatgttattttccacaaactgcccatcttccactaattttttaaaaaaatttaatggcttcagataaagggcaatgtagcacaatacacagccaagaaacaaaagaagtagtcttatttttcccaattaatcatcatgcataaatctacatattagcaacagatcaaatataaagttctatggctgcccagtaaggtaatgctagagccgttaaatatgcatgctggtgggggagggaaccacattccaatcagaagacttcagtaatgtataagatgacacaaagtaaaaactcaaggcaggtccctttttaaatttttatcatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtg

SEQ ID NO: 227965 - DNA, 262 bp, Homo sapiens
cgtcaggtcccaaatatgagccgcgagaaatgcagccccggggaaggcgctgaggagggaagggggtctgaggcctcggggctcaaggccagtgcggggaatcgccgtgctcaggaggactcgggagcaagcccggggacaggaggtgcgcaggcgttggggccacacggacgacccaaacacaagactgtgtgccccttagagagccaaagggatccctgtgccatgaattaaagctttctggaaaatgttccaaacttca

SEQ ID NO: 227966 - DNA, 376 bp, Homo sapiens
ccagccagggcagttcccagacagactctggctgcctggacccaggtctgctccaaggaagcagcacgtttctggaggaggcttagccaagaaaccattacggagtgagagaggagttatctggataaatgcggaactgcccaactcctagcatttgttcctgggacccaggctgtaacatcctctggagccaaactgcctctgttcaaacccttgtccccgcactccacctcctagctgtgtggcactgtgtgcattacttaactttgcatgccttactttttccatttgtaaaatgcatataataataaatcctacctcctagggttgtgtgaggatttaatgatttaataaataaaaaacacttagaacaatt

SEQ ID NO: 227967 - DNA, 654 bp, Homo sapiens
gtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaa

SEQ ID NO: 227968 - DNA, 469 bp, Homo sapiens
ggcctcatttgatatgaagaaaaatgataaaatgccgtatatttttactttaaatataaccaatgtaatgcctgaaatctaaagtcagtaaaattttgaatgacttgacaaaagtaaaaaatgatatataatttcctcacattttaaagtatgaagctgttggttctagtttctctaattttgttgttaaaggttttctataaacattctataagtgaaaatgagagctgcacaccactgtgtccaccgtctttgggagagaagggtgaagttgacctgaaatcagagctgtttttcactcttccattcactcacattgtaaatttggaagaagcacattatctgttgtgaatctcaggttcctcatatgtaaagtggagtggttatctttttgctgcttctactcatgggtatggagtgaagatttaatgcaataatatatgtgaatgaataaagagctttttttggc

SEQ ID NO: 227969 - DNA, 894 bp, Homo sapiens
gacctgtgtccgttccagcaaatgaaaacctaaataagtcccacaacagcaccgagtgttctctaaaggactgtggtctgacattttcacgtaaaataaactaacactcataagtaatggtgcattttcaacatgctcgtgtgacaggtatatgaacgcgattggtggtggggggcatatttttgggggcaagagaggactcctcattcacccttccccaagttagaaaatgccatagcatagtaggaatgcgttcaaaaacaaatttctagatgatatcctgcatatgaaataaactccagtcttttgtaccatctgtatctagcatacttataaaatagaacaaagtgtgcatttttaataaagaagcatggtgttgattttcttcttcagtcctcttcttcttttctattattttataaggtacacaaagtatattatttgtttttaggaatattttagtggggcaacaagcatggccaaacattatctcgtgaagcactttttagaagaggaagcatttgagattctcaaaagcactttcagtgaaatgtttttaaatgcacattatgatgttaagaaattaacttgagttattaaagcggcaagtatgttagactaataactactaccatcatgctttcccaggtttgaagagctgctatcacagagatttaataattctaattcgaggttatcttcattaagaatactaagcttgcatgactgataaaagaattagaaaaaatagtttaatatcaatttactcttctatagggcttgacaatttatcaagtgcctttacctatattacatgatttgatctttaagaccagtacaagccctccatatccttgggttctagatttataaattcagcccaggaattgaaat

SEQ ID NO: 227970 - DNA, 375 bp, Homo sapiens
  misc_feature (375)..(375): n is a, c, g, or t
gacctgtgtccgttccagcaaatgaaaacctaaataagtcccacaacagcaccgagtgttctctaaaggactgtggtctgacattttcacgtaaaataaactaacactcataagtaatggtgcattttcaacatgctcgtgtgacaggtatatgaacgcgattggtggtggggggcatatttttgggggcaagagaggactcctcattcacccttccccaagttagaaaatgccatagcatagtaggaatgcgttcaaaaacaaatttctagatgatatcctgcatatgaaataaactccagtcttttgtaccatctgtatctagcatacttatttcagtcctcttcttcttttctattattttataaggtaccn

SEQ ID NO: 227971 - DNA, 697 bp, Homo sapiens
atgactggatacaataaaagaatttatcaaatggatccttgtataaaggacactaaataacataatagtcacagcttataatagcagctttacaaaaaggtagagaggttctttgtgtggccatctggtccatccaactaaataaatgccatgagctaaatgttatactttactgctaggaaaacattgccactgagagttaaagaagtatcatcaaactgtaaggctttctggagacgtctcttaatacagaatagcacagagagactggatgaatctctggttagtatgttctgtagaccagagggtttttttgtgtgtgtgttttgtttgtttgttttgctttacttttaactgcatgtggtgatctattactgggtagtgaaattagtgagttgctgtaagcattctttaaaagaaaaggctgggtgcagtggctcacacctgtaatcccagcactttgggaggctgaggcgggcagatcacgaggtcaagagatcgagaccatcctggccaacatggtgaaaccccgtctctactaaaaatacaaaaattagctgggcgtggtggcatgcacctgtagtcccagctactcgggaggctgaggcaggagagtcgcttgaaccctggagccggaagttgcagtgagctgagatcatgccattgcactccagcctggtgacagagcgagactcaa

SEQ ID NO: 227972 - DNA, 787 bp, Homo sapiens
cctagaataaaaacatatcattttagaggcagaggtacagtcccattcctctgtttaaaaagatgaggtagataaagtccaagatctttcatctggagtgtttgaaagagttgggactagaagcacatctctggtctccagtcaagtgccttttctagttgagcttgacttctttatatctggataataaaatcaatctcatacaatgatataggtcatatttttccaaggcagttaagtattcattcactcctataccatcaataataatgacaaacatttatataaagcttacaacctaggcagtaccctaattgctgcctagcaggctgtaagcgctatatgaatattgctgtatgaatgttgcctgacgtgaagagttagacactgtagagtaattttccttatattgccttttgcttaatattgcccctcttttaaatcttcacaagagccacattaactaggtactgttgtcctcatttcatagttgaaggaggaaactgaagcacagagactttaaatatattcaccaaggaaatcgagccattaattggtaaagcctggatttgaacccaggcagtctgggtttctgagcttgtgcccttatccactatactgtgtattgttccaataatttttagttgcataaacgcttagaaatagcatttataagttctctgtgctccagaagaaccagtttcaagaaagaataaaatatatgtaaatagcagataaacccattatattttaaaaaggttggaggcactggatactaaaaaaaaaa

SEQ ID NO: 227973 - DNA, 476 bp, Homo sapiens
tgaatagtattcaattgtatgaatgtaccacactttgtttaccctttcacccttagaggaatatctgtgttctttctagtttgaggatattacaaggaaagttactatgaacattcctttctaggtttctgtgggaacatgtgttttctttcctctagggtaaaagcattatactgagggaaagaatatacacacaaaaagtgcttgattctctttgtttgaaatactatagcagtcaaaatttatcttagtgacagaaagtagaggagtggttacaggggatggaagttgggtttggtgttgattgcaaagggcatgaggatgctttttgagattatggaaatgtcctatatcttgattatggtggtggttacacagctatgcacactgtcaaaactcaatgaaatctacacttaaatgtgttcattttaatatatgtaatctctacgtcagtaaaattgtttcaaaaatgtttt

SEQ ID NO: 227974 - DNA, 598 bp, Homo sapiens
aacaacaacaaaaaaaattgactttaaatgacactctcaaacaaatggacctaacagatatttacagaacgttctatccaagatatgcacaatatacattcttctcatcaatacatttaacattctccaagatagaccatatgataggctcagaccacagtggaataaaagtagaaattaactgcaaaagaaaccctcaaaactatacaaatacatggaaattaaacaatctgctcctgaattatttttgagttaacaatgaaatcaagatggaaaaaaaattcaaatgaatgacagtagtgacacagattattaaaacctcttgagatacagcaaaaaaaaaagtgctaatgggaacgtttatagtgctaaatgcctgcatcaaaaagtcggaaagatcacaagttgacaatctaatatcacacctcaaggaactagagaaacaagaacaaactaaacccaaagctagcataagaaaagaaataataaaaatcagagcagaactaaatgaaattgaaacaaaaaaatgcaagagataaatgaaaaaaagctggttctctgaaaagataaaattgatagactattagctagattaacc

SEQ ID NO: 227975 - DNA, 662 bp, Homo sapiens
ataacattcaggaataaaaccagtgctgcctgggcttgttaatcctttccattttcaaaaaggagaggaaaaaaaaaacagtctgggagaacccaatgttaattaacttgtgtcttggtgacatgaaataattcttctccctgccacattcctaggcaacatgttaattaactctgcattagtgcaggcatttccagccattctttaatatttatattattgttattaaaatgggcagcagagagcttaagatgggacatctcttgacagaggagaaaaattgtcttttgcgtcagggatggtcctttagccaaggtcttgtttactggcattcttagtatatctggcaggatcttttaacaaggcaagttggaggagtaactgaacgggccctctaatgtgtttgagttcttcttcacccctaggataacttgtccccgtgaggatttccaatggctgagttgcctgttacagttcttttccgacatttagcttcaaatattcatgagacccccatgcagaacctcaactctgctgctgtgttgtattgttgggaacccaagagcagctgttcatgtctgtgctgagccagatctccttggatcccttttcactaattcttgtgtgctgggagtggtggggtggcggtgatggcagtggtt

SEQ ID NO: 227976 - DNA, 454 bp, Homo sapiens
agcttttaaaattgcttatctcatttgtggggagattatagatgttctagatgtaggtagaaaaatacagcataactgtgcattaaaaatgtggactagacttataactacccagaactggactcaaaactacattgttacattattaatgacaaaagtgccaccacagatcggtggcaaaaagatggtcttttcagtaaatggtatggcagcaatcagatggccgtacagaaaaaaagaatcatatcattacctcaacctaacacagaaattaatttgagatgaatttaaaagcctgaatgtgaaagttaaaaagaaacttctaaaataaaatacaggagaataagcataaaacaaaatattagtaaattgaacataattaaagttaaaaacttctcttcatccttagacacttttaagaataaaaggcaattgaattctggcactcaaaaaa

SEQ ID NO: 227977 - DNA, 507 bp, Homo sapiens
agaagaacccgtaggcctgtccatgttttcctgcccaggggctcccgagggctgactggagcccagccttaaaccccaaatccaacctgcattgtggccaaacggagtcagtgctccctgaacacaaactgcaagttagttatcaacaggtacctccaatgccctgtcaatcacccatgtgaggacaacctggcagcaggaaggagaaaaaacaggagctgctttaatctcccggaatcctcacttctccccattcttgttggtccaaaccatcaagatctcttgcctgggtgacgtctcctaactcttgctgccttctctgtcactacaataatcaaaaccatccaatggcttcccagtgcctttagaattaaatccaaacttggtactgtggcccctgctgccgcccccaaaaaatctctctcccatccttcctgttctctacctgttaatgccttcccatccctcagaacccatcaggacacacgtgagtttgaatgccctgaa

SEQ ID NO: 227978 - DNA, 577 bp, Homo sapiens
ccatgtttacttttgacacgtggccaaggtctgtgttgttacaagaacctcattcttcccaggagatgctgggccagtggcttttggcagctgcttggagcactgaaagatgttttcctggtatggacatcatcactactacccctaagcattgaaacacgaaggcttgggtgcaaaaatatgtacctggatagatacacatttgcaccaaatccaaatacagtacccacatgatggtttcactgcccttttggagttaatgactccattcttaataagggtggggcaacatcttttgcctggagagaatcctcaccatcctggtattttccatatcctcgtcttcctaaatcattccatgacacagtgagttgataggggtttaagaattaatcttcacttatagtattttccgtaggggaagtcagcactgaatcccgctgatgcctacatcccaccttctatgtaaaccctcctgccctccctccctccatttcctcaattcatccgtggttgataggtcaaccatcatcaatgactgacagcggtatctacttcacagagcattgtcaagacg

SEQ ID NO: 227979 - DNA, 371 bp, Homo sapiens
tcttgctggccctgagacactccagcctcagggcctcttgacttgctgctcccttccctaaactgcccttcatggcatcatatcaatcaggtctctgcttgaaagtcacttcccccaaaaggccttccatgaccacagcacatgccttcatctccacgttcacatcgcgcttcgtgttcttcacagtactcaacactctgcagctctatcaagtgtctttcttacttgctgtctctctcccacactagaatgtaatttgtatatggcatcttatttaccatagcattcccattgcttacaacaatgcctcagacgttgtggacatttggaaaatatttgctatgctgacacattaaaagaaatgtgtatat

SEQ ID NO: 227980 - DNA, 525 bp, Homo sapiens
agcagattaccaaacccctccaaactttggtttctaaaacagctgtcagtaaggggagtaaagtaaagtatagttcacagaattttccaaaacatcaatgtttcgaggtagacaaaagggtttataatgatacttggtttgggataggtgctcatgaaacattttctttcttcctgttttgttttttgcctttacctggggttggggcctctgctgcttattcatcacgcaactttaggcaagttgttaacctaaaattcagtgtccctgtcaatggatgggttgtggaggactgaacacaacggtacgtgcaatgagcttgtgacatccacacaaggggtcagaatatacatgtgcagcataatcataaattacggtctgaattcatccattcactcattcttccaaacaaacaggtaacccatggcgcttgtgtgccaggcattgtgctattgctggagacgtaaagaggatcatgataccatccctgccttcaaaggaaggcagtctatatcatttttgcct

SEQ ID NO: 227981 - DNA, 491 bp, Homo sapiens
atatgactatagcccatgtttgttaatgctttaggagtaccctggaactaaatacatattaaataccattaaataattgttaacagtacttgtcttggtttagcaaaatattattttcttgattttccaagtttttcagaatttctgacattgtacatcaaatctgtaatcaaggaaataccttatttcgaatgtcttttggaaaaaattattataattcctattgttgttgcatgtcgtacgaatgaaagaatatacaatattctcttaatacggttgactgttgagcatggaaaagctgaagttgcccatatactttttaccttaaaagggaaatagttgtttttcacttcacgttgatcttttttaaggtgcacaagaggaatttagagttttcaaataaaagttgtacctagatgatttgtaacaatataaactaagaaactctatattataaacattaattaatttgaatatcaacaaaaaaaaaa

SEQ ID NO: 227982 - DNA, 273 bp, Homo sapiens
acttttttctacagttactttttttccacacttacttttttttaatatcagttcttaagggcatttgcataatccccatgttttgtcacagtagtctcagaataataataccaactctttcaccaacaatataattttaccaaaaaagtttcagggccgcacacgatggctcatgcctgtagtttcagcagtttgggaggctgaggcaggcagatcgcttcagcctaggagttcaaaagcagcctggggaacatggtgaaaccccatttctac

SEQ ID NO: 227983 - DNA, 448 bp, Homo sapiens
tgctctcatacagagattacatttcttaaggaagtcaggcctttggaatgcagtagacaaatggccatgagagaaaaaacatataagtatcgaaactaatggcacactcgatatgtcataagtgaatgacagtctgtaaatgccaaggaagacagagagaggtagaaagcagccttctttggaagataagtggtaaactcaagattgctatagctaaacgcataacaatcctcaacaggggagatgaaagaagtggtttctgtaagaaggaattgataccacttgaaattttagtgctgagtaactaagaaaacttacatgagggtctatggttatgcggagcagacaccatcttctttccctttttcttcttctcattctagttttctaagatgcagcctttggtgagcttactaaaaatacagattcttttaaagttagtgccgaa

SEQ ID NO: 227984 - DNA, 590 bp, Homo sapiens
gatggttcctttgacagaaagtttgggctgggtgcggtggctcacgcctgtaatcccagcacttagggaggccgaggcgggcggatcacctgaggttgggagttcgagactagcctgaccaacatggagaaaccccgtctcgactaaaaatacaaaataagctgggcgtggtggcacatgcctgtaatttcagctacttgggaagctgaggcaggagaatcgcttgaacccggaaggcagaggttgcagtgagccaagattgtaccattgcactccagcctgggcaacaagagcgaaactccatctcaaaaaaagaaagaaagaaagtttggagtaggtgaaaagttttccttagtctgccaaatctagactaagttttgcaggaggtggggtttgagtgtaaaataccagacctcaaaggtaatctagatcaatatttttcaaactgttggatttaatacatttaatagattgtgaaattaataggtcacaaccaacattttaaaaaaggataatataataaaaaatgtcagtctattacatgtaagtaagaataagtattgtttttagaaactttgtagttatatatg

SEQ ID NO: 227985 - DNA, 412 bp, Homo sapiens
aagaatgtgtcctttaacctcagagccccaggccttggccagtccccccaaaacacttggggtcacatgacccctgtccctcaggaacttcctgggagaaggggagggcacctcccagcacctctagcccccactgaaaaaccagcctgggtggccctgagagggcagaccgaaagccttggcacctcctccccaaccatccctctgaaggagagctgggggaggggacggctcctcggctttggcctccaggacctggcactggataggtgccaaatgtttgctggctacatgaggcacttgttcctgcagaagggaaactgcacctgacaatgactgcttcctccacctaagtggggccttcttccctctctcattcattcattcaacaaatacacactaagctcaaaaa

SEQ ID NO: 227986 - DNA, 309 bp, Homo sapiens
cttggcagttcttcagctgcagaggtttagctgcaaccatctgcaaaaaggccggtattttcgattccattgaccttgtgatcagggtgttaacagtgcatggagcaggctttggagggccgtaggtcaaagtctgaggcccccgatatcccagtatgactttgggaactgccctgaggtctgggctgtgtctgagggactcctggccaaggagcgttctctccttcagaagcagcatccgtgctgtgtgctgggtcagggcgacccctggctccagggtctctacacacagctctccttggcagggag

SEQ ID NO: 227987 - DNA, 255 bp, Homo sapiens
gtattttcagtagagacaggattctattatgttggccaggctggtctcaatctcctgacctcaagtgatccgcctgtctcggcctcccaaagtgctgggattataggtgtgagccaccgcgcccggcctctgctactttttaaaagtctatctccagaagtctgctttctcattttgaataccgtaggtattcaaatgaattcactttcaaatgaattcactaggtgctgttctacccttctgttagccttttac

SEQ ID NO: 227988 - DNA, 231 bp, Homo sapiens
cagcctatttccaatatgccctctttctgcctggcaaacatcttgtcttttctaaactcagcccagggacatgacatctgtaatgtgtttctgtgtgactcccaggcttctgccttcttaacctctcaccttccagctcatttgagtgaatctttgtccaagaattgagagaaactttataggtaaagcatgcacatgttgtctgatttaatctaaaatagaaataagaaa

SEQ ID NO: 227989 - DNA, 358 bp, Homo sapiens
acatgacttataaaggaacaacagactgacaaattctcaacagaaggcagaagggagtagaattacttcagggagctggggtaaaggcccatctgaagattctccatgtgtcacagcaagactcagactgccttttgctgagggaaaatagaacttctccagctgagctgtggttttggtagccatgtgggccagcgaattcagaaatcagagttcggcccctgctgggtcgggggttgtcataacagtcccgtctgtactactaagctgggaccttggggcgctgcactcttgaagtaaaccccatcaggagatccacagcgcactgtgggcttctcaagaagcccaaattccagga

SEQ ID NO: 227990 - DNA, 348 bp, Homo sapiens
agcaaaggttagattttgttactctggctcatcaaactgatactgtgaactgtgtctgtgtactcgagtggactgttatcaccttgtcaggcagggcgctgagggctttgcctccatgatctcgtttcaacttctattatcccctaaaagggttttacagagaagtaatttgctcagtgtcacattgctaattggtggtaaagtccaccctcaaacccacatatggttgactctggggcataagtattcagccggttggcctcactgcttcccatactttgacgtttgcttgcccaccatgacccgacttatttttaaacaagtaagagattattttccaaaaaaaaa

SEQ ID NO: 227991 - DNA, 216 bp, Homo sapiens
caacagtgaacaatctggaaaagaaataaaaactaatccaatttatgacagctatgaaataaataaaccagaaatgaaagtggaaatattattgaccttaaagtaataaaaattattacactactataaaagttgtatgctaacaaattatataaccaaaatgaaatgggcacctttctagacatataaattacttaatttcgctcaagaggaatt

SEQ ID NO: 227992 - DNA, 813 bp, Homo sapiens
ctttttaagtttcttgttattttttgtcaccagtaagcaatgacattattctgaatttgagtttcagctttaacacaatggtcttagttaaatttaaggtttcaaatagatttttacaatttaaaatctattttggtgacaatacaacttcagagagagtcctatagaaatgattacaaagagtttttaatactagacttgtgctattaaatcttttcttgtatgcctcagttactcttaggttttccacatgcctgttaatttcacttgttttaaagtgatgctccttggaatttagtaaaagagacactgagataatttggtgaaagattcatttatctttgttagtcttccatatacttggtagtatttttgcttttggtgccccgtcattgaaaaatgtttctttggtagaatgtttacacattataagctgttttataaaggagataaagattcattttatatttagtctaaagtgacaatggagatgtatgtgtgggagtgtgtgcgtgtgtgtgcatgagagagacagtgaatatatcagtgtaacttcctgctgttgttcaatagtccttaaactagtgaaaaaagtagtgaaatgagctattggcccaatggcttgaaaacttatttgtgtctatctaatatgtttaaaaggaataataatatatcatggatatgagtgtatgtattaactatagaatgactgattttttaggaagttaattctggtgagagtggtcaagccttagtaacacagatttcccagatatcagaacttaaattattatagaagcaactgatctacct

SEQ ID NO: 227993 - DNA, 484 bp, Homo sapiens
gaatggagatgattattctggaagatacaacttgaccagctttgtaagctgttaattattaaacaaaatcaatgtttttaagtttaatttggactctttcagttggaataactcaaggtcattctttcaaaaaaaaaaaaaaaaaaccccagaaaatccccgtgtgtgtttttggtgaccttcttggaaaagggagttggaaaaaaggcctctaaggcaacagtgaaagaggtaagagcctggcttccatgtgtctggagttccttatgtctggattcttggtcatttctgtcactaagacctgaggatcagcatggctgggagaggcccgagctggctcagttggggccatgaaatctgtaatgacctcgggtcatagccagcccaacaaggggacactctgtgactctggtaagatgtaggggccaccggccagcagtagccagcaatgaccactatcagttggccaaagtcaaaaaaaaaa

SEQ ID NO: 227994 - DNA, 348 bp, Homo sapiens
aaaagcggggtggttattcaaagagcaggttgcttagcacctttaaggaattttgggggtgggggcagcaggaacccaccatcacaaaaatcactgacatgccatatcatggatgaatctcaaaaacattataagtgaaagaagccagacacaaatgactgggtatagtctgattaagtgaaatatcctgaaaaggcagttctataaagatagaatgtagattagtgggtacctggagttggtggtgaagatggtaattaactacttgggcataaaggatctaaccgggatgacaaaaatgttctaaaactggatttcagtaacggttgcacaacctggtaaatgtat

SEQ ID NO: 227995 - DNA, 151 bp, Homo sapiens
atattaaaatttctaatcttcccttgtgtttgtctttctctggggccagttttatgtacatagtcacttgtgcatataattcctagctgattcagtaaatatgtacaactgaagactgaaccctcagaaactgacatgaacctgcctttaa

SEQ ID NO: 227996 - DNA, 414 bp, Homo sapiens
tcttacatgtgatgttcaatatgagttagagccaaagaaaaatgtaaatacaaaatgcctttgacctagcttttcagtaaagctgaaaaaatgatgttaagatttgcagggctgagtttgtcataatctattataatccagcaagtttagattgctactgaaaatgataatattctcttacatcagattaagaaatgctcaggatgtatattaagaaatttcatggagaaatactgtccctactaaaaatacaaaaatcagctggacatggtggcacacacctgtagccacagctacttgggaggtggaagtgggaggatcacttgagttcgggagacacagacttcagtgagccatgcctgtgccacttcactctctagcctggctaacacagtgagacgctatctcataaaa

SEQ ID NO: 227997 - DNA, 724 bp, Homo sapiens
gacagagcaagaccctgtctcttaaaagaaaaaaaaaaaaaaagagccaagaatactcattgttctgccagtgatgtctaggaaaggaatgccaggtgctgctaacatggacattttagtgatgactcacaagttcatgccttatggctggggaaaggctctgtgatggggccgtgccgtttaggatagcacattcagacttaattcgtgtatgcaatgctaggaacgaaagaaagtgaatgtttttttctttagtgggtaattcttctcctagtcctttggtagagaacattggtcttttcagatttttgcaggttttgtgttctttcatgtcctgctcttcatgtagagttaggcagatgtcttcactcctaatagctttccgatgggatagaatagaaatacttggtttcactaattattctatttagtaattactcaaaaatttgtttggacttaagtttcctggtaactggggcagtagtggtgttggagtattggctgtgatgaggattacattccttattcttacagagatgagcctgttgaggtttataagaaatgtagctacttcagctgtgtgttttgtatatgcctgaatacaaagtgatcccctctttgcccagtgagaagatccctgcaaaaggttttaggtctacttgaaaatataaatttttaggactctaaaaatatagttcaaagtccacctataatacttaatttg

SEQ ID NO: 227998 - DNA, 685 bp, Homo sapiens
tagcatgtaactcaaaatctaaattgagtaaagcccaggaatctgaggaatgatcagtgctacaaaatgtgaaaggtaatctcatctgagaggaatccaggtgttaaagcagggggcagttctatcactatactacaactaagtaagtttaaacatggctaacagagacttctagttcaatgtggctaagcacacaagtttatcttcttctagattcttatattaaaattactgtaagggaggaaaccaaacacaactatataaaataggagtagagtcatcagcaagaaaatgatttcaacacacagttctagagaagtaaataaaaagtttcaatttagagtgtacacaaaggaacctaacagctgaggaggacctaatctaccacatagagcctcaaagggatcaggacttgaaaatgccagatatggtagaaggcagaaatgcaactttgataaaaatagaataattcaaaagatccttactaattctaaagaatgtactttaggcagaaggaaaatgatccaatgtggaaagctgaagatataagaagaaataaaaatttttataaatatgaaggtatcagatccaggaagtaggctgggtgtggtggctcatgcctgtaatcccagcactttgggagaccagggtgggaggaccgcttgagtccaggagtccaagacca

SEQ ID NO: 227999 - DNA, 262 bp, Homo sapiens
ccttaccacccccaccacgacacagacaaccttggacagactgtccacatttgtggcttttctttatatacgcatcacttttaatacaaattccatgttactataatgagccaatatacttttagtatgtatatgttcatagctctgcttgcaaaaaaaaaagaacaaggctctctttatatataaaaatcacctggaaataaatatttaaaagaccaaaacccagtacaaaaataggcaaagggtaataacagacaattta

SEQ ID NO: 228000 - DNA, 333 bp, Homo sapiens
accctccccgccaggccccgctccgctcccccaggtccaccccttcccaaaccagccccgacaggtgaccgctccgtggcccaaagcccgtcttcctggccaacagagaaaaataaagtttcattttgcacactgcctcccgccccgcgccccactttttgaggaacggggagccctttctttcctggctccttcccacatctgggagctgtgtaggcagcgcacccacacaaatggcctcgcacctttcccaaatcgggattccagagcgatccactcaacaagcctcagtgatttaataaagcaaaaattaaaaaatgaataataacgaaa

SEQ ID NO: 228001 - DNA, 401 bp, Homo sapiens
aattaaaagtgtgtcttctacttggagattgtggagataagtcttgatgataaagacttgataaattctagaaacataaacttagaacaaatattttcccagctataactatgtgtgaatcccttggcttgatcttgtagaagagacaaagtaagactctgcaggtcttgcccttaaagtgcttacaatatgattaacttagtaaagtacggttggctgtctaatccaagatagatgtaatagctacttttctgttatagcaacatttggttgagaaaatgtgggagtcattgtagatttttggtttaaaaaattaagaaataaaaattgtgttggcagattgctttagcccaggaattctagaccagcggtaggcgacgcggcaggatcttgtctctcca

SEQ ID NO: 228002 - DNA, 596 bp, Homo sapiens
gaaatttgggaaggaaactttttaaaaacactgttagactgcaaactgacaatggaaaaacaatcagtatgagattatgatgggaatgagcaatttatgagggacaaacagctgaacttacctagagcgaaatatattcactctagacttgtaaaagaatggcttggttctaatctgaatctaaatgtaaagatatgtttacttcagtgataccttgtttaaaaaaaaagtgtttgttcttgggacattggactcagtatagtataggacagttgatgaaataaagggcaaatcccacagctggaatagaaccataaacctgatcctgtggcaaggatggcttgttcactcactgatttcactcttattgttgcatacttttatttctagtgaatcagagctagaaaaacaattgagccaggtgcagtggctcatgcctgtaatcccagcactttggaaggccagtgtggatgaattgtttgaggctaggagttcaagaccagcctggctaacatggcaaaatcctgtctctactaaaaacataaaaactagccaagcatggttgcgtatgcctgtagtcccagctacttgggagg

SEQ ID NO: 228003 - DNA, 419 bp, Homo sapiens
ctatcaacattctattcacgctatcttagaaaacatctaagaagactgaggctttctctctaacttttctcttcttctgagccctcaccagaattactcctaatgctcccccatttatggcaatgtgggctttttcctagcatgtacttccaaagtctatccattacccagtttcaaagtcccttccatatttttaggtatttgttccagcatcagcctcacttctggtagcaatttctttcttagattattcaggctgctttaacaaaataccttggattggataatttacaaactacagagattaattgttcacacttctggaggctggaaaggcaaaggtcaaggtgccagcagattcaatgtctggtgaaggctcactctcttcctcacagatggtaccttcttgctgtatcttc

SEQ ID NO: 228004 - DNA, 419 bp, Homo sapiens
tgagcgcttcaggatcacctccaagaatttgataaggactttgctgggccgccagccagtcagagggaagatttatggctttgaagtttgccgctacccaatcatcaaagaatagcggctctttcagaagcgaaagcaaatcctttgaatccacaaagctcctatggtgtgtttgttggtctggataaaagaactgattattaggggggatgggaagggaggagataaaggcgggacaattaatgaagtaatcactatgtgggaaatgtatatacacaaataattggattttcctgatcaaagggggccttgccgcctggagacccgcgcttgggttgctcgagacactcttcccgccccccccaacatacacacacacacacacacacacacttgcaattaaagatttgcaccgacgc

SEQ ID NO: 228005 - DNA, 398 bp, Homo sapiens
ctgtctctaaaataaataaatattcatttttgttggcccctaaaagtattggaggccctaagccctgtgcatactgtactgtgcctaatggataaggtggccctgccttagttccccacccccaaattaaatcaatctttctcttagcgttcaggaccttttatgaactggttctgccatgaacaagtgagatttcactgtaaaagtgtgtgccagtttgtacatctcatattttcagagacctgggttcgaattcctgctctataatctaatggtatgcagttgtgcatgtcacttgatttctgagattgtcagtcttttctgcaatatgaaaatagtaatatctctctcaaataggtctttgtgaaaattaaatgggatagtatatgcaaaatatc

SEQ ID NO: 228006 - DNA, 717 bp, Homo sapiens
actgagtgacttaaacaatagaaatgtatttctcacagttccagaggctaagaaatccaaaatcactgtgccagcctggttggtttctggtgcagcctctcttcctggcttgcagatggcagccttctcgccgtgtcctcttatggcagagaaagtttgtgaactgtctggtttccggtcttataaagacactaatcccattgaaccagggccctaccctcataacattatctaatgttaattacatcccagagatactatctctaaatattatcacactgaggattaggattttaacatttgaattttggggtgacacaaacattcatttcataacacctcccttgagttagccttgtgggggttgccctggtacaggttaccatttacttctgataagactctaatttacttttggcaaaaactgactaaccacatataaataagtgattttatttaccttttcccccatttggtgcatacaatttaccatgtagtccaagcctttaggcctcacaagacttcagctcaggaccaggtaggctgccagttcgtcccccatatccaaacagccccgggagagagaagggagagaatttttaaaatgacaatcctgggatgtcctacggtttagagcactgggaggtgtacttgtagtcattaaaaagcaactgcagtgacccagcatagtgctagtaatctggctcccaggccgtt

SEQ ID NO: 228007 - DNA, 405 bp, Homo sapiens
acttcttttaaccagaccaaacagtctatttttgcccaagcccaaatgaaacacagcacctttgttacttaaattacacattacagcaatacaattataggagaacttttcctgttctctggggagccctctgggtatgtggattctatgggtggtgatagctgcccccatactggagggggagatgcacttgggggaggccattaatttcattcaccatccgggatgattttcccctccccagtaatctaaatgcttacaaacatcactggttacaaatgcaccgggccctctggtggtggtaccctatcacagtgttcgcccctgccgctggtacgatcctgctacagaaataaaatattaagcttacatgtaaaataaagctcttaatgacagtggtactga

SEQ ID NO: 228008 - DNA, 115 bp, Homo sapiens
caacacaatttcatgtcattttcacaacaaccctacgaataaataccatgtatttggttgtgagacactgaggcactaagtgattacgtcacttgtctaggttcacttatctagt

SEQ ID NO: 228009 - DNA, 364 bp, Homo sapiens
gagacaaagtcttgccctgtcacctaggctggagtgaaatggcacgatctcggctcactgcaacctctaccttccggattcaagtaattctcctgtctcagcctaccgagtagctgagattataggtgcatgctgccatgcccagctaattttttgtattttagtagagacggggtttcaccatgttactcaggctggtctcgaactcctgagctcaggcattccatctgcctcggcctcccaaagtgctaggattataggcgtgagccaccacgccaggcagctgtgtttatttctttgtggcttgtctgttgggtttgttctgctgagaaatgcaaggccctatccccttcttctgtgtctt

SEQ ID NO: 228010 - DNA, 449 bp, Homo sapiens
ttcccattcctatctggtggtcaaagcacatttttttttttctggattgtccctgcttccctccctctcctttttgctcataggtgggggaaggggctgcagtctccttgcaaatgtcatcagtaggcagagaaagccaatccggcttgtttttgttattcaggagtttttaatcctgaaattgcatcagttgaaaggggagataaggaagacccagataagagagaccctgccccacgcagccggttagaggaatgtggaaggccctccctttcttattggcaccatccaaggggcaaggctgaaaacccagagccagggtcatgaggatggatcagggccttttctccttcagagaaggggtggtccctgcatccctgagaccctagaaaaggcttcctttaggccaaagagaaagaaggcgaggaggtgtgtgtgggagggagggg

SEQ ID NO: 228011 - DNA, 285 bp, Homo sapiens
tcttatatttttagttgagatggagtttcatcatgttggccagactggtctcgaactcctgacctcaaattatccacccgcctcggcctcccaaagtgctgggattacagttgtgagccactgcacccagccggatctgattttcatgaggcatctgacacattgcatacggaagcattcaataagtagtcattgaaatgaaagagtcaagaaattgaagactgttatgaaatgtctgtggatagaaataataaatgtagtctaggtaatggatactacacttag

SEQ ID NO: 228012 - DNA, 326 bp, Homo sapiens
cagttatactgtttttcccatcatttgctatacaatttggttcctgctttcaatgttttgtttgttggtttgattggttagttttggttttgttgttgtttaagtaagggatgattcctccagtattgatcatcaggcaatgagaacccattaaacttactgaagaagaccaaagagactgccaatttagaaagagtgggctgggcgtggtggctcacacctgtaatcacagcactttgggaggctgaggcaggcagatcacctgaggtcaggagttcaagaccagcctggccaacatggtgaaaccccgttctctactaaaagta

SEQ ID NO: 228013 - DNA, 467 bp, Homo sapiens
cctgctcgagttactggtacacagatctttaattcactcaacaagtgtttattgaatgtctattatgtgctagggctgttccaagctctgaggatgaagaagtgggaagaggagacaagtccctccaatctagtcgggaaggtgtattctcactgtttcacctcaggctgttctcaagtgtgtctgatccataataggaacacagtgttcatgcattcatgctggtcttgcttggaaaaagatcatctttcttggttttttggctataacaaatagtttgtattaatagtagccaaatttttaactttccatcaaaatatgccatgtccaattttgtccataattatgttaactcaggagctcaaaattgtgccatatttatccaagagaaataaaaacatattcacaaaaaaacctctttgtaccagaatgtagtgttcattgcagctttatttctaatagccaaa

SEQ ID NO: 228014 - DNA, 443 bp, Homo sapiens
gggatagagttttaagaatatccccagtgagggtttagaaaaatttaattcattataaatagatctattttaccttaattattattctattataattatttctttttttttttttttttttgagacagagtctcgctctgttgcccaggctggagtgcagtggcacaatctgcaacctccacctcctgggttcaagtgattctcctgcctcagcctcccgagtagctggaattacaggcatgccaccatgcttggctaatttttttgtatttttagtagagacggggtttcgccatgttgccaggctggtctcaaactcctgacctcaggtgatccacctgctgtggctgggtgggattacaggcgtgagcctgggattacagtgctgggattacaggcgtgagccaccgcacccagcctgttataattacttctaatcataa

SEQ ID NO: 228015 - DNA, 423 bp, Homo sapiens
caagcgcagctgttaaccagatgcatgcaacataagccacagagtgtgagaaaaaaagtattagcattatttccatggaactagtcatgtggttattatagaaataatcagcattagcatactacaatatttgttttgttcttgaattgtaacaccctagggaaaaagttgcctttatttttaaaaagttaaaaatgaaagtacatgttatatatctttgctgaaaaatggtgggaaatggatttgtcaaaaccatatggaaaggaagagggaatcaattaaaaacagaaatctaataaatctaaaatatttccaaatgaaatgcttgtggtaagctaacttcttgtaaacaccgcactcaagtcacttgaacagtcccagatggtgaactaactttgtggtcttaaaacaaaagtcagccaa

SEQ ID NO: 228016 - DNA, 368 bp, Homo sapiens
aaggcgagaggattgttcaagcccaggggttcaaaaccagcctgggcaacgtagtgagaccccatctctacaaaaaattttaaaaattagccaggcatggtggcatgcacctgtagtcccagctactcaggaagctgaggtggaaggattgcttgagcccaggaggtcaaggctgcagtgtgctgtgatcgcacccctgaacttcagcctgggtgacagagcaagattctgtctcagaaaaaaaaggggtggggtgtggggcctagtactttcaaacctttttagcagaaccctttcctctcctcccaccaataaagtttttaatcttgtgtggaatctcactgaataaacaaaaacaatgttttatt

SEQ ID NO: 228017 - DNA, 407 bp, Homo sapiens
gaggatattggcttaattcaggcaagagatgatggcacctacatgtccagctgacagtggttaagcaaaatgtagtatgttggtgagatggaacattaggtgaccatggaaagaaatgaggccaggtgtggtggctcacacctgtaatcccagcactttggaaggctgaggtgggcggatcgcctgagcccacaagttggagatcagcttgggcaacatggtgaaaccccatctctgttacaaatacaaaaattagtggtggcgggcgcatgtagctcctgctactagggaggctgaggtgggaagatcgcttgattgagcccgggaggcagaggttgaagtgagctttgattgggccactgcactccagcctgggcaacagagcaagaccttgtctcaaagagggg

SEQ ID NO: 228018 - DNA, 729 bp, Homo sapiens
tagataaaattaattacttctaccatggtagaacttctttaccgtgtacattattgcatattttatgttctgtccttgcacaccttggctcgcaataaccatgccctcttaccaacacacgcttaatagaatttgtatgcacagttacattttttttggaaaggaattgagcattgacttgttctacatccctaagcctcaggctctcctatgatcagtgaacacgataatacctgctttattggggatcagataagaataatgtgaaagaatctccaaggactgaccttgtaaatcagtaactctgggttctaggctcttccctgccaaatttgacatgatctcagacaagttgtcagatgtctctgatcttccctcttccaccagtagcaacagagtttttaaatgtataaagtgctaaacaaacttgagagagttttattgtgagcagtaggaaaatgcattactttttaatttaatgaaatgaatatccaaaattaattgaacagcattgaattaattaatatatcgttaatttctacatgaattctctccattagcagtgcagtgtgtcttataaatgtttgctagaggagtcttatatgtaagcattactcactggtagaagattctcgcctaatacatatgctaaatttccatcttcttgcacgattctggttaaggatcgtattattccagccttagttgtccccgaggtatgcaggaatt

SEQ ID NO: 228019 - DNA, 131 bp, Homo sapiens
agtatggtctcaggtttatttgctttcaggataatttcttgcccctttttcttgtgcccttaaagagctcaaataattcctttctttagaaaataaataaataaaagaagtcatataatttaatcattacc

SEQ ID NO: 228020 - DNA, 344 bp, Homo sapiens
tcgccatgttgcccaggctgatctcgaactcctgagctcaagcaatccactcacctcagcctcccagtgttgggattacaggcgtgaggtgccacacctggctccccaaaatatatatttttaagagacaggctcttacaatgttgcccaggctggtctcgaactcctgggctcaggcaaccctcccaaagtgttggcattataggcgtgagccaccacacctggcctctttgttgagtaactatgtacatgcaaacattaaaaattttggcaggccgggcgcggtggctcacgaggtcaggagatcaatactatcccgtctaacacagtgaaaacccgtctcc

SEQ ID NO: 228021 - DNA, 449 bp, Homo sapiens
tcaggtgtcaagaagcatttgggagtcaaaaagggtggaggagattggtgcagggatcctggcaaatctctgggtgagcagcagggggcgccctgatcagggcagggaatgttgagttggatacacagccataagggggtgtcatggggctgtgggaagtccacggactctgcctcagaagggaaattacttgatctctgtatgcctcagcgtcctcatctgcaaagtggacatcagagctcctacatttattagcctgagaacaaaaatcaggcagaataaatgaacaaccacagcagcaacaacaaacaagaacaagagccaaaagcaaacagagagatgagcccttatatcatcggaccctgaaatccagccaccgttgaagccaggtctacccctctgatttccaagacaacagaaatcaatgctttttttcattaaaagccaaa

SEQ ID NO: 228022 - DNA, 425 bp, Homo sapiens
cagttatatagaatatggtcagataattaaaacttaacagtataaaacatgcaaaaaaaatttcagaatatttcttaatcaaacaacatcagggtctgtttagaatggttcccatacaaaatgggtataaagttatttcaaatcatgtaatattgtaatactaaatattattcagtactgtatagtaaacagtgctgaagaagaggtaaatttcatagatatgggggcttacttatgctgtaaactcctgtccttcttgttcacttgaagcagcatacaacaccccagaatttcataaagtaagaaaaggacggctgctgctctggcaaaaataggatgtgtaagagtcaaaggcacactattcagctagccacagtgattagcaaacacttgcccttcccaccccacatgctctttccccatgt

SEQ ID NO: 228023 - DNA, 523 bp, Homo sapiens
ggggggctttgaggccaggggcgaggatagatcaaagaacagagaatgctgacgggggccagggcaagtgtctagcaactccttgtcttgacacagggttgaaagggaacccaaagccttgaagacccccttccccattccgctttctggtcggctttgaaactatcccattttgttttccctcggcgtccacaaaaatataaagtagggcctattttctctgtccttatgtctctttttccctatatcaccgatgagatctcaagggtgcaggattttttttttcttgattcatttttgcagtccccttcgtagatacttcgtttgacaggcatactcattttcgagttagcttttaaaacacccactgaaagctctttcaatttctaaccagcagcagttatttctgtgccatatcaaaacttgaacatcagtgtttataattaaaagctttcagttgctgtatcaaggatgttgtaaacactctagagtagataagtttccggagaaggagaacccccta

SEQ ID NO: 228024 - DNA, 497 bp, Homo sapiens
tatgcttagcatgctacatttgaggtgacagcctgatgagtagtgggaggcatttatgcggtatgtggatttcttagatgttgtctattggagccatataggcctgcttactaaacttatttagaatttccttacattgtttttacccttttaaagattattagtgaaaaaaggccaggcatagtggctcatgcctgtaaatcccagcactttgggaggccgagacacgcggattggttgagctcaggagtttgagaccagcctgggcaacatggcaaaaccccatttctacaaaaaacataccaaaaaattagctagatgtggtggtgggcacctgtaatgccagctactcaggaggctgaggtaggaggatcgcttgaacccgggaggcagaggttgcagtgagctgagatcaccaccactgcactccagcctgggcaacagagtaagactctgtctcaaaaataaataaataaaaataaagattattagtgaaa

SEQ ID NO: 228025 - DNA, 585 bp, Homo sapiens
gattattatcgtacatgaatattcatagcagcattattcatagcagcgttatattagctttctaacttcctaaaaggattgttgcaaagttcaaattaaaagcttgaacaaaagtgctttgataggtataaaacattgtgtgtaaggcagtcatgccattattcattcagcaaatatttattggtgcctgctaagcttacatcactcctggaagaccagtgggatcaatggatgaatcggatgaagagcaggccctcagcatgcttttaatcttctaagaaagagaagccacgtaaataaccacagctcaaggtaggagacagatgaaggaaaggctaagaatggaattttctttccataacctgtgattttgaggtagagaaaagaaagggttttttttggttttttttttttgtttgtttgtatttttgagacggagtcttgccctgtcacccagggtggagtgcagtgagctgagatcatgctaccacactccagcctgggtgacagagccagaccctgtctcaaaacaaataaaaatttttttaaaaaaattaaaaagatgaagagacgtaagaggtatag

SEQ ID NO: 228026 - DNA, 766 bp, Homo sapiens
tgaggagcttaaattgagagaattttacttttaattttgtagattgagaagaggaaccgctttttaaaattatagctaaactgtcattgttttcctaagagtcacttggccatctctggccccctctttcatcagcctgaagagagggtctttgtagactgctgagggtgggccttgtaggacttgaccatggcttacacctacttaacctttatcctgctttctttcagcttgtgcttttcagttataaactccagtgggtacagcaggctggccttttcatccagctgattatttttccagcttaatatagattgacccatatgaaatttccaataatggaccatattttctgcaaatagacagtattcgcatggatcacctatatcttccccctgatacactgtgggtcccaacaccagatgtcatttctccagagcagtgctaatgaacacaaaaggtataccctgggtggcccagctcttttcacgaacgtgctgccctgctcatagtgatccttgcatcacttggtgaatgggccatctcctgggacatggaagttgcagaggtagatagtgcactgcagcttctcttaagccggattggccatcaggcatatcactctggagtttttagctgctgtcctttcctgatgagcagtctgtattagctgacctcagcctacttgttacgtgacgtatgggtcccaaaagtgtcctttgtcaaaaagcagaatgtgccttctagtctccctttccccatctaa

SEQ ID NO: 228027 - DNA, 310 bp, Homo sapiens
tgaggagcttaaattgagagaattttacttttaattttgtagattgagaagaggaaccgctttttaaaattatagctaaactgtcattgttttcctaagagtcacttggccatctctggccccctctttcatcagcctgaagagagggtctttgtagactgctgagggtgggccttgtaggacttgaccatggcttacacctacttaacctttatcctgctttctttcagcttgtgcttttcaaaatattccacataggtatttttaccttccctgatcttattgtttagctctgactgaatgtcgacgc

SEQ ID NO: 228028 - DNA, 153 bp, Homo sapiens
ataaagagagagagagagagagaggaaaagggaaaacaaaaccaaaaacccaagcccaccaaaggaatctgatcttatttgtcaagaccaatgacccaaactgtgccacttaagaatagaaacaaaggttttaaagcaaagacacaaagaacc

SEQ ID NO: 228029 - DNA, 603 bp, Homo sapiens
tggcgtttttcttgttcttagcatcatataacaaacgtgacagtcattgacatatttgaaaacagaaccttgctcggattcctctattctccgagctctgcctcccactgtctctaaccattcttctgagctcacatttggaagttgcattctgatttaaaacacactctgaaaggatggtaccagaacagtgtggaatggaccatcacttctgaacaatgtaaaatggattcaatatatagtgtaaaagatgaattatttttctgaaaattggatcaatgtacatcattttgctcatcttgtatagcaccataaggatcactgaaggtgtttagtttttcttcaggttatttcactatctttagattgtatacaaatatcaagggcacttgaaatcattcagaacaatgagcttcttgatgtccctcaaaccatttcttgcaatagttgctgaggtgttttcttagtggccattattctgcttttgaagagtacacacaaaagaaaaacaagcactcgtgggatttctttttttttagaaaatattaattatcagttaattgtaagtaacactgtcttataatatgcattatgatttgataa

SEQ ID NO: 228030 - DNA, 650 bp, Homo sapiens
ggacccgttgtacattattggtaggaatgtaaaatagtgcaccaattgtggaaaatggtctgtcagtatcgcaaaatgtgaaacatagagttactatgtgagacacaactattccgctcctggatatatgcccaaaagaaatgaaaatatatatctgtgcaaaaatcctgtacattaatgttcatggcagcattacttgttaatagtcaaaaagcagaaacaacccaaatgctcatcaactgaggagtggataaacaaaatgtgttatagccatatgatgacttattaagttattaaaaggaatgaagtactcatactacaatcttaaaaacatgctaagtgtacatcaaattacatctagtgtaaaaaaaatgctaagtgaaggaagctggtcacaaaagaccacatattatatgattcaatttatatgaaagtctagaacaagcaaatccatagagacaaaatgtagactgatggtaaccaagggatgaggggaaagtgcaatgagattgtactttcaagaatttcaactcctcaaaaattgactagttcttttcaaaatgataaaaatgttctaaaaatgattgtagtgctggttgctcaactccatgaatatattaaaatttgttgaattgtatgttttaaatgag

SEQ ID NO: 228031 - DNA, 303 bp, Homo sapiens
aaggacacagctagcaatgggctggaaaaagagcagagaacctggagtgatcatctccaactcaactcaatcacactacctaaaatcggcactgacaaagtacaaataatccacctatccagtagaggcagtactgatctggctgattcctggatatggggaatcctctttatgaaacaaacttataataagaaagaatatgtttgtgggagctctggctgctcttcttgattttgctagctaagagtaaagtggttaagagagtcaggattagagtgttctggattcatataggttctgtcc

SEQ ID NO: 228032 - DNA, 536 bp, Homo sapiens
tgtggtactggcataaaaacagacatagggacaacatgaacctgcaagatgttacattaagtgaagtaagccaagcgcagaaagacaaatacggtatgatttcatttatttgtggagtgtatatatttatccataaaagtagagaataaaatggtggctaccagggctggtgagagaaaaggggatcactgagagtttgctcaaaggaaatcaacatttcagttagataggaggaataagttcaagaaatctattgtacaacctggtgactatagttaataatagtgcattgtattctttaaagttgctaagagaatagattttaagtgttttcaccacaaaaatggtaagtatgtgaggtaagtatgtgaggttaattagctgaatttagccattttacaatgtatacatatttcaaaacaacatgcgtactataaatacaagtttttatttgttgattacaaaagacatagatttacagaatagagagcctagctaattaacatacacattatgttaattagctaaattatgca

SEQ ID NO: 228033 - DNA, 474 bp, Homo sapiens
attcattttagaaataagcattccaactgtatggatgtcccattcaacacttttttgtttgtttgttttttacagtcttttgttggtggcgcatgctgatgctgaaaggagaaaataactattgaaaatatctaataagttaaggttaaaaagaaataacctaacatagtgcacactgagtatttttcagggtaaagaaagacacatttatcaaatgcctactccttttcagggactttatatcaattatttctcatcttaaaaaaacactgcaagaaaggttttattatcaccactttacagatgaagatcaaagttcaaaatattacataatttgcccatgtcacatatctgttaagcagcatatagctcagatctgtttctaaaagctaagatctatgctttgcaaaatcatgtttactcatcagctatctgaccttaggcaagttatttaacctctttatgaagcttcaa

SEQ ID NO: 228034 - DNA, 353 bp, Homo sapiens
gtagaaatgtcccttatttctccccttatttcagaagtattacaattattgtagaaaaataaaggagaaggccaggtgcggtggctcacgcctgtaagcccagcattttgggaggctgaggcgggtggatcacctgaggtcaggagtttgagaccagcctgaccaacatagaaaaaccctgtctctactaaaaatacaaaattagctgggtgtggtggcacatgcctgtaatcccagctactccggaggctgaggcaggagaattgcttgaacccgggaggcggaggttacagtaagccgagaccacaccatttgcactccagcctgagtaacaagagcaaaactccatctaa

SEQ ID NO: 228035 - DNA, 291 bp, Homo sapiens
ctgtatttctacaaagaacttaattaacatgtacagtgaaaaagtcagaaaataaaatgtctagttataatttatttcttcaaattcccaatacttataatggcatatacatttccagctgaaaaaacaaactttaagctttttcctcaaagtatctgaaatcctaaaatttagaaagccaagttagtttttagagaagacatacatgatttgactcccaggacaaaaaagtaaactctgtactacttcgttataataattctacttaaaatggcaactcaaagtactgta

SEQ ID NO: 228036 - DNA, 367 bp, Homo sapiens
ggaggcacagacgggggcccgtgggggcaggacagcagcctccccgaggcacatggctgagtgctgagctgggaaggcaccatcgtaatgccctggagggccagacttgaaatgagaactcttagaaaaccacaccagagcacagcccacctcccttctcttccctgactgtgccccccagcagaggaccctggcccacagccaagccacatccatgccactcctgcgaacagccacttctaagtatggggaaccaaggaaatgttactaagacaacttggtggggagggagccagtgttcacagcccctaggatccctttacagtttctgagcacaagactccaacttgcccgcgtgatttcactc

SEQ ID NO: 228037 - DNA, 314 bp, Homo sapiens
ggaggcacagacgggggcccgtgggggcaggacagcagcctccccgaggcacatggctgagtgctgagctgggaaggcaccatcgtaatgccctggagggccagacttgaaatgagaactcttagaaaaccacaccagagcacagcccacctcccttctcttccctgactgtgccccccagcagaggaccctggcccacagccaagccacatccatgccactcctgcgaacagccacttccagtgttcacagcccctaggatccctttacagtttctgagcacaagactccaacttgcccgcgtgatttcactc

SEQ ID NO: 228038 - DNA, 454 bp, Homo sapiens
atcaagaaaaaaaaaaaacaaaggcttaagagtcaatgtggaataaacttgatgctttttgctgctttctgcaggagttttaaggtaggctggcttcgtccccgtgctgtgcacgtgctgtggtggtgagtccagcgtctgagggtactgcctgccatcgccgccttgcactgtgcagatgcacctgcagtttcaccttagccaccggagcaaatgtcagcacagggaaaacacaagccgctctggccctggggacctccctgaagctccccggaccacacttagagaaccgctaagtcagaagactcctaactcctgttctgtttaactctcgaatgatctgcatgcgcgcgtgtctacttaatcccagagtgtttcggagagatgttccactttaattaaattgtatcatgatttacacacatgtttgaataaaaccacccaagaagagcat

SEQ ID NO: 228039 - DNA, 476 bp, Homo sapiens
gagatggagtcttgctctgtctcccaggctagagtgcagttgcacaatttcggctcactgtaacctcagcctcctgggttcaagcaattctcctgcctcagcctcccaagtagctgggattacaggcgcccgccatcgtgtccagctaatttttgtatttttagtagagacagggtttcaccatcttggccaggctggtctcgaactcctgacctcgtgatccacccgccttggcctcccaaagtgctgggattacaggtgtgagccaccgcacccggccgaattttcccctttcattttctgcactgctgtgttctctgagctttccactgctatagtgtttcctgatgagaaggaagtgtttcctccagcttttttttcttcctggaggagtaggatatgaaggaatccctgcccccacacggggtgggatccagccagctgctccagaggatctcggcccctcctgtagcctc

SEQ ID NO: 228040 - DNA, 121 bp, Homo sapiens
gctgtttgcttctcagcgctacgcttccgcaccctttgtcgttggtagtaaaatctcaagcccaaccgcgtgagccgggggcgttactcacaccctcatcaccatcctgatcgccgtccaa

SEQ ID NO: 228041 - DNA, 505 bp, Homo sapiens
ggctattttttttgtattttagtagagacgaggtttcaccgtgttgcccaggctggtctcgaactcctgtgctcaagcaatctgcccacctcggcctcccaaaataagaacagtaattcttttgtattcttaggtaggtgtttagaagaccaattaaagtaagtcgcattaagtgatgaatggctgacaccctcagttctgctaaggtggtacttgcattttaaaaatgcattttaaaaagagatttcttaattgatgcagtggtgcaattgatgtttccttctgaaaagaccctaatggtccacgctttctagggagggaacaataggatggttggacatggggttgcttctcaaacctgtttttgaaagaaggtgattaataattagtttttgggaggaaagaataggctaattttaaaccaaactattaattatcccatagccgtttgtgtttatttaaccttttcttaaataaagtaactcttaatttttccttgatatca

SEQ ID NO: 228042 - DNA, 484 bp, Homo sapiens
cagacagtaggctgaatagtagtttactgattcctgtactatatccacaagtatataaagaatgatgaatgtgtataaaaactatatgttccttgctcagctatggaattaaaagacatgtgaatgtagccacaagtctcttgatttatcatctaattcacaacttgaaagatagtttggccaaatgcggtagcttacacctgtaaatcccagcactttgggaggctgaggcaggcggattgcttgagctcaggagtttgagaccagcctgggcaacatggcaaaacgctgtttcttcaacaacaacaacaaaaaaaacccgaaaccaaaaattaacttgagtgtgatggcacatgcctgtagacccagctgcttgagaggctgaggcaagaggatcacttgagcctgggggttcgaggctgcagtgagccaagatcacaccactgcactccagcctgagtgacagagtaagaccctgtttcca

SEQ ID NO: 228043 - DNA, 366 bp, Homo sapiens
tgacaccctcactggctccacggctcccccttcccatcccaggtttccatctgcccactgaacagggaggggaaactgaggcactcccctggcactgagggctccttctgtcatcctgcctgccctggatggtcctggctgcccctcagggcttggccctggcactgtgagcctcacagggctcagacccccacccccaacccagcactaaatggcactcggcaccagaatctcacttcagttggcaaaagcagcaattagcatgtaatgaggcttcttgctttatttttaggtaacctccaaggccctgcctgtgtaattcagcccgccattgctcggtggataattaaagcatgtcaccataat

SEQ ID NO: 228044 - DNA, 418 bp, Homo sapiens
gctgtgtgttgctacaatccagctttggagcatgaactctcacactcccactgtattccttccattgaaattaaagaaatgcaactcatcaaacatttggcagcttcatatctaacgctcacatttcagtgtctcctttgatgttgtaagagaagcagatgcttctacatgagaaagcaagatagggagccatgtatttttacttttactttaactatctctcaatgtgatcaccttacctggattttaggatctttctaaactagaaagactctattgtcacaacgtaatgtctgaaatgaatgattaaaggaagatacccacattatgtgaagtgaattaaatctaaatcttaaatctctatcataaaattattctgtaatgaattaggagtttcaattaaaacatgcaaaggaaa

SEQ ID NO: 228045 - DNA, 293 bp, Homo sapiens
gtgctgggattacaggtgtaagccacggtgtctggtctggatgatactttttgtagagtatgtgtgcataattatttgctcaatgttatattcatagcagtctctttacacatttaatttatcctttatgatttaaaacaatttaaagctacagattacatgttacaatttgattttttataaaattaaatagacttttgtttataaaaaaattgacaatgtgtttcatcaatgttaatctgtagtttgtaattacaataataccaaataaaatttttctagagtcattatga

SEQ ID NO: 228046 - DNA, 833 bp, Homo sapiens
gcacgagctcgtgccgaatcggcacgagtgaaaagtcaaatataagaaactcctggaaatgacaataaatatgttaaatgtatttggaaatgaagactttgattgccatggagacttaaaaacagatcaactgaaaatggatattctgattaagaagctaaaacagaaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaaatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcctagactgtggttagttacatgaccatttctcttttgggtttcatttctctaatataattcttgtttttaatttggtgaaatactgaattctgttgacttatgcatgtttagtaaagatcataattagctgtgttaacacagaaaggaaatggaaactttacattttttaattccctggagctctcattttcaagagatacccgtttactaactttattccataaatgtgactaaactg

SEQ ID NO: 228047 - DNA, 502 bp, Homo sapiens
acagcataagccacctgcaaagccaagctggtcactcccagaagcacagtggaaatttccatctggcttgagtccctagatggccagcctccacagccagcctcaaatccctccccaaggccccacgcagaaatggagatacctgcaacaaagcatttcaaacaaaagaaacaactgagacttgtgccccagggcatttaaacagtggctcagactcaaagctcactcaaggagggagatgcccaccacagcacctttcagcaaagcccagaggctggactagccacacccagaagtataaacggtggctcacctcagcctcaaagcccaccccaagtctctgcctaggcaagggggcaagcctcaaccatgcatttcaacaaagcatagcagctggtcccaactaccctgaacaaaacctatctaacctcaggacccaaacagtggtagtgcccggccggggaaaataccatgtctgttaagggttcttaccatgatttta

SEQ ID NO: 228048 - DNA, 465 bp, Homo sapiens
tctttccagaaagaggtaatttagaacctgtttgttatgttctagtataatagttggaattacgtgttctaaacacaaccagaatgtgcagacaggtgagccctttacaaaagccacagaaggccaggcacggtggctaataaatatgtaaggaattacagaattaaaatatcatcattggctggttgtggtgtctcacactggtaatcccagcactttgggaggctgaggtgggcagatcacttgaggtcagcagttcaagaccggcctggccaacatggtgaaaccccgtctctattaaaaatacaaacaaaattagctgggtgtggtggcatgcacctataaacccagctattcaggaggctgaggcaggaggattgcttgagtccgggaggtagaggttgcagtgagctgagatcatgccactgtactccagcctgagcaacagagctagactctgtctca

SEQ ID NO: 228049 - DNA, 392 bp, Homo sapiens
tgtagaaaataagctatttgtaccatacctgcaagttttctcagttattgtcaagaaaaataaataaaggtaataagaccccaaaattgcggcccaaaccccatccaggatggcaactatcctagctccaaagacatcaaagacatattctctggggaccagtgaatatggagacttggtactgacaggtatcaagcacaacagaaaataggtttgaggcacaggactgaaaacaaaagtgaaggctgagcacagtggctcacaactgcaagcctagaactttgggaggctgaggcaggaggatcacttgagcccaggagttccaggctgcagtgagttgtgattgtgccactgcattccatcccaggcaagtgagcaacaccctgtctcta

SEQ ID NO: 228050 - DNA, 393 bp, Homo sapiens
tatgcttgccagagtccctgtcttcctatctgaacacattccagaacaatccaattcttctttgaaatgttcattttatttcagatacagaaagaaattaaacaagattgggtgcggtggctcatgcctgtaatcccaggtcttttgaaggctgaggcaggccgatcacttgaagtcagaagttccagaccagcctggccaacatggcgaaacccccatctctactaaaaatacaaaaattagctgggcatggtggcaggtacctgtaatcccagctactcgagaggctgaggcaggagaatcacttgaacttgggaggcggaggttgcagtgaactgagatctcaccactgcactccagcctgggaaacagagggagactcctaaaaaaaac

SEQ ID NO: 228051 - DNA, 973 bp, Homo sapiens
ccgtgcgcacaggtgtgtgctgggggacatgcatttaggctgtgcgtgtgtgggcggcccccagagaacgctcagcatttaagcagtcgcaatgagggaggctgacaaggctgctgggaagaggggtgcgcttcgccctctaggctactctgcttttgaggcccattttgaatgtgcgtacttcctgtttaaataaaaccaaacaattttaaagatcaaattctggaagcacgtacttgaaacattaacaacaattaccttggagaagaaagagggcaataaaggcggcttttgtgttttattctggacgctgccatgtttaaaaaacaagaattcattcatgaccgggaggccttcaacagtcacactctctttcttgagctgagaggtggatgcgcgggcattctcggttactcttgaaactgtatgcgcaccttatatacactcccatacatatgttcggtttcataattaaaaaataatactttcatctatttcttagaaaaggtgaaataaaacaggatggaacaacacgtcgttttaggacacagaggagagactgtttcttcttcctgctaggccatgtaactgacaaggcaacccaagtgaatagatatactcaacgctgggaaacaggtagcacagcaaatgggcaccagaatatgccaagacaaccgattccagggacaagttgagagttctctgtatagagaacataaaattctatgtggccaacattaacaagcccttcggactggccactgaacctttctggaccagcattagatggtcttgaagaggtctgctagatccaaaattctgagatccataacaagtccatccagtggacacagatgataatgtatagatgatacataataggtccgttgctacaaatgctgctcagtccctgacttgccagtgagggatctgggagcagaaagatgcagagagagcttgaagatgactttgt

SEQ ID NO: 228052 - DNA, 672 bp, Homo sapiens
tgtgatctcttagcagaatagatttattatttgattgcttgcagaataaagcctatccttgaaagctctgcatcatgggcagtgagctcagtggtatctggaggacaaggctactatcacaagcctgtggggcaaggtgcctttgctcatgatgtccctaaaaacctagattgtctttaactcttttcactcacccataacttgcatctcacaaactacaactgaactacaactaaactcagtaggtgctaacaatgaccacaatgcacacatcatccccatgctggggcacactcactcagcagagcatgatttagtgcctggcagttctttctttcagatgttttcatctttctcatatactgtaaacactttcagtggctcctatagttctttactatgttgggagcattttaagtccttagtaaatcttactgattagtcagtcaatcactttggaagctatcacagaaactttcttattattggtattttaatatttaatatatttgtaaaattataaaatatttactgaagtatatcatcaggtacctgcaactcaaaattctggttggcttcactgaaaaagacggaaatgaaagaagggttagcttgcctttctaaagataaattttacttacttacccaggttgtagtgaatacaaggaactg

SEQ ID NO: 228053 - DNA, 802 bp, Homo sapiens
aaatagattgacaattaggtagtttgaaatgataaaaatttctttgaaaacattaaataaactagctttttttctattgggttattttaatgtcaaaatattttaagtcatatataaaaatacctaatatggtgaatttaattgattaccattaataagatccagaattgaaggtagaatgatttttaaatttataatatagtaaaattgaccaagatgggttatccaaaggttgttccattaaaacctaagagagttcaatatttcttttatcagatttatttggaataaatgccaattttcttattcaaaccatttaattttgaaataattcaatagttaatatataacctaggcaatgtatatttcatggtagtattgtttttctataaatatgttctagtgacaatctcaaacaataaatttagcttttgcttccatttttgtttctggatggtgtatataagaagaggaatatacaaaacacttactgaccaagtcttgaaatagttctcattgatttaagaataaatttgtttaagttaaccggtagtatctaaagatagatttcttgtgtaaattctaaaacaagaacaataatgagttgaagattctgacaaacttgaaagtacaatgttatttttgaccagggttattgtaatagtattgtagaagagcattactgtttctacacatttatgaggaagttgtatattttatttttcttatgcatgagatttcaagaatgtaccattagtatcgacacaaagaaaatattaaaggcaactttagaataacaaat

SEQ ID NO: 228054 - DNA, 438 bp, Homo sapiens
tttttctttcttttgacagagtctcgctctggccagagattttctaaataatggtcaggaatctgcattgtaagtcttactctttggtaagaatattactgtagttgatctgttgttcttattgtgttatctagtattactgatgtggtatgatgagcacataataaagtgggtacattatttccctacattgagttaaccatgctctcttatatatgtatatatggaaattgttggtctctgattagttacacccaggtgtatgctagtgacccttattttttcatgagcctttaataccctcattttaatttctctcagaatatgttaagaaccaaaccacaagatttctgctgtcactgcactgaaattgtaaaaaatgtgggatgggatattacatgtgctctaacatgtattaaggatccaacatctttttac

SEQ ID NO: 228055 - DNA, 423 bp, Homo sapiens
tcgtgagaaatggagagaaagatagacccttggcaacaccattcaaactcctgggcccagctctgcttgaatctagttctgtctccagattttttcagctcaaagagaaaattagttttctttttaaaaaacaaagtggtaaaatacacataacataaaatgtagcatcttaagcatttttaagcatacagttgagtggcattaagcatcggcacagtattgcaagaccatcatcaccatccatctccagaatcttttcttcttctcaaaatgaaactctgcacccattaaacactaccagtccattctccactcctcccattccttgacaaccaccattctgctttctgtctctatgaattcgactactggagacatctcatgtaagcggaaccctacagtatttgttcttgtgtgactgac

SEQ ID NO: 228056 - DNA, 385 bp, Homo sapiens
atttgtatattttttagtagagacaggatttcgccttgtgggccaggctggtcttgaactcctgacctcaagtgatccgcccacctcagcctcccaaagtgctgggattacaagcgtgaacccctcgcccagcctattctgccattttacaaatggaaaatagagactcagagaggttcttctcccatccttatccatttttgacatgcaaacatatttcaattcaataaacctgtactggggccaggtgcagtggttcatgcctgcactgctagcactttgggagaccaaggtaagaggactgcttgagaccaggagttccagaccagcctaggcaatatagcaagacctcgtctctaaaaaacaaacaaaaagaaaacaataa

SEQ ID NO: 228057 - DNA, 886 bp, Homo sapiens
cctctcagagcacatggataggtgacgggtttctcatgtgaatctacaagaaaaggtacgcctgggccacacgcaggacatggcacccactagggttgttcaggtctcattcactgcaagcaagaattcacgtacatgagtgcacaaaggtgttggagcttggtctcctcaggcttaacccaaggctgactcactaggacagcttccaagaaccacagatgtaactgcaaacttgaagagagtcagaatgttttcaactgagtcacgaagctgtcccagaagcacccgacatagggtggaggtcagacacattccctggctgcccacaggcgtgagccttcctgccaggggacagtaacagggcccgaagggctgggggtgccgctggcttcccagggccaagcgctcagagctgggccggacttgcccatgctggcttcagctcacattgccaaggaagatgtgtattggggctgtgcaggctgccacattcttgctttttctgtagacaaaagtcacctccctcggatggctgtttacttcaaatcaaacttctctgacgagattttaatctgaaactgcatctgttcttcccagctttatgtggggccaacaagtatctccagcctttcatgactgtaatccctctttaaggcagggaaaacatatttccctcccatgccttcagcagtgtgaaagaaggatatcaaagagaatcagagggaaaaaataccaaatccacccaatcagtgccaaaataaactttctctgaggacatcagtgtttgcatccatctaaaaccaccagaggttccaccaaatgcttgagggtttcagctgtacagtgtccaggaaaaaacccaaatgcacacagcaactgcagtttc

SEQ ID NO: 228058 - DNA, 384 bp, Homo sapiens
ctgtgctcatcagcgcccaaagtccagagggggccgaggcagaaggaggctggtgtgttatcaccaccctgcgcacacacacacccagctaggtcgccacagcacctgggcttggcctcaactttggaaattggagcaggcgctgggagcgaggagaggccaggcagtgggagcaggtacttccaagcctgcaggggctgaggggcttcctggaccccgcgagagcacagggatgcccaggtctgcagccgtggctgggcagctgcagttgcccccagaagggcaggtttcccactctgccaacttggaaagggggcagggctcccacctgttcccagctcccgcaggctccgtggagtgcacagccccagctgcgcgtccccc

SEQ ID NO: 228059 - DNA, 451 bp, Homo sapiens
attatatatcattcatctaattatagtagtttttcatgctatgaaggaaaagatacaaaaagaacatacaataatgagagctaatctggtataggcggtgatagatatttgaccatatgtgtaaggactattcaaagtccagggagggtgggtgtatatgtgtatatgcgtgtgtctgcaggaggaggagaatgttcaaggagagggtcattgcaaagagaaagaacaaaaggtacaaatatcctgagaccacagtttgtttaataaggatcctcaaaggaagaaacagtgaaaagagccaatatttgaagagttaattgctgagtactttccagacacatttatagacacaaaaaactaaatgtacacctaaaagaaaaacatttatacttagtcacactttaatgaaaaggaagtacaccaaagacaaagagatatttaaaacaatgag

SEQ ID NO: 228060 - DNA, 717 bp, Homo sapiens
acactgtattataatgatctgttttcacatctgtttttcctctgcgactataagcatcttgagtgctaagatttgttcttagactgagtttaatagcagaccagacacagaaaaatagcagattaatactgaaaaatagctaagttttttaaaaagagaaagagaggaaaaatgcgacataaaaagacacagagaaaaaaaaataagctccaatatatcttacggtgtttcggaagaaaatagtgatttgaagacaatacataaagagataatgactatcatcttttaagaactaataaaaatgccaatccatagattcaagatacccaatcaaccccaagcataaacatataggggaaaaaagtccacacttggacacatcatggtaaaacttcagaacatcaaagacagtcttcacagcagtcagaaaagggtaccttcaaaggaattacagttaaatttatggcagttttcagcaacaacactgaaagctggaagaaggtgaaatgacagctactttatgttaaaagacacaactgcctccttaaattgcgatatggtttggatctgtgtccctgccccaatctcatgtcaaactaagttccccagtgttgaacatgaggcctggcgggaggtgactggatcatgggtgtgggtctttaatgagcggtttagtaccatccccttggtgctgttctcacaatagtgagatctggt

SEQ ID NO: 228061 - DNA, 385 bp, Homo sapiens
ggggaagccacatgattaggcttctccaggagggcctggtgaccctgggccagatgttttgagaaaaatttataggatgaatggaaaaacaaagaagatagaaggaaatgggaaaaataaatccctattctgaaatcaccaaaagccagagagtttgaaggaaactttgagataaaaacaaatggctcaccaatactttttttctttctttctttttttataaagtttgcccaggctggtcccaaactcctgggttcaagtgatcctcctgcctcaggctccccaaatgttgggattacagatttgagtcaccacgtaccgcctcaccaatgctttttaaagtgcatatgcaaaatatgttataaggcaaatatatatttgtaaa

SEQ ID NO: 228062 - DNA, 843 bp, Homo sapiens
tccttccctctgcacttctcgctgctgccacgtcgcaaaggaagtgttttcttctccttccgccatgattataaatttcctgaggcctccccagccctgcggaactaagaggaagagacaccagagatgtgcacactcagagacaagacacatgaggacacagagacaaggcggctacctgcaagccagggagaggggcctcggggaagccaaccctgcctacgccttgatcttggacttccagcctccagaactccagaatctgagtgaaatgggtataaatcatgagctaggatacagttcaattattcctatgatgaaaagattttggtgtttgtgggaattcttggaaccaattccctgtgggtaccgaggagcacctgtacatgtcacatgttgcgtattcattcatcggtgggtggacactgcagcagtctccatcccttgcctactgtgaataacgctggtcataagacccccatttcagaaggggtcccgccccatccctggggaaggaaagccacacagacaggccaagaaggatctggacagacaggccctgctgggttccccactccgtctgttcctgctggatggtaccctttgtgtccaatcacctttccacatggttgtccgtgcctccatcatgcctgtccagtgatgtctccgtaaaggccaaacaggatgggagaggatgagcttcgggatggctgagcatgtggagatgtggagggtggcgcgccagggaggactgggagctctgcgcccctcacgtgccttctcctatgcgtcttcacctgtatctttcctactgttctatatgataaaccggtcaatataagt

SEQ ID NO: 228063 - DNA, 531 bp, Homo sapiens
tccttccctctgcacttctcgctgctgccacgtcgcaaaggaagtgttttcttctccttccgccatgattataaatttcctgaggcctccccagccctgcggaactaagaggaagagacaccagagatgtgcacactcagagacaagacacatgaggacacagagacaaggcggctacctgcaagccagggagaggggcctcggggaagccaaccctgcctacgccttgatcttggacttccagcctccagaactccagaatctgagtgaaatgggtataaatcatgagctaggatacagttcaattattcctatgatgaaaagattttggtgtttgtgggaattcttggaaccaattccctgtgggtaccgaggagcacctgtacatgtcacatgttgcgtattcattcatcggtgggtggacactgcagcagtctccatcccttgcctactgtgaataacgctggtatggacatgtgctatcctgcttttatatttacaaactcttcactaaattatcagattctcaca

SEQ ID NO: 228064 - DNA, 81 bp, Homo sapiens
gtagcgctgcgacccccgcacccctgcgaacatggcgctgcgagtggtgcggagcgtgcgggccctgctctgcaccctgcg

SEQ ID NO: 228065 - DNA, 483 bp, Homo sapiens
cccggggagccggaccagtgttacccagttgtgggagcagaggcatgggcgcatcgcagctatgtttccagtgtcctctgggtgtttccaaaagcaacaagaaacgaataaatctctggagttggcatcctttgaggaggtagctatgcacttcacctgggaggagtagcaggacctggatgatgctcagaagaaacctgtacagggacatgatgctggagacctacagcagcctggtatcattggggctttgcattaccaaacctgagatgatcttcaagctagagcaaggagcagagccatggatagtagaagaagccccaaacctgagactttcaagtcagttggtgaatactgggcagggaggcctgcaggagtaatgcccagcagattttggtagtgttatcttgttttcaccacttttttccctaggtcgtcaacctgaagactgttggtctcgattaaatgtacattatatagtcc

SEQ ID NO: 228066 - DNA, 514 bp, Homo sapiens
cagtggttgatcgacacagagtgtgtgtgtgggtgaattattctgtgctggctgtgggaaacaggcagtgctagatccttggcaagaatgttatccatgtatagtgatgcccacaccctccaagaaccttttgttctttgaatcccactcctgtgggttgatgttttagtgagactagtgagtagcccagcatttttcttccttctaattcatttaacacacacacgcacacatctatcttctgctaagatgtgtaagtatgagataaatgggaacacaaggatcatattgtacttgagttatatcattgctgacttcctgagaaggctgttcaaatgactagaggatgttaactaaattgacaatgtgtttctctgaagtggaagtgagcaaaacatctgcttttataatagtctgcttgcctggataggcatgtaccgttttgttgttccagaagactttcaagcaaatatactggtgagtttcaatggcttggaacttcctgttttgtgat

SEQ ID NO: 228067 - DNA, 448 bp, Homo sapiens
attgtgccactgcactccagcctgggcaaaaagagcgaaattccatcaaaaaaaaaaaagaattttgaatatgaagtaacatgaaaatagaattcataaagatgagtgtagcaaaacgggagggtgccagctgggaggcaacctcagcaacctgggatggttagacgtagcagggctgttgtagcaattaatattaggtagggtttagtagagaaaggagaccaatatagggaaaagaaatcaaaactcactatctgctccatgcctttccgagcctagaatccaagtgcaattatatcgcaaaactgacagggcttgagggagggtggacctaatgagtaaaatgtgaagcgaaagtgacaggatgactgagggtttgagcctcgggtgactggaatggtgagaaaaaacaattttcagtaaggaagatggaaattcaatagaattg

SEQ ID NO: 228068 - DNA, 303 bp, Homo sapiens
ctaacaactcctcctctgccacttgatcatccctttattgatttcaaaaatgaattacgatctctgtttgctttgtagcttgagcttgttcctagttgtccatcacagaaagcattagcagaggatgctgtggtgcagcgggaacagcttgggttagagggagagagcctggattcaagtccttgggaaagtgagaacatgggaccttgggctggtgagactcaacttcctcccctctgatgtggggtcactaattccaccctgccaggttgtttggaagattaaatgagataaaatacccag

SEQ ID NO: 228069 - DNA, 1017 bp, Homo sapiens
gcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttga

SEQ ID NO: 228070 - DNA, 919 bp, Homo sapiens
ctcagaaacaaagatgcctagctttcaccttgttgatgtttttctaaattttggaataataaatttatataggaatactgcaagaatagtccatttttttctgatgtcccaacatcaccaaatgtatccatcacaagtaggaatacatggaaacattaatgccagccactaaccattcatgtttacccagtagtcccaataatagctttgtcacacaaaaaataaaaaatcagcccggcatggctgtgggcgcctgtaatcccagctactcaggaggctgaagtagaattgcttgaacctgggaggcagaggttgcaagtggcacagtttcagctcaccgcaagctctgcctcccaagtttaaatgattctcctgcctcagcctcccaagtagctggaattgcaggcatgtgccaccattcccggctagtttttcgtattttatagtagagacagagtttctccattgctggtcaggctgtctcggaagcaacacgaaattatgtgaaaaagaaggacaaatacagggaaaagtaaaagagaaacaagaagcacaaaaaaaaaacacaaaagttacaagatagaacagaatggggtatgattaggcaatagcgtacaaaacaacgcacaaacgagtagctagatacaaaagtcacgagagtcacacccacaagacgaaccaaacaagcgaagacaaaaacaaccccacagagagtgagcagtagagaaacccgccagaaatgccagaacaaggcaagcatcacagacaatcgaagaaacaaacacaaacaacacacacaacagacaaacaagcaaaaacaacagcaacaaaaacacagcacgagaaacgaaaacaaacaaaactaacacaaagcgagacacacgaaaaaaagaagacgacaaacagaagaacacacagc

SEQ ID NO: 228071 - DNA, 365 bp, Homo sapiens
gatgtcccaacatcagcaaatatatcaccaaatgtatccatcacaagtaggaatacatggaaacattaatgccagccactaaccattcatgtttacccagtagtcccaataatagctttgtcacacaaaaacatgattatgttggctgggcacagtggctcctgtaatcttcagcattttgggagcccaaggcaggaggatgacttgaggccaggagttcaagaccaggctgggtaatgtagcaagaccctgactttttttttttttttttttttgagatggagtttcgctcttgttgcccaggctgggagtgcaatggcacgggtctcggctcactgcaatctctggcctcccagggtttaagg

SEQ ID NO: 228072 - DNA, 1019 bp, Homo sapiens
gttttatctattcattctacattcattcaataaatacttatttagcatgtgtgggccactcactggacacttcagcttctgcattcttcctaaacaggcatgttaatgtacatgcaaatggggattccacctatacttataagtcaagaggtagttcaagcatcaccttgtcagtgcagctttctccacttccccaaggtccttactccagtcttttgagtctccaagaatttgggggctaaccttttatgtcaagcttaagacattgtattagaattgtattattatgaattatattataattgtccagtttacctagcaagatcttgaattataatttcaattctcattttatctatcacatctttgtatctgtagttttctgtgctcagggtaattcccagcacacaatgtttaatcgaattaataaagtgtaacaatgtccaactgcagtgtgttaactagcaaactggctaagaaatgtagttgaaatatactctctgctgtcatttctcaaagcattctataaatacatttagtgaactcttgcatacaatggaaaattcagtaaccattaaaattatgtgtatttataattgttgggttttaaaatatttattatttattattaaataaggaaggttatagaataggatatttaaaaatattccatttcaaaagcatatgcatgtatattcaaacgcaaatatatctattaatagaggtgagaagggtataaaaatgttggtaatggacccctggttggtagaattatgcataaattttatttcctttgtgttttacaaattttaaaacttttttgcaacagatatgtacatttttgcaataatatcaaaaatagaggctatttccaaaactgcacagataaataagcaaacaaacatacaaaagggtagagagggatattttatcatttgcctatactcttaaagttgcttaaacttgtgtttgtttccttttatctatttttattaaagtaattactggtgactcatatt

SEQ ID NO: 228073 - DNA, 313 bp, Homo sapiens
cagttgggccttagtagcagtcgagttgtttgtgagatgggtaattagaaaattgaagaggccgggcgcggtggctcacatctgtaatcccagttcaagaccagcctggccaacatggagaaaccctatctctactaaaatggcaaaaattagctgggcgtgatggtgcacgcatgtagtcccaactacttgggaggctgaggcaggagaatcacttgaaaccggaaggtggaggttgcagtgagccgagatcgcgccactgcactccagcctgggtgacaaaacgagactccatctcaaaaaaaagaaaaac

SEQ ID NO: 228074 - DNA, 553 bp, Homo sapiens
tggtggcaggatcacggctcaccacagctcactcctggctcactcctgggctcaagtgatcctcctgcctcagccttccctgtagccaggacaacaggcatatgccatcatgcctggctaatttttaaattttttttgtagatataggatctcccaatgttgcctagactggtcttgaactcctggtctcaagccattctcctgtcttggccaaccaattgtgaaactgtgtctggcctgtttaactcttaagtgtagatgtaatttacttcatgaaagagtcagactcagtggcttatacctgtaatcctagccctttgtgggaagctgaggtgggaggattgcttcaggccctgagtttgataccaacgtgggcaacatagcaagacccccccccccccgaccatctctaaagaaaataaaatgaaaaaataagctgggcatagtggtgagctcctgtagtcccacttctcaggaggctgaggagggaggatcagttgaacccaggagtttgaagctgcagttagctatgattgtaccactgtattccaga

SEQ ID NO: 228075 - DNA, 325 bp, Homo sapiens
aatgaacatttctactgcttgatgttggagtgaatttttgatcatgttttagggcagatgttttcaaatttaaaaacaaatagctgaacttggctgggtgcggtggctcacgcctgtaatcccagcactttgggaggccgaggctggccgattgcttgaggcaaggaattcaagaccagcttggccaacatggcgaaaccctgtctctactaaaaatataaaaattagccaggcgtggtggcgcatgcctgtaacccagctactccagaggctgaggcacaagaatcacttgagcctggaaaggagatattgcagtgaaccacag

SEQ ID NO: 228076 - DNA, 1151 bp, Homo sapiens
gggacctagtacctaagaacttcactggtgaatggttgtatgtattgaccatgatcattcccttaccctccttccaaaatgaatgagaagcagagacttttctgtattttttaaatctagcagagtaaaaatactgtataagttccgggattattcaagcttctggttatattttcatatgttaatgttctatgtcaaaaggaacctctacccagtccccactcataatttcatcatccagaaaaaagccagctatatgcttccttaatgagttaagctagataagtgaagcccaatccagaaaggtgcatccttaacaaattagatttccacatttataatccttttgctgaaccaaagagttttgtttcctggagctgtatttttaaagattatgtattgtacatagaataatcatttttaataggattgacataacctgcttaaagaatttctaagagtttttaaagatttttatttgaatttggttggttgtactgtatgtttttccatgtatatatttttaaatttccaactataaagatagaaaatttatgtattgggtggatattagaactatacagttataataggaatgatattctcacagcagatcaatagttgtaatttttaaaaccctacatatatagaaataaccaagttagagtactacaggtttatttttcctgtgattgaccatgtcaatgtgttatcctcccatgtgattttttattgtttccttagagtactttaaaagatgaagaaatgagagactgaaccattgaataatcccaactccaccatttcctaactgagtgactctgggaaagtgatttagcttttttgagtactagctttctcattcatagaaaaaggcagagtaaagtaatatttacttagaggtttgtttcagggattaagttatgtagagagtcttttgcccggtatctgtgaaataaccattgctgcatagacgggagctactgttactgtctctattaaaattaaaggggccttaataaccatttagtcctgaatcttatgtatcattggtatctgtatgcagaattgtacttatcaaatccagtatctgtcttttttttcttttaaatcatgaagtaaaaatgattgaccaaaaacttcggtgtatg

SEQ ID NO: 228077 - DNA, 1439 bp, Homo sapiens
gatgccccaccctgcttctgctcaccctccatgggctgcatccactgagatgagctgggtacctcagttggaaatgcagaaatcacccaccttctacattgatctcgctgggagctggagaccagagctgttcctattcggccatcttgccagccacctctagacagctttaaataaagtgtgttatttaagctcttgtttatcttcatgatcaacaactatttatttagttatgatgtgaaattttatatgactgaacaatgatgatagtttctttcaagttgaagacaggcttcacaaaataatgatcaaaggatgaattaatatcgggtgggggacgttttggtgggatgtaggcatttaagcagaagcgtaaacataataagtgttcaagaaacaacatctcttttaatgtgccagctgctggaaggcaggcttcagtattagcaaatagcttagaggtgaactctggccaaaacagagggagagaggaaaaaaaaaaaaaaaaaaccagacttttattgagcatttactatgtgccaatcactagcccaagtactttaggtatgttgcctcatttaatccccacaaaaactcttaagataaaacagacactttgagaggctactcagctcgtattagcagtcaggatttaaacctcattttgtgagatttcaaagtctaagttgttaacccttgctttacgtcacttaggggagtcctggaccttaactgtgaaaactcattgatgctatatgagaagaaccctgtattcagaagtgccagagtcccagagtaatctctcccaccattttctaccatctgtaaggaaaacccagctctttcagaggcaagatcagcctgctatgaagtctctgaatgactcattcccttaatggcatccgtccccagttggcatttgcataaatcacatcagcacagttggatacttaaatcagcagaaatctggaaaccctgagacctagtagccatctcactagggaacagtgatgtcatctcataaatatggctacaaggagaagggatggggggatggcgttccattgagggccttcagctggccaggaacttgcctactctgagtgaaccttctcagcaatcctatgaggcagttagtgatctccactaaatcagactcagagaggttaaataatctggccaaagtatgaaatgatggagtgagggtatggagtcaggattcaaacccaggcctgtcttcttctttcaactagttttaagactgctgccctgaatagactgaggcatccctcaataacctgatgactgggtggtaccatgcatccttagttttctctgtcccatgagaaacatagatatgaagagagaatgcactaccattcaaatcccctctcgttaatatttttcccttccctgattatcctggggactttgcaact

SEQ ID NO: 228078 - DNA, 389 bp, Homo sapiens
ggtgggaaaggtcacagaatctgtgttgtttccctcgtgtcactctgttccatgacaacgcaacccccaagtctctgtaggtcttggagacaaacactcactccactgcctcccgctgggagtacacacattcccacaggcagaacagcccaggactttgcttttgaccctggcagggccagccctcctaacaggtaagagggagggagaaagccaagccaccaatcccagcagtgggatttctttttttttttttttttttttttttgagacggagtctcgctctgtcacccaggctggatgcagtgacgcgatctcggctcactgcaagttccacctcccgggttcacaccattctcctgcctcagcctcccgagtagctgggacta

SEQ ID NO: 228079 - DNA, 192 bp, Homo sapiens
tagggaagattgagtcaacacttttagaaaacatttttaaaaaaatggtcatatgaatttgtatcagactatcaccagattaagttacttgaggcaggagaatggcgtgaaccccaggaggtggggcttgcagcgagccgagatcatgccattgcactccagcctgggtgacagagcgagactccatctcaa

SEQ ID NO: 228080 - DNA, 473 bp, Homo sapiens
gtgtgacatggattttgcacattctgcctcattttcttatctggggtataactcatggagcataaatatatactgtattacaccccctggtcacctagctttgtcaccacaaccccctagttgatctgggagctcataccttctgtccacagttgagggaatcctgttgcaaaggggtgaatgaatttccagactgggaagccaggccagaaccagggctcctgccggagggaagccacagagctagctggctggtacctggcaggcaggcccagctacaggcattcacctccaaaggagggaagaaatggaagcaaccagcacaggacccaggcaggcctttcctgggcttcttgtctctcttggagcggcctgtttgggagttgggaagtgaccttgtactccagggaccctaatcataaatgtcagatagatattttactgagctgaggggatgccagatggatcttaaa

SEQ ID NO: 228081 - DNA, 504 bp, Homo sapiens
caaggcagtcattttcttgccctgtgggttttgatgaatagacctgttttgctggcagttgtggccatttgctgccttgattgcttttgtggcctttggtgccccaggtagtgcaaagcctacctgaaggagttaggagaagtagaatgaatatcacccccaggaaaccgcggtgtactttacatatgcaatttaaattaccctacttagcaggtggtagtattctacacctgaagacactaaggcggtgaaaggttaaattgcctacagccatgctgctgattaaatgttgactcagggatataacccaggtaggctaaccttgaaagcagtgcttcgtgaaaaaggctgaactgtctactgctaactgtgactcagggacacccgttaagataagttgggaaagttgccctttccactaagcatatatatgtttttttttttttaaaagtcacattgaaacagcaggagttataggaaaataaaaacaaattattgcaaagt

SEQ ID NO: 228082 - DNA, 600 bp, Homo sapiens
agtgagcaaatattcaaatttttggtgttccataaaatgtagagaaggaaaatgtcatagaaaacctatttaatggaataatagctgaaaacttccccagtctcacaagagacagctattcaaacacaggaagttcaaagattcctaaacagatatgacccaaaagatcttattcaaagcacgctgtagtcaaattcaaaagtcaatgacaaagagaatgctaaaaacagcaagagaaaagtgtcaagtcaaacataagagaaactccatcactctaacagcaaatttttcagcagaaacattacaggacaggagaaaatgggatgatatattcaaagtgctgaaagaaaaaaacccagccagtcaataatactatactagctaaccctcaaaaatgaaataatattttaaaaaaaaaaaaaacaaaaaaaactgagggaattcatcaccactagtccagccctacaagaaatgcttaaaaacatcctgcatttgacagtaacaggatgatatctaccatcatgaaaacacacataagtattaccctggtagagcagtcacacaaatgagaaagagaaatgactccaattttaccactac

SEQ ID NO: 228083 - DNA, 650 bp, Homo sapiens
ggtgctagctgaaggcatggcagtggggaggagagcccagggaaaattgagcactaagagtgtcggaccctggtaagcactgggagctgcctgcctttccagaattatttagtttgcccaggttctgggaaagtattcaagggaataaaacccagaaggctactatgtatgtatatgtaaatgtttttgtttgtttttctgagatggagtctcactctgtcgcccaggctagagtgcagtggcgtatcttggctcactgcagcctctgcatcctgagtagctggaattacaggcgtgcaccaccatgcccagctaattttttgtattttagtagagacgggatttcaccatgttggttagccaggctggtcttgaactcctgatctgaagtgatccacctgccttggcctcccaaagtgctgagattataggcgtgagccaccacacctggcctgtatatgtcaagttttaagaacacatattaatctcatttagttgtacataaactgtgtcttagaaggacactgtagaaaatctttccgcagctctaaaaatggattaaggtaatgactaaaaacatttattggtttatttttcatctttaaaatgtttgcatcaaagaaaaataatatggaataaataatatctag

SEQ ID NO: 228084 - DNA, 443 bp, Homo sapiens
tctctctgctctacaaatatttcatttcctgaaatattctatggcagtgagtgaattattattttatcaggctaactctgttaaagaaatttcatataatgattacatgaaaaaggagttgagaagtactataatagttgttaacactgagctagttaaaaaattgtgccattattccttatgtttaaggtggttcttttcaactttgatattttacattgttaaaaaaaactatatgaaatatgtttaatggataaaggtgtatctttcagctgattagttgcatttgtcttgaaaaaggactgaattttgtagatttgaatgataagtcgctgacaggaggtctttaattttttttttccctctgaacagctgtcttggcctgcagtgactccaaatcccataatccttccagttgtcccctccactaagtaaatttcaaa

SEQ ID NO: 228085 - DNA, 827 bp, Homo sapiens
cgggagtctggcagtccgtgcggcagcagtggagcgcagaggacagggccggcctggagcgcttggcgtctccccgaagtctctctgagagctggggaggcggttggcccgctaggtcactaggtcgggcaggggtcttcccccaaacatggaagttttcaccgatatttcgccggtgacattggggccttgtgccaacagactttgctgaagtgaacccaaagttcaaccctccgggagagtccttgcaacgattcggccactcagttctggagccgtcggcactacattctaagttgcggtggactccactggcatctgcgtgactatctccggccggtgtgcataggcgcccgtcgggtcgggggctgaggaccttggacagggcggccacacccctctcgtacagcagcgcctctgtccattctgcgcaggcgcctctggggtcagggacggaggaacccgggcgagtagccacgccccttcacaggtgtcttccctcgaccgctactttcgcccctggcagccaaacacaggaacgctgaaaaacaggctgagaggtggatttgaggaattacatcgttcacttagagttgaactggagaagcattcttgtacgtccttatacctccctgcactctcatcctaaccctgttaggatacaaaagtacgggacagacctactcgtaagaaatactgttagtgttaaatattctgatttttaactacagcaaaaatcgtactgttcaagtcatatccctgagcgttgtgagatgagggccaaagatcaaagcctctggtatttatttggttacagtatttcatat

SEQ ID NO: 228086 - DNA, 94 bp, Homo sapiens
gagttaattagcgtatatggttttggtagggatctaacttcattcttttgcatgtggctagttttccccagtgaatgctcgtggcatccttgtt

SEQ ID NO: 228087 - DNA, 405 bp, Homo sapiens
aaaagaaaaaagaaaaaacctacactgaaaaaacacacatggaactgcaagacagtgattaagaaaaatgtttactcataaactctggtacgcaacatcgatgtatcattaaaaaagtttgtcagtttgggcatggtgtctcacgtctgctatctcatcactttgggaggccaatgcaggtgtatcacctcaggtcatgagttcaagaccagcctggccaatgtggtgaaaccccttctctagtaaaaatacaaaaattagctgggcatggtggcacatgactgtaatcctagctacttggcaggctgaggcatgagaattgcttgaacctgggaaatggaggcagcaataagccaagatcacaccactgcactccagcctgggtgacagatcatgtctctgtca

SEQ ID NO: 228088 - DNA, 1808 bp, Homo sapiens
tattagtaagtccaattaccccatgcagtttaaaaacatagtattaagaatatgtacccataggtattagctgaaaggagtggaaaaaaaaaagttacagacccaaacattaatacttaaggaaatatgctgtctcatgaataatacagaatgatttaggaattcagatgctgactggccatctggttttagtaatcagtgaagactcattaggatagttttcatcatggtcttgaaagataggaataagctcattttagtgtacctgtttgcccttgggatatgtttattagtgtaagagtatcactgatgggaaaagtgtggtctgaaatagggacatggatcgccatcagcaagccaaaagaaaaacatcaagtcaccagttaataatggtctgaagcagcccttctttactcatgtcatttctactgtctcagatattagtgttcctccaactgcaaagtttatttttgttataataaccactagtgttttatccaatatagacgttatggaagtgagaggaagcaaacaagcttctttaaagtgaaaaagggaaagcttgaggggcattctcccagacatcaatttctattgtgaaacactactgtccaatgcaaatgatccttctgttctttcgaagttctctactaatctcctgccttccaccaactccatcatgcatctgaggcacataaaaagatacatgaccataggttaggataataacacactgtgatgacttccctaatttcttataggcaaaccgcttttgaaatgtggctttaggttagtagcacttatgtaagaacacaaagctcttgtatgtctgggaacttctggtataggctgaaggtgaaggctgaaaagaacgaaaattgcttcaagttcaataaatttaaataaaatatgctccgtagaaattaaaatgtataaatcaaatatcatatactttttctgatacgatttcaaagttaacacctatactcatacttatgagtgtaaagaatttacacattttattgcaccctaattttttaaaaaataaatttcattgtgcaactgaggtttacaacatgatgctatggaatatagacagcaaaatggtgaagcagattaatatagctatcatttcacatactttaacaagagctgctaaaatccacttatttaacaaaaatctctaatacaattttactaacattggtccccctgtatctctaaacttgttcatcctacatatctgctattttgtatccttgacctatatctccccatttcctctccttccccaccaccagtagtaaccactgtttcgttctgtgtattttagctccttaaaaaaatattctacatatgagtgagattatgcaatattttccttggtgtctggcttatctcatttaacataacgtccttcaggtccatctatgttgtggtaaacagtaggatctccttttttaaggctgaataatgttccattgtacattgtctatacacacacataaacgtatacacacacacataatttctttagccattcctcacccatcgatggacatttaggttgcttccctatcttggctactgtgaataatgctgcaatgaacgcgagagtgcagatatcttcacaaggtggtgatttcctctcccttgggtgtataccagggacaggtgttgctgtgcacccagaatcttcaaaataatatgtaaatcctacttttgctggtatactgtgaactcgtatttacctaaaaaaatgacattaacagcactctttcaagaaagtaatctgaagagaaaatata

SEQ ID NO: 228089 - DNA, 738 bp, Homo sapiens
tgtctgacctgagcagagctaggaatggtgggggcagctgcatgcgtgcaggctgcctgcaagtgccggactcatcaccagcttcagtcctgagagttggttctgttttgttttctttattctcatcatacctgtttcgtgagccaggactgtactctggtgtactcacagcattggccaccatcatcacagtcaatttacatcattttcctcacctcagaaagaaaccccatactcttctgcagccaccttcctcttccccagcccagtcttctctccctcccccaaccctaggtaatcagcgtcattgtctgtagatttgcctcttctgcatgttttgtgtaaatgaaaccatatggtctcgtgtgcctggcttctttcatgtaggatagtgtttttccaggttcatagttatagcatgtatcaagacttcatttctaggccaggcactgtggctctcacctgtaatcccagcactttgggagactgaggtgggtggatcacctgagatcgggagttcgagaccagcctgaccaacatggagaaaccccgtctctactaaaaatacaaaattggctgggtgtggtggcgcatgcctgtaaccccagctacttgggaggctgaggcaggagaatcacttgagcccaggaggcggaggttgcagtgagccgagatcgtgccattgcactccagcctgggcaacaggagtgaaactccccatcttaaaaaaaaaaaaaa

SEQ ID NO: 228090 - DNA, 282 bp, Homo sapiens
ctaaggtcttcactttggtccgctccccaccccaagctatgccatatataccaagaggtgcctggaacctcctcctggcctcctgcctgagcataggtcaataataaaaggatttaaatcaatacagggtcttgaagttactttgtgctgagtaccctggcatgttcttcattccttacattcttcccagtatcttaccactacaacaacagagctccaggataataacggtgaaccacaattgaacaagctgcaagacacaaaatccatttatgaatctcc

SEQ ID NO: 228091 - DNA, 473 bp, Homo sapiens
atgccatggggatataatcaactgagagattctatgcagtggaagtcatgaagtccgaagtcttgtgagaatcacattctttcatttaaagtatggaattggccaggcacgcctgtaatcccagcactttgggaagccaagctggtctcgaactcctgacctcaggtgatccacccgcctcggcctcccaaagtgttgggattacaggcgtgagccacagagcccagcttaacggtaaattatgaggaccaagcactctttattttctctttcctcagtttaccttctttaaggcattactgcagactaagcctaaaaaaaagtaatttgttttcaaatgatatgatttactctctggcctggatttcaaagatgtcagtataatatggattgtatatattgtttaaattttacaaataacataacgcctattatagaaattttggaaaatacagaaaagtgcaaagaaacag

SEQ ID NO: 228092 - DNA, 619 bp, Homo sapiens
ttatacacaggagcattcattctgaacaaaaactttacaaatgtgaagaatgcagcaaagcctttactcaatcctcatcccttaataaacaagagaattcatactggtgagaaaccctacacatgtgaagaatgtggcaaagccttttataggtcctcacaccttactgaacataagaatattcatactggagagaaatcctacaaatgtgaagaatgtggcaacgccttttatagatcttcacaccttactaaacataagagaattcattctgggcaaaaaccctacaaatgtgaagaatgtggcaaagcctttagacagtcctctgcactgaatgaacataagaaaattcatactgcagagaaaccctacaaatgtaaagaatgtggcaaagcctttagatggtccagaagcctgaatgaacatacgaatattcatattggagagaaaccctacacatgtgaagaatgtggcaaagattttacttggtcctcaacccttactgtacaccagagaattcagacaggtgagaaacatagttgataacatagttgaatgacatttctagtaatatgtttcctttggctttaaacagcaaataaagtgaagaatattgttc

SEQ ID NO: 228093 - DNA, 792 bp, Homo sapiens
gggtggattcaaggagaaagtatagctgcccgtctccaaacagtgcctggcagaaagtaagcattcaataacatcagctattggccaggcaaggtggcttactcctatattcccagcactttgggaagctgaggcagaaggattacttgaggccaggaattcaagaccatcctgagccacatactgagaccccatgtctataaaaaccaaagtgctgggattacaggcgtgagccaccgtgcccagcccaagcgttagttgtgaaggtttattttgttgcaaatcccagtcctgcatgaaaatgggaatgttagtaacccctgcctcaaggtggggcagtgaaaacaaaaaacaccctgggagtctgcagaggtgtgggcctttcccatcccattctttctgctacaatcaaaatgatcgtttaaaaatggaaatctaggttgggcaaggtaactcctacctataatcctcacactttggaaggctgaggtgggaggatcccttgagcccaggagttcaagaccatcctggacatgatggcaagccccttctcaataaaaaaaattaaaagtaacagtaaaaaagtaaacgcagaagcctgagttccccctgcagtcaggtcaaagcccccaagtcttactccaggcctgctaaggcgttcccatccccttcagcttcccctttgggcctctggcttctcactgtctgggctttcgtgacaatgacctttaacccctccgggcaacaggtggttccctcgcctttcagattccctctgcctgggatgctcta

SEQ ID NO: 228094 - DNA, 251 bp, Homo sapiens
ttttgtatttgttatagagacggggtttcaccatgttgcccaggctggtctcgatctcctggcctcaagtgatccgcctgcctcgaccttaaattcttaaatgatgaattttacaataaaaaattatctgtgaggcagggtgtggtggctcacacctgcaatcccaccactttgggaggctgaggcaggaggataacttgagcccaaaaatttgagatcagcctgggcaacatagcaagacctggtctctt

SEQ ID NO: 228095 - DNA, 445 bp, Homo sapiens
aggaactgtgacactaaagatgaaggcctgcagcttcactactgaggccagccagaccatgaacccactggaaaaaatgaacaattgcagacacaccatctttaagaactgtaacactcaccgtgagggtccgcggcttcattcttgaagtcagtgagaccaagaacccaccaattctggacacaataggaccaatgtaaggacacatgtttgttcttataccattcttgctgtatttgtaaatttttgttgcaggagaggtgtgattaccttggatatcttgatagtgggacactttgagaaggcaagagttaacctgatcttagctgacttggtgaattgaataaatcttaccttactatcacaggcagattgaggcaaggtttggggtagtaagttcagtttagaaggtttatttagaataaaattctgaagtccaagcaac

SEQ ID NO: 228096 - DNA, 364 bp, Homo sapiens
gcaatgttgccagggtactccctttgatttcttaactccaaactctttaagaacaaaatgtgggcctgattcacctttacagtccccacttccttctatggccatttgagtaactactctcatccactgaaactgttgccttcaatgctactgatctgaaaaagatcatgaggccaagttagggtccagtgggcaggaatgttgtgattgattattaatgtctgtcatgggcagtgggtagaggacagtagcagtatctgtgcctggaattttccatctttcattgtatatttaacaaatatttgttgagtgaaattcaacaagaatttagaataaagagatcctaggaaaaggctctttgagt

SEQ ID NO: 228097 - DNA, 550 bp, Homo sapiens
cgttatgtatcagtttggggactttcaggtctgtgcttttagcacttttttgttttgttttgttttgagacggagtctctctctgtcgcccaggctggagtgcagtggcgcgatctcggctcactgcaagctctgcctcctgggttcacgccattctcctgcctcagcctcccgagtagctgggactacaggcgcccaccaccacatccggctaattgcttttagcacttttttgggagaggtgtgtggcaacagtaaagctttctacatgttaaacagaatgaacaaaaccaacgcagagcagtgacttcctgtcagagcagaaggagacccttatagaacagctgtgccactgctccaaaggcctcgtgtggttctatcccttggactgcctttcttcaacagcccagacacctgctctgtcagatttataagccacaccccctagagccatgccaatcaaagcatggcccgcagacctgtgccagtctccgaacctctttgttaccgatttggagcaagatggggacagaaattgagagccagagtt

SEQ ID NO: 228098 - DNA, 386 bp, Homo sapiens
atctttttatttggaaaactgtgttagactccaaggtattctctccttcaatgtaacagaagtaaccagtttaattgttcagaacctgacatttatttaatcatgtcttcttagtgttcaggtttagtgtcttcaatgactggatgccaatctgcttcctttttgactttcctaggctcggattcatcagattctctacttgcgtcatttgcaatggaaagaccctcccacagggtagaggttattcattctctctctctctctcagtctccaccacaatttttgccaagagcaagtcaggtttttggtcaagctaggtttttactgcatgctttccttcaactaagtgtgaaagaaatctattaaataatatttaatttggtctc

SEQ ID NO: 228099 - DNA, 487 bp, Homo sapiens
caatgtcaaaactggaacttctgggaagtccacctctgcagcagcatgtgtggtggctaaaagcatggcttttggaggcaacagaactgccctgtaatcctggcaaggcagccttgtagcttcatgatcttgatcaagtcacctgactcttcaggcctatttcctcatttgtaaaaaattcgaaatagggcaggcgcagtggctcccgcctgtaatcccagcattttgagaggccacagtgggaggattgcttgagcccaggagttcaagactagcctgggcaacatagtgggaccctgcctctacaaaaaataaaaagccaggtatggtggtgtgtgcctgtagtccccaactactcgggaaactgaagcaagaggatcacttgagcctgggaggtcgaggctgcagtgaggtgtggtcgtgacacttcactccagcctaggcgacagagcaagacactgtctcaaaataaaataattgaaataat

SEQ ID NO: 228100 - DNA, 776 bp, Homo sapiens
gatctaactagaaggagtgagttagctttggaattattagccatctgaacagccaattttattttattttttggaaatgtaattcacatatcataaaatttaccaatttaaagtgtacaattcaatggtctttagtgtatcaacaatgttatgcaaccactaccactatctaaattccagaatgtttccatcacccctaaaagaaaccccatgccaattagcatgaacaatttttaaaataaacacggtatgggccagaaacacgccaagaaagacaccatgagccccactgagatggcaggggtgacactggggttcaggagctccaggggaagctcctgaatgctggcagtgtggccgtgccatccccaaaagaacctagggtttctttacatgccaagagaaagtgccaagtcttttagcctaagtcctacagggagtaactggaaaacgtactggagcaactggaaatttaatgtaaaatatgcaaagaaggccgggtccagtggctcacgcctgtaatcctagcactttgggaggctgaggcaggcgattgcctgagctcaggagttcaagactagcctgggcaacacgatgaaaccccatctctactaaaatacaaaaaattagacaggtgtggtagcatgtgcctgtagtcccagctactcgggaggctgaggcaggagaatggcgtgaacccgggaggctgagctttcagtgagctgagatcacaccactgcattccagcctgggtgacaaagtgagactccgtctca

SEQ ID NO: 228101 - DNA, 485 bp, Homo sapiens
tgcatgatgaggaggccaaggttgccttctcacccacatttcagtccaattatgaacctttaaaatactccctctcaaactgctaggcatgttgcccctggaaatctttgtttcttccagatttgaccctcttccagcctggcaaaggcaatggctgccactctagatttctgcttgacagacatgacctcaagacctgcagacttgaccaggcatggtggctcacacctctaatcccaacactttgggaggccaaggtggaaggattgcttgaggccaggagtttgagaccagcctgggcaacatagtgggaccctctacaaaaaagtaaaacattagtcgggcatggtggtgcatgcctgtagtcccagctacttgggaggctgaagtgggagaatcgcttaagcccaagagtttgaggctgcagaaagctattattgcaccactgcactccagcctgtgtgacaaagcaagaccctgtcttt

SEQ ID NO: 228102 - DNA, 2250 bp, Homo sapiens
  misc_feature (389)..(389): n is a, c, g, or t
  misc_feature (1394)..(1394): n is a, c, g, or t
  misc_feature (2029)..(2029): n is a, c, g, or t
  misc_feature (2123)..(2123): n is a, c, g, or t
tttttatacatcttatatctctttgcagattacagttctatatttgacttcccataacatgtcacaggacatgtgctttaaatcccccacaagttgttctcttgtggatatagtctaggtcttctgggttgtcccaaaatatgatgtgcacagacacaaacatattctgtatattggttttgattaacacagaatgcagtgggatttccttcctattatcattatatttcccttaatgcagtccaagattatgtattagtgtctaaagaagtataccacattcttaggtcttttagaaagtatcatctgcctctttggactctgggctatctttactaattcatctcaagtattatttttgtctcttcttttcatctaagactaaatantctccactctgctgttctactcagattaatgtatggccatatggcagtagacttctttatacttagtgctttctcaattttaagatgtttgaatattacactgatgcagaagttatttcataagcatagctttttcttgtgtggggtggaaagggaagaggattaaatcactgcctcacttgagcacatacatagctggaaaatgtgtggaaagtttcttgatgttgagaaaaaaagacagtgtcttgttaatcaataaattccgtttatttttcttttactatgtcctttactatatcataactgtagccttgctatatcctgaactcctcacaaaggccttctctgagccaactaaattaatgataaagaattgtaattcttggctgggtgctgtagttcacgcctgtaatcccagcactttgggtcactgaggtgggcagatcacctgaggtcaggagttcaagaccagcctggccaacatggcgaaaccccatctctactaaaagtacaaacattagctgggcatggtggcatgcacttgtagtcccagctactcgggaggctaaggcaggagaatgacttgaaccctggaggcggaggttgcagtgagccaagattgcaccactgcactccagcctgggcaacagagcgagactccatctcaagaaaagaaaaaaaaaattgtaattcttatacccttgctctgcttctttatcattgtgtaattttaaaaacaactgacatatattatacaggtacttgtttattgtctatttctaccactaaaatggaagctccaactgctattagattaatttccctcccaggtccaattttgattatgttactctgaccaagctgatcttttctcttcaatctagaccttttaactaccttcaaaaatacaataaatataattattctagacttctttatgtatgtgtgtgttcctaatttaactgttgtgtaatcacttgatagtataaactgtatttttttagnataaactatttttaaacagctttattgaggaatagtttatgtacattaaactgtaggtatttgaagtgtatgaattgatatgttttgatgttatgtatatactcatgaaatcattaccacaatcaaataatagacgtataaattaccccctaaagcttctttttgtccatttgtaatccatcccctatcctgtccccaggaaaccactgatctgctttctgtcactacagtttgtattttctagaaattggtataagaggaatcgcacagtctgtactgtttggcttcatttacttagcttactgttttgaggttcattcacgttgttacatggcttagtagtatttttttctttttattactgagtggtatttcattctataatttgcttattcattgatttgttgatgggcatctggattatttccagttcgaggtcattacaaataaaatctctatggacatttgtgtactagtctttatgcttttatttcttatgcttttattctctttgataattaactatctgtggaatggctgagtcatatggtagatatatgtttaagtggtaagaaactgcccagctgggccaggcgcagtggctcatgcctgtaatcccagcactttgggaggtngaggcgagcggatcacgaggtcaagagattgagaccacggtgaaaccccgtttctactaaaaatacaaaaaattagccgggcgtggtggtgggngcctgtagtcccagctactcgggaggctgaggcaggagaatggcgtgaacctgggaggcggagcttgcagtgagccgagatcgtgccactgcactccagcctgggtgacaaatggggactccgtctc

SEQ ID NO: 228103 - DNA, 1583 bp, Homo sapiens
gaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagtttttcaagtagcagattaagttttatcccttaggctgctaataaaaaacaattgactgtgattgcgtaattttacctgtcgtacacctttcagaaggcagaggctttggttcacccctctacctccagggcctaaaacagtgcctggaggaactcaattaaacatttgttgagtgaatacgtgaattacattgcagcgaggccaatcttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactctggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaactcaaaagctaacccatttaattattgtactactggacttttatgatagtaagtagaaatctgttgcttaaaaaagaagtttctttggtggtgtgcgtctatagtcccagctacttcggaggctgaggtgggagaatcacttgaacccaggagatcaaggctgcagtgagctatgattgtgccactgcactctagcctgggtgacagagcaaggccctgtctcaaaaaa

SEQ ID NO: 228104 - DNA, 778 bp, Homo sapiens
gaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagaatgtggtgcttagttttagataagttaagtttgtgatacctgttgaatatccaagttgagactctatgagagtctggagttaaggaaaacttttaggctagaggtagatatttgggtcatcagcgtgtaaatggcatttaaaacctttggactggatgagcctggaaaatgcattcgtggatgtggagggaagctggaaggtgtgagcatggatgtgggtcggcagcaccgggacacagctcacttcccggtgattctcttttcttggtgaaatgggaagcaaggtcatcagttgagggtgcagagtgggagaagattctgtagtgtg

SEQ ID NO: 228105 - DNA, 1491 bp, Homo sapiens
gaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagtttttcaagtagcagattaagttttatcccttaggctgctaataaaaaacaattgactgtgattgcgtaattttacctgtcgtacacctttcagaaggcagaggctttggttcacccctctacctccagggcctaaaacagtgcctggaggaactcaattaaacatttgttgagtgaatacgtgaattacattgcagcgaggccaatcttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactctggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaatcaagtggacctctcgcctcagcctccccaagtgctgggcttacgggcatgaaccgctgcacctggcctttgattttttaaattcactttaattatcttaagttctgttatactctagactcttagcaagagtctag

SEQ ID NO: 228106 - DNA, 1949 bp, Homo sapiens
tgggctcaaatgacaggtccctttgaagaactgacagggacttggtcttcccagtgatgtggggtggtggagatgagtcttgacatagtaatggggctcctattttatgagactggtaaattttcacaggaaactaaataacaggttaatgaggggttttaatagaaagtggtgttaactttaatgaggagaaaacactttgtaaaggccaaccaatgcccactggggcagagatataaatctggggtaaggagctgcttctctgctttggggtgtctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagctcttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcagctggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggacgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggctcagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttgtgtgccctgcccagggggtcggttctgagagcggggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcaccatt

SEQ ID NO: 228107 - DNA, 1331 bp, Homo sapiens
cagaaaagagggaatgagggaccagctccagtcacaaatcccccagtggtaaaggacaagagacctgtagcaactgacatgtccaggcagtaggtcctatatttgtgcaagcagatacatcttctgagtaactatcagttactcagagatgacactaacagggagatactttctagatcaaagaagccacaggggctaattagctcatctcaagtgagatgtctgattgtggttcatcctagctcaaactctgattctccgagcttctgttcttggattctgaggcctcactgagacccagattccttccttgctccttctctgacctctagcctttttcctccctacacaactcttgacctcacagagagatgctttggaatccaccctggcagagacggaggcccgctatagctccaaggaagattccttccttgctccttctctgacctctagcctttttcctccctacacaactcttgccctcacagagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttagggagcagcagttcccagctcctgtcagactctctctgtcctaaagttgtcacagctattttcacattgtccacctggacagccaaccaagcattccctaccctcctgggtgagatctgagaatgagaaacaccatgcttcacaaggatgctctccatggaattctccccaggccctaaaatgaatgaaaaaaaatgtgatctgagccacatggggacgtttccatctttccttatggtggatttttaagcatcaagtatccaagggtttgctcccatctgtaatgaaactagctgcgctctgggatacagatggggtttcacttctcactctactgtgggctccattggtcaggtctgggcagcagtgagggggttgaagggatagccccttggactgaaacccagctctgcacagccaagacatgcttctggttcactcaccctccctttttctcctcatccacttcctcaatgcacgtgattaagatcctgctaga

SEQ ID NO: 228108 - DNA, 758 bp, Homo sapiens
tgtgaacactcactaatgccactgtgactgttgagacctaaccctgtccttcaggagctgacttaattcttgattagggctcaatcttaatcaaacacatcttaaattacccctaaaattctttgggactgaatctttttattaatacttcttaggttggtggaaacatttccttggagggattcttttcaaaggctgcccctcctttgcttcctccacagagacctgtacctgacacgaaagagatggacagagtacagggagcagcagttcccagctcctgtcagactctctctgtcctaaagttgtcacagctattttcacattgtccacctggacagccaaccaagcattccctaccctcctgggtgagatctgagaatgagaaacaccatgcttcacaaggatgctctccatggaattctccccaggccctaaaatgaatgaaaaaaaatgtgatctgagccacatggggacgtttccatctttccttatggtggatttttaagcatcaagtatccaagggtttgctcccatctgtaatgaaactagctgcgctctgggatacagatggggtttcacttctcactctactgtgggctccattggtcaggtctgggcagcagtgagggggttgaagggatagccccttggactgaaacccagctctgcacagccaagacatgcttctggttcactcaccctccctttttctcctcatccacttcctcaatgcacgtgattaagatcctgctaga

SEQ ID NO: 228109 - DNA, 2056 bp, Homo sapiens
tgggctcaaatgacaggtccctttgaagaactgacagggacttggtcttcccagtgatgtggggtggtggagatgagtcttgacatagtaatggggctcctattttatgagactggtaaattttcacaggaaactaaataacaggttaatgaggggttttaatagaaagtggtgttaactttaatgaggagaaaacactttgtaaaggccaaccaatgcccactggggcagagatataaatctggggtaaggagctgcttctctgctttggggtgtctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagctcttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcagctggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggacgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggctcagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttgtgtgccctgcccagggggtcggttctgagagcgggtgacccagatggccatggctattgtctccagggcttgaacttggcctctacccaaacttaacccttgtagcccaatcccctctcttcgcgcagagcccaggcccagggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcaccatt

SEQ ID NO: 228110 - DNA, 448 bp, Homo sapiens
caatgccctccagtataaaataaatgagtgggactggggaatcgggaatgtctttcttggctcatgattctaaccggcctctgtagctctctgaagccaagtccctggtgtggctgaccaggttctgtgtgtgtatgtttcagagtgaggagctgaaccagcaggtggtgtccagctcagagcagttgcagtcctgccaggcagagatcatcgagctgagacgcacggtcaacgccctggagattgagctgcaggctcagcacagcatggtgagccccaaggcagggtggagctgcctctggaccaagccgaggagcacacaagctccccagcttccatgctttgaccacacaggcggactccaggggtccatgttcttgagcaccaggggttctctatgcagaaaagagggaatgagggaccagctccagtcacaaatcccccagtg

SEQ ID NO: 228111 - DNA, 493 bp, Homo sapiens
ggacgacaagacattctaaaaccaaatggagataattagattttttttttcaatcaaggagcattacccgtgcatctctatcaggtaaacaagagatggcagtgaaaaattacagttgtttacatgaattattcattgtctcactgggtcccagatgtaccaatggaatgcatggtgaattcatattcttgagcctgaagaggaggtttaaaaattctcctttgcactttttccaagagaaaaaggcatttacagattgatttaaaaagaaaaaaagctcaattatgtttccttctaatataaaggctgacaaggaaagcaaagcaagcaactagaagacatttgctgtgctcttgactttgggaaagaccatgggcaaattatatcacttttaggaaatttaatttccttacctacagaaataaggcatgtgaatcaactgattcagcaggctgtcttcagcaataaaattttgtacttatcaaaaaaaaaa

SEQ ID NO: 228112 - DNA, 746 bp, Homo sapiens
ctttcagtaaataaaaactacattatgattgttttcatatctattatgtttagatcagacgggaatttgtacagtttcattttgtttatggtttctcactttacctttatcctctttgattatctggagtttattttggtgcatgttataaagagagaaaataacctaatttttcctctcaaatatttaaacaacttttaaaagcattttttacaaatataaatttttactttgtccttattataaaaacatttaacactaactgaagaaatgtcagaagtacaggaaaaaattacagcatttttcctagaatctgcataaatatatataagaacactctttgatactcagatgtaaagaaagtgactcaaaaatcctttggtaggggtaatggataaataatttatccaagcaatggaatattaaaagctattaaaaataaggtagatttaaatgtattactatagaactatgataaatgaataaagcatttataatgataccagaaaaactatttgcagtcaacaatttgtatttcacagtaatagtaatgttctcctcatagtctaatgtagcatctaaaaacattactatgaatgttttctaatttgctgctctctttataccaattttgactgacatacgtcctttgtctgtatgttctttaaagaaactgactgcattgcacatgctgtttagttactattattcactaaaacacagtactgttaaaggtatttaaaata

SEQ ID NO: 228113 - DNA, 498 bp, Homo sapiens
cctgtcacagtaatatgccaatttttggtgtcgctttagtaatttttttgggggggactgtcaaatttcagtaaactttataggctatagtttacaatttaaggtctttcctcagttgtctcctaaaaaattttgtggaaatcgaaatttcttttcaattgatcgtcttgtgcagccctttaaaaaatgcgttttgcattcatgtctttgcagtacaaatctgtatctttcattttggaagtgactgtcatagatgggtaatataaagtgacaacacacacaccagggccagattgcgtgggttctagctagggacctagagctggttacttgatttctctctgttccatttactatctgtaaatcatatataataatagtaattatttcatagagttgctgtgagcattaaatgaggtaaaacatgtaaggggcttaaaagtgcttggtacatagtaagtactaggtgtcagctattgtcagttaaacaataaaaaa

SEQ ID NO: 228114 - DNA, 266 bp, Homo sapiens
tttcatgtaatagtcccataaaccctgacaggttcgcattgtcatcccatcaaggaagaggtggagagtcagagaggttaagtaattaacaacctgtgtcacctaaagtgagtggcagggtcaggaattgaaccaggtttgaggaggtcctaactaggttgaactactgaccttcataaaagtttggcactacagaccagctttataggacaaaaaaaccttctttcagagctcctttttctcgccttcctgacagctccctagca

SEQ ID NO: 228115 - DNA, 424 bp, Homo sapiens
aagatggagactctgtcccaaacagggctgcagcgtctcctgagagaggtgaaaatgacctcagaagccagtttctgatgacaggccggacagggaagcagctctcagcctctgcctggggctcctggaacacctgctacctcgactctcaggcctcacccctgccaccctgaccaccccgccccctgcagctgctgaagggcccttcctcttgacttgcagatctgactgtgattgaaaggtagtgtctgtgcaggaaggggaccatcacacaccggggcctgttgtggggtggggtgagggggagggttagcattaggagatatacctaatgttaattgcagcacaccaacatggcacatgtatacatatgtaacaaacctgcacgttgtgcacatgtaccctaaaacttaaagtataataa

SEQ ID NO: 228116 - DNA, 492 bp, Homo sapiens
gttttcctaagatcttccccattgccattccctcccgtcatctctctgtgtcagaacaacattccgtagaatgtcttctttgatgaaaatcatcacaaggtggtcaaggcttgaggggccagcccatcagtcctcctagcctttggtttctgtacaagtcatgagatcaggcagtcgtccagtagggatcgagatactagctttgttactgagaaaggattggagagctctgacttgaggccaaaacagatttcctgctgcccctcccttcccagtggtagacaggatgcctgctgtccgggggcagagctggcagggcccgacgtcctgcagcccgtgagcgcaaggcccctctcccattgcccacaagcaagtctttgcccccatgggctgggagggagggcagggactgccaggtgttgccttgggagtactggggcatcatttcctgggcgacagagggagactctgtctccaaaaaaataaataaat

SEQ ID NO: 228117 - DNA, 566 bp, Homo sapiens
atttggaaaggaaatgtccctagtagagatatttgatttaaattacaaggaatttagttctaagggataatcgacatatttcataaataaatgcagatatctctagatatcaaatgataaaagatcttgagcagtgatggattactgctaatgggtttctgtctgctactctgagcacagttcaggctcaagaactgacatgaagggtttgagaatttagtcaaaatctggaagtaggcaggtggtcacaggctaagagttcataaccggatgcagtcgttgaaggacaattgtgaagaaaaaatgctgatggtgaaacgaatgcaaaaaccacaaacacattgaagaggcctatattcctgggaacaaagaggaaggttatcaatgatgtgcttgtagaaaacatattaatactggaatatggtcttctttcccatcatttcaggtcagttagcttagattactattcagctagaaaaaacaaatgatacccttgcaaggactctgaacaatattggaattcagctgttttgtttctaataaaacatggtttaactgttaatgaa

SEQ ID NO: 228118 - DNA, 230 bp, Homo sapiens
ggtttctccatgttggtcaggctggtctcgaactccggacctcaggtgatccacccgcctcggcctcccaaagtgctgggattacaggcgtgagccattgcgcctggctgactctcaaatttttatctctagcctggaactccaggcttgtgtatgctactgcctacctgacatctcttatatcttctatccttatttcaaattgaacttaccctgtctcctcttccccg

SEQ ID NO: 228119 - DNA, 427 bp, Homo sapiens
cggtatgacacgtacttagaatttacattgaattagttattgtaagctagaaatgacttaaagtatacagtaagatgtgcataggttatatgcaaatattatgccgataagggacttgagcatctacagattttgatatctgtaggggatcctggaaccaatctctcatggatattgagggacaactatatatcccctatttgatgatcattactttaaaagttaatagagcaatatgtaaaagttttagggaagtagctctcagtcctttataagaaggtttcaataatcagtccccttagcaatggattggaccacttagaaagatgctaaggtccatgtcacctggccattttggaggatgttgtagaaggtagagtaaatattggagtatatgatgtttaaagtactcttcagcaacctcact

SEQ ID NO: 228120 - DNA, 568 bp, Homo sapiens
tgggacatatgtgtctggaatttaggagagaggcctggactgatgatgtaaatttggaaaatgttggtgtatagatggtaattaaattagccaggaagagggctcaccatcaaagcagcaagtacagacagcaaagagaaaaagactcaagacagccgtaggcccacaacattcaggatgacttggagtagaggaggagccagcaaagggactgagaaggagtgaccagggaggtaagaagagaaccaacattattaatgttctagaagcaaattgaagaatgtgcaaagaagcagagtgcatcctggggttctgtgagtgtccccaggcctgtgctcctcaggggtgagattcgtccctgctggtgttaagagttcccaacagccaggattgtttctggctcaccgtgcaatcccagtgttgtttttttgttttttgttttttgtttgatgtatactgaatgaaccccagaacagtgtatttctgatatgtttgtttccctttgacagtctgtaacataaaataaaggtatacagtgttcatggttaattttgccagtgagcatgct

SEQ ID NO: 228121 - DNA, 431 bp, Homo sapiens
cctgagatgatgagataatatgttgctagatagggatacaatttccttgtcacagcaactctatttctgtaagagatccaagattttcttcataataaaataacatacagatgcccacacgaagaagagagagaggcaattttacagcaagaaaaattgtcagcatatttgagttctaattaagaaaggaagcatgtgaacaggagtgatagctaagccaggcgggagggcgggtggcaccaggcccacacagcacatttctaaaggaatatggcaactgctgtctatcttgttccaattactatatatcaaataaatggctgcctctatggtgggatgcaaaagaatgttaagaaggcctgtttgcctttctaaaattacataattatatttgtcagaatatgacatagaagtcagttgtttcttcaaat

SEQ ID NO: 228122 - DNA, 239 bp, Homo sapiens
caaatagaatgcaatcctcacagcagcccaatgatgtactgttattatctccagcttacaaacgagagaactgaggtgcagagaggtgacgtgacttaactcatcccaggctttccaggaggaggtctgattccagatcctctgtcatgagacattgcaaagcccatcctcacagccctaactgtggaataacctttccaaatttgcctttgtctgctgttgtgcttgcctagcccttg

SEQ ID NO: 228123 - DNA, 344 bp, Homo sapiens
ctggcacctacttctcaccccaggctctgctctatgggggacgaaggctggctgaaatgtccttcctgcgagacatgaaggtcaaccttggagagctccagggacatgagcattgagctgtccagcagtgtagaaacgtgcacacttctctgagcttctgtgtgtcccgacctgttgttgagtttggggtggaaaaatggtgaccgacaatgaaacaggaacctcacagcctgtcagtcaccaggaaggcaagtggacttctcctctgaggagcagagaggagaaccaactgtgtggcctctttctcaggtttaacttcgttggaataaaagctgcatatggca

SEQ ID NO: 228124 - DNA, 281 bp, Homo sapiens
ttaaggaagcaaaggacccaagatcagggtcaaaggcacgctcctgaccacctggcaccttgaggttacagggggcagcaacctgaagaacaagattcctaggaaggtctatttcctaggaacagatgccactgatggaatacgtgatgttttttgaatgtattgagaagagatttacatttctgatgaagaatttttggaatgaattctcaacaggtaaagaaaaatggataacctgtggtaccttacaatagaacagatatctatttctgcaatgaaat

SEQ ID NO: 228125 - DNA, 411 bp, Homo sapiens
cagtgaattgtttccttaaactataaaggaatcaggtactattgagttttggatgcaagaggaaatgaaaaagctgcccctttttggaatgggaagttcttcagtcactgttaaaactatttggactgaggccgggtgccgtggctcaagcctgtaatcccaacattttgggaggccaaggtgggcagatcacctgaagtcaggagttcaagaccagcctggccaacatggtgaaacccccgtctctaataaagatacaaaaaatagccagatgtggtggcacatgcctgtaatctcagctacttgggaggctgaggcaggagaactgtttgaacccaggaggctaaggctgcagtgagccgagactcgcgccgctgcactccagcccgggcaacagcaagactccatctc

SEQ ID NO: 228126 - DNA, 93 bp, Homo sapiens
cttatttcatttttaattgaattagtaatgacttgataaggcacaaaggttagtctaactaacattttttttttccctgacatacgagtgatc

SEQ ID NO: 228127 - DNA, 397 bp, Homo sapiens
ctcaggaaggtattcatatttatacagacggaaagctgggtggggttgcggacacactcccatagagaaggtggtgtgagcttgtctggcaggccgtgaataactttcatatcaataaggtaaattagtctccagaatatttgcgagatggaggcctagtatctatatgcaaaaaagaggggttctcagtatctcgactgtctcaacaagtcacgggtgtgccgtggcttccggcgtctcttaagggaatggtgctgcagagctcggaccaagaaggttttccagcaaagtcccatgctttgccagttgccttgagcctgggtctgggccctcaagttgaaaatgcactataatgaaaagggagaggtgtcctgaatcagtatcttatatgagagat

SEQ ID NO: 228128 - DNA, 449 bp, Homo sapiens
cggaccagtttcgtggaagacaatttttccacagactcggggagggggatgatttggggatgattcgagaacattccatttattgtgcactttatttctattattattatgttgtagtatatactgaaataattatacaacacaccataatgtagaatcagtgggagccctgagcttgttttcctgaaactagatggttcccatctggagatgatgggagacagtgacagatcatcaggcattagattctcataaggagcatgcaacctagactcctcacatgcacagttcacagtaggatttgctctcctatgagaatctaatcctgccaccgatctgacaggaggtggcactcatgcagtaatgctcactcacctgctatgtggcctggggttggggatctctgctgtaatagagttcacttgtaaataaaaatgctttcctgagca

SEQ ID NO: 228129 - DNA, 476 bp, Homo sapiens
gtgagttgagtatagggcttgattatgagtttaatatctacttctctcactggactgctccatcactgagggcaggtttatctgtcatgttcccctgtgctatgttttttttttgtccctacctaagctcatgttgaaatttaatccccagcgtgatggtattaggaggaaggtattagtggaagatgtttgagtcacgggaaaagatcccttgtgaatgactcggtgctgttcatatggtagtgagttttccatctcacgagatgaattggttcctaaaggaatggatgagttcccttgagagtgggttgttatgaatccaggacactctcaggtttggtccccttcaagtgcctgattcttctttgaccttctcactaggtttggtgcagcacaggagcccccaccagaagctgagcagaggtacagcctacagaaccatgagcaaaattaacctcttttctttataaatcacc

SEQ ID NO: 228130 - DNA, 208 bp, Homo sapiens
gcataataattcacaaactacaaccattttgactcccacttccataagcaaccttcaggttttttttcaaggtaaagtactgtctttgttgtagcatttatggattaaaaacaaatcatttagattgtgtaaaactgtgttgccatttttattaggttcctgtcttatgtgtcattgaagttttttaatgttgtgtcccaacctcttt

SEQ ID NO: 228131 - DNA, 775 bp, Homo sapiens
tattattaaattatcagaagaagtattaagcaagacaaagcatgatgttttgtaatgataaaagtgtaaaccacaatgaaaccctagctatatatctagttacaaatagatatatagtaaattataatagtgataaattcataagacataaactacagaaattcaaagagaaatagaaaaatactaatcgtagaagattttaattcttttacctgagactttgacaggtacaaaaaaataagaatattgaagactaaaataatgtaatttaaaagatagactttatgaacatatattcaaatgctatatcagaatatatcttctttaaagtactcatgcaataatcacaaaatgttactcttacattagattgaaataatgcttcactaatttgcaaaatggagaaatagtgcaggtaaaactctcagacagcatttccacaaaatggaaattagtttttaaataattttaaatctaaaaaccttatcatttagagcatttaaactcttcattaactttctgatcaaataggaaatttaaaagtataggaaatctacaaagtaacagcaacacatatataatcagaatctatgggatattgctaaatcgataaacaagaaagaaaataaatgaagtatccagttctagaagtttaaaagaacaataacactaaggcaaacagatggaaagaatactaactaaaaaaaaatcaatccaataactgattctttaggggaaaaataaaaaactatgtagatgttaattaatctaatca

SEQ ID NO: 228132 - DNA, 539 bp, Homo sapiens
ctgcgttccgctggttgtgggcttcctgtggccgctgagggcgcgtctcccctccgccatggcatcagttttgaatgtcaaggaatccaaagctcctgaaagaacggttgtagttgctggtcttccagttgacctttttagtgatcaattattggccgtattagtgaagagccacttccaagacattaagaatgagggcggagatgttgaagatgtgatatatccgacaagaaccaagggagttgcatatgtaatattcaaagaaaaaaaagttgcagagaatgtcatcagacaaaagaaacactggctagcaaggaagactagacatgctgaactcacagtctctctcagagtctctcattttggtgacaagatcttcagctctgtaaatgccatccttgatctttctgtttttggaaaagaagttactctagaaactctggtaaaagacctgaaaaaaaaatcccgagtttaagcttcagtcctttgaaacccaatggaagaatctccgtggaaggatcatttctggctgtcaagag

SEQ ID NO: 228133 - DNA, 644 bp, Homo sapiens
ctgcgttccgctggttgtgggcttcctgtggccgctgagggcgcgtctcccctccgccatggcatcagttttgaatgtcaaggaatccaaagctcctgaaagaacggttgtagttgctggtcttccagttgacctttttagtgatcaattattggccgtattagtgaagagccacttccaagacattaagaatgagggcggagatgttgaagatgtgatatatccgacaagaaccaagggagttgcatatgtaatattcaaagaaaaaaaagttgcagagaatgtcatcagacaaaagaaacactggctagcaaggaagactagacatgctgaactcacagtctctctcagagtctctcattttggtgacaaggtcttcggataaactcaaccaactgtcaactagaaaatgtttaaatttacctatagcctggaaaccaccactttgagctgtcctgcctttctgaaccaaaccaatgtatttcgtaaatgtatttgattgatgtctcatgccttcctaaaatatgtaaaactaaactgtaccccgaccaccttgggcacatgttctcaggacctcctgagggctgtgtcacgggccatggtcactcatattaggctccgaataaatctcttcaaatatttca

SEQ ID NO: 228134 - DNA, 503 bp, Homo sapiens
atatagaactgaaaataaagacttacttgcatggtcagattatgctattatttccaaatctagatggggagtatactattgaaagagtagaataaagtagctacaactagttaaactcacaaaggattctttcacaggtattgggctaaaaacacagtattttcagcagttttgatgaggaaatcagaacatgggcagtcattctgaaataagaggctcagatatagataatttgagaacctactaaaattgtgtgcaaaattgcatatatatgtacattactctgagtacagggttgtcatattcttaaaggggcaagaatgacctaaaaggggtaagaatgattataattaagactcagcgccagacgcagtggctcacacctataatctcagaactttgggagtccatgacatgaggggtctcttgaggccatgagttagagaacagcctaggcaacacagcaagactctgtctctattttaactaactaaattaattta

SEQ ID NO: 228135 - DNA, 378 bp, Homo sapiens
tgtgggattacaggtgtgagccagcacacccagcctgccattaaaggagctgttcagctcctttaatgggcagtcattctgaaataagaggctcagatatagataatttgagaacctactaaaattgtgtgcaaaattgcatatatatgtacattactctgagtacagggttgtcatattcttaaaggggcaagaatgacctaaaaggggtaagaatgattataattaagactcagcgccagacgcagtggctcacacctataatctcagaactttgggagtccatgacatgaggggtctcttgaggccatgagttagagaacagcctaggcaacacagcaagactctgtctctattttaactaactaaattaattta

SEQ ID NO: 228136 - DNA, 326 bp, Homo sapiens
aaaatgtcataagtcaagaacttggattttaaggcatacctaggaatgaagcaccttagtcctgggcctggtacagacagataatcctgtgtgaagctggaactctcaaagagtggcaccctcagtgaaaggacacatagcaaaaaatctactcaccagcccagagaggtgacaagaaaatacatattttcttgtctatctgtgtgtatgcatgtatgcacatatgtatgtatgtatgtatttcttgtctgtctttatatatgcagaagaaagagttagaaaaaagaatttctgcagagtcattaaaaacccagacctgcttttca

SEQ ID NO: 228137 - DNA, 451 bp, Homo sapiens
atcatccgcttgcctttttgtggcccaaaccagctggacaacttcttctgtgatgtccgacaggtcatcaagctggcttgcaccgacatgtttgtggtggagcttctgatggtcttcaatagtggcctgatgacactcatgtgctttctgggacttctggcctcctatgcagtcattctttgtcgcatacgagcgtcttcttctgaggcaaaaaacaaggccatgtccacatgcaccacccatatcattgttatattcttcatgtttggacctggcatcttcatctacacgtgccccttcagggctttcccagccgacaaggtggtttctctcttccacacagtgattcttcctttgttgaatcctgtcatttatacccttcataaccaggaagtgaaagcttccatgaaaaaggtgtttaataaacacatagcctgaaaaagggcaaaaa

SEQ ID NO: 228138 - DNA, 483 bp, Homo sapiens
tgttttatttcatccatcatttattgagaaggcctggaaaggagaaatgattcatgtgaagataaccagacaggctttattttagattccatgaaaacagtgaaactttacattaaaacattgcacatctgagtgagtgtttcacctttatcttgagtgactttttttagcacatcattttcatattttaacatgactagaagcataatccagaaatttgttgttagcagtaatgcatattgcttcaagatatgctttagaatctcaacttacctttcttacatttttttaaaaaacatccgtttgaatgaaacatgtttgatcttgaagcacattaattcttttctcattcatttagccatccagtcatcatagaacaagatactgttttaatcaaccttttattgtgggtactgcacctttaatgaaacttgggttttgttttcttttccatgtgtgtattttctaggtattgttaaaatg

SEQ ID NO: 228139 - DNA, 330 bp, Homo sapiens
ttgcgtcccttacaatcctgtcttctctgactttccctctgcgttcatcctccagttccttcactcctccccgcccccaccccgcaattccatccccatcccacctcgtccccagttccaatagtctcatccagggagttctttgttttctcattcaagggaaattctttcccctcaagtccaacgcctacttcgatccacctgtcgtccccctctagtccctttcgccacccgggttcttcacccttgagctccatctcctccttagtttccatctttcccctttgaatcccatactcctccagctctattctccctccggcgtctctc

SEQ ID NO: 228140 - DNA, 168 bp, Homo sapiens
tagggcatgcagctgatgggagcagaattggagaacttcttgggatggagaaaaagccccacacatttgctgtcagaagtattgtgtgagcgaagagaaacagtctgttttctccagatggattgcctaattctttccggccatataataaagagttattgctggtca

SEQ ID NO: 228141 - DNA, 465 bp, Homo sapiens
atttgggtaaggtgcacatttgtgtgtggttttgcatgcttgtgcctattggcctggggtcagagagtaagggctaatgttgcctaagttctatttcccacttactgctttaggccactggccagctgttccttctgggctgttgccactacatgtaggtaagagtgtggttacattatagagcagggcttcttgagtttgacaaagcacgaatcccaaaatggggcataggctgtaattctgatttttttccacattcaagttatggcttttctacagttgataaaacatttttttttaaattgccaaacatggatattttgataggttgcacagctccagtttgcataattctgaattatgttagtgtttcctatttggcttactgttaagcttacaaataataattagaaattaattagaaataattttaaatttctaaataaaatgttttagtttgagtca

SEQ ID NO: 228142 - DNA, 691 bp, Homo sapiens
gagagcagcttctaggaaaacaaaattaagcatcttctctcaccaactttaatgcatcatttttacatactatatttaaatgtttgtatatttatgctgaccttgatactagaaagatttagtgacttagaaaaatgctgcgcaagttagaatttttaaatggagagaaaaatgagagtaataaacataagcttaagctataaggaagactaaaatatatgctgtaacacgccaggtgtgttggctccctcctataatcccagtgctttgaaggccgaggcaggaggattacttgaggccaggagtttgaggccagcctgggcaatacagcaagatctcatctttacaaaaaaatagaaaaaaaaatggccaggattggtggtgtgcatctgtagtcccagctctttgacaggctgacgtggaaggatctcttgagcctgggaggctgaggctgcaatgaaccatgatcacaccgttacattctagcctagacggcagaccaagaccctatctttaaaaaaacaaacaaaaaacacaagtagaaaagttggattttcatagcagcagggatattttttctgttgcaacaggaatgaaagcagagggtatagtaaattctagaagctgattatagactaattctacattttccttctattaaaaaaggcttaaagaaaaaaacggatagtga

SEQ ID NO: 228143 - DNA, 584 bp, Homo sapiens
ggcatgaacccaggaggcggagcttgcagtgagccgagatcatgccactgcactccagcctgggcgacaaagcgagactctgtctcaaaaaaaaaaaaaaagtcaacaggcctttggcataattttaacatgatttcctctttattgagcacagaacaagattcaaactgtcttacatttgaacttgtcaagcttaacaaaaatataagtacattacggagagcttgctatgtgaggcacgagggcacagttctgaccggctctcagctgagtctcacagtgacctctgaaacttatttcttctacaaggttttcttttctaaactttaaaaagttttcctttcaggctggccatggtggctcacgctgtaatcccagcaccttgggaggccaaggcgggaggatcacttgagcctaggagtttgagaccagcctgggcaacatagtgagactccgtctctacaaaagaatcttaaaaattagccgggtgtggtgtcacccgtctgcagtcccagctactcaagaggctgaggtgggaggatcgatgagcccagctgagatcatgccactgtactccagcctgt

SEQ ID NO: 228144 - DNA, 283 bp, Homo sapiens
aaaagcaaaatgttatttatcattaaatattaacaatataatcacattttcttgcatctctggcaagtttcttggtacaacaattttaaggaacagactcttagttttttttttgagatagagtctagctctgtcgcccaggctggagtgcagtggcacgatttcggctcactgcaacctccgcctcccgggttcatgccattctcctgcctcagcctccagagtagctgaggcaggagaatcacttgaacccaggaggcagaggttgtggtgagccaagatc

SEQ ID NO: 228145 - DNA, 352 bp, Homo sapiens
cgtctcttcaggaagctctcacagaggaccgcaagaggcacagtatggatgctggtcacaatattaattgttgggggcaggaattggaagtctgtatggggaaggtaagtaaaatgtgaaaatgtgtagtgattcaaagtaatggattatatgttcacatagcaatagggaacttatcatttatatcagttaaaatacatgcacactaacaatatatgccggtcaagaacacatacaaggctggatgtgatggcattacaggcatgagccaccatgcccattctgttcagacaatttataaaattatacttatttactacaaaagttaataaatataaaaagagagaccaaa

SEQ ID NO: 228146 - DNA, 355 bp, Homo sapiens
atcctcttcttgtcctttatggacagagcagagatggtgtgccatgcacttttcatatggacatctcatccttcccttggagttttgggttcttgcatttgaatttgacatatatgtatccaacatttcatttacagctcatgagaaaggcactgtatttagatgtattggtctgaattgtctgaatgatttaagaccataatacttcatctatgataggtgtttaatcagtaactgatgatgcgttaaggttttctgaaaagataagttcagaatgtctgctctttgttgcaggtttcctggttttaagtcaattttattttattttttgattttggataccaatttaacaaaa

SEQ ID NO: 228147 - DNA, 346 bp, Homo sapiens
gatatgactgctactggacataagatttcttttgaaaatgatgaaaatgttctgaaattagtggtgctagtttcataacttgatgaatatactaaaaaccactgaattgtacactttaaaatgatgactttttggtttgtaaattatatttcaataaagctgttattttagaatatttaattatgtttttactagctctggttcatttacgcctcactgaggtggtactccagaagaagaaatctaatggagcaatgaatgatagccaagatggggtggggtgtccgagtggttacccccgggtacagacgataaaggagtacactgtctatacgattgccattta

SEQ ID NO: 228148 - DNA, 215 bp, Homo sapiens
gcccttttcatggaccccaggccctttcctgtttctcccagaggaggaagtccaaggcagggtctgcatctccctcgtctttgcaagccccacaacagctctcctggacagtgtctaaactaaaacttcttggctgtttagtctggttatacgtgttacaaattccccatttcctgtggggttcacagagagctacaaaattatagtaatacttc

SEQ ID NO: 228149 - DNA, 373 bp, Homo sapiens
gggcaaagaggagcatgttgggttccttcctctgttggtgtgatttcattgtatttcagagcagaagcactaagctgtggtcaaaaagcaactattgctcaggaaataatacactccatattttgatcatgcaggctgtttgtattatagttatttttgttattctttgcatacctttatccacctgtgcttaaggaaggatcctcatatgttcatactgagctgttggaaatctatgcaagacatttatttgtacaagtctcttcaggtaaaataatatatttattgataacattttctggcgatctgtttattttaatggtatgctttcacaactatcttaataaagtttgcaagctgtgtactttaataa

SEQ ID NO: 228150 - DNA, 442 bp, Homo sapiens
ttccctataggaggcagattcggaagtctggcctacgactcttttggaagctgaaactaattaaaatattcatttttcgcctctgtagctaagacccggcaggggagatagcatttgttttatgaaggtgtaactatatccactaacctcttgtgtgccacattcggcatctgccccaaggctgccacacctgctcaaacacctgcccagtatgtgagtatttggtagaacagtttttaatggcttacctaagggcacctagggtcacccacctttacctgaggacaatagagtcttgttccacatatttattacctatacactcacctctgagtgaagtactttcctggtttcaccttcagtgagatctgaaaagctatgcaaaagacaaatagaaaaagagaaagagaaagagaagttaaaaaatagttgtgtgtcatta

SEQ ID NO: 228151 - DNA, 602 bp, Homo sapiens
ataatcattagacttttttagatctgttggtgtgatcagttgtattagcagttttcctaacagtgaatcatccatgtctgtatgtatagaatagtcactcgcttgcttactatgtgtgaagtttttaacgtgctgctggatctttggggtgtgtgtcgtggcacacacatgagtgcacacatgaggctggtttgaaggtttcccttttgcacatacgctgtcttcatcctgtttatatgccaatgttatgtttgtctcataataggaacttagaactttccttcttgtgctgtgatctagagctgtgctgtgtagtaatgtagcctctaaccacgtgtgattattaaaatttaagtgaactaaaattacatgcaataaaaaaactgttcagtcaccagtagcctcatttaaaggacagacgtggctagtgcaggtctagaacgtgtccatcactgcggaacgtactgagacttcctgcgtcggtggaaacattccgtcatctacaccggccagtcctgtagcaacggcctaggtggtttttgaacgtgtgtgtgtaggtgtgcccacacgcataggcatgtggtgagtgtgtggggtgcgtt

SEQ ID NO: 228152 - DNA, 201 bp, Homo sapiens
aaagtgcttgcaaaacctggtggaattcgctaaggcctctggtttagttggtttagttaacctcactgtaccaatgtccacctcctggtgccaaccagtgaaccatggaaaggtggatgctgtcattgagggaagctctgcaacccccacgtgagtctaaaattatttcaaaaaagtttagaaagtgtgaacaattgtatt

SEQ ID NO: 228153 - DNA, 242 bp, Homo sapiens
tgaatttctaatatgaattctagaagttggaaaattggaagagcctttgaaattgttcagtccaactcctatttccagaacccaataaggacaataaaaggaacatggaattttgagatcgtaagatttttattacttaatcctgtgcctagaacatttcaataaatgtaaattaatctaataagaaaatataccaaaatgtatatttaaattacctttaaagtttctttacacatacctta

SEQ ID NO: 228154 - DNA, 401 bp, Homo sapiens
catttcttccttccttccttccatccgttcctccatctgtccatcggtccaccttctttcaatggtctcgctctgttgccctggctggagtgcggtggcgcaatctcggctcactgcaccttacacctcctgggttcaagtgatcttaccacgtcagcctcccgggtagttgggactacaggtgtgtgccaccaccctgggctaattttttgtacttttttatagagacggagttttaccatgttgtccatactgatagtaggacatttcttaagttaattttctaaatcactactttgttgtgtatttctctacttaattctatttggtaattttagtagtttttctcctccccccaagcatttgttctctgctattttattcagagctctttgctctta

SEQ ID NO: 228155 - DNA, 674 bp, Homo sapiens
gcaggagagagggattccaaaagggcatcaggaaacttctaagagtgatgaatatgttcattaacttcattatataggtggtttcatgattatataaatatatcagaacttatcaaagtatacacttttatgtagtttattgtatgtgaattataagtcagtaaagctgttttcaattttttagagaaaaggaattattaaactataagagagtaacactgagggagacattacaaagggacaaacttggaagagagcctgaggctgaaattcagttttcactggagcaggtgtggttgcagcacaccaggtaacagagaatctcactgggttgaccagaccagagctggtccaaggttgcccggtaaacaataaacagcccactggggtgctgatgggtaggtgtgcagaggcagtcagggcacagctgcaggcaccaggcctggaatgtacaacatctgcatcaagagggttgctggaggcggggcatggtggctcatacctgtaatcccaacactccgggaggccgaggcaggcggatcacctgaggtcaggagtttgagaccagcctggacaacatggtgaaaccctgtctctactaaaaatacaaaaattagccaggcgtggtggtgcctgtaatcccggctacttaggaggctgaatcacttgagccc

SEQ ID NO: 228156 - DNA, 895 bp, Homo sapiens
  misc_feature (811)..(811): n is a, c, g, or t
  misc_feature (853)..(853): n is a, c, g, or t
agcggggagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattnacaaggtgaggtggtatcatgcttggagaaaggcctggtganagaagcagaagaaagagaacccaagattcaagtttctgaact

SEQ ID NO: 228157 - DNA, 511 bp, Homo sapiens
ccattatatagttaaacagtggattccatggagttatgaaaaagaagcaagggttttctgcccctttggaagaacagaatatctgctagatagcctctcaagatgagaagtgaacctggagattgctcaccagctgctttcttgaagccaaagctatattaattacagtattttctcatgtcatctttggcctatgagcttgggtatctagttcatctaaataatccaaccaagagttgtttccttacgcattacttggagttaatttgagaaccagtatacaatacttgagtttgatagaatttcccagtctaattttttttcttccctctcattccaataatagaggaattatatcattctcacaggcccagtgaaaaaatgaatgacacacagcgtttattgctttctaggtcttgttgactttaagagagagaataaggatgtgcaccttttccctggtcacttgataaaatgcagtgacattgaggtattgacttttttttccaaa

SEQ ID NO: 228158 - DNA, 358 bp, Homo sapiens
ttttggggggaattaggtcatgaaggcagagtcctcatgaataggatcagtacccttataaaagagaccccagactgggcgtggtggctcacgcctgtaattccaacactttgggaggctgaggcaggcagatcacgaggtcaggagatcgagaccatcctggccaacatggtgaaaccccatttctactaaaatataaaaaattagtcaagcgtggtggtgcgcacctgtagtcccagctactggggaggctgaggcaggggaatcgcttgaacccgggaggcagaggttgcagtgagccgagatcatgccactgcaccagcctggtgacacagcaagcaagactccgtctcaaaaa

SEQ ID NO: 228159 - DNA, 549 bp, Homo sapiens
tggcaaagagactggggaccctatgatgccacccctgagccatgtgaatgctggctttggaagtgggacttattctgggtcttgaagaaggggcaggatctggggaggagaagcgacttcaggaatgctggggaagcagtgtgactccaggtgtggaggcttggaggaaagcagacctcagaagcctggaggaaagagagaagctgcctaaaccttggccaagccaaagcagacggcctcacaagatcaagatcctctcttgcttctctagagaatgtgctccatcaaaaagagagaataaaccaagaagaggaagacagaggatccggaaacagggatgatggtgcacggaagtcccaggatgacagctgtgcatcaggccttcagcagccaggatgggagcagaaggatggggagctctgggagtgtctccaagaaagaaaaagaaactgatcaaatatctaatttttaaaacatattgaggggaaatttatacttctgcaataaattttaggatatcgtaatagaaactaagaaaataacaaataa

SEQ ID NO: 228160 - DNA, 379 bp, Homo sapiens
ggcgttaagaaaccagcttgaacaacatagtaagacctcatctctacaaaaaatacaaaaattaggcctcacaagatcaagatcctctcttgcttctctagagaatgtgctccatcaaaaagagagaataaaccaagaagaggaagacagaggatccggaaacagggatgatggtgcacggaagtcccaggatgacagctgtgcatcaggccttcagcagccaggatgggagcagaaggatggggagctctgggagtgtctccaagaaagaaaaagaaactgatcaaatatctaatttttaaaacatattgaggggaaatttatacttctgcaataaattttaggatatcgtaatagaaactaagaaaataacaaataa

SEQ ID NO: 228161 - DNA, 428 bp, Homo sapiens
caacatatgtgaaaaacaaagagttaatatcctcagaaaatgcactcacaaataaatatgaaaaatatcaacatttcaatcaaaactggggaaaagatatgaatagacatttcacaaagaatgaaaataaattgccaagaaatatataaaaatatgtccactttcacttattagtgttataaaacacagaaaatacccagagctagtgagaaagtgtgtgcaggaataggcatttttgtacactgctggtagatgcataaattgatacaaaaaagatacatttctttatccatgaaataaagagggtagattaagtaatctctaagattctttcaagatctaaacttctaaggatctgtatttctctgagttgtgtcaatgatgtattaaaggatgtagcaatcaataaaatatgtttttgtagaaat

SEQ ID NO: 228162 - DNA, 363 bp, Homo sapiens
actgccactgaggctgaatgcaccctcattcccggggaacatgggcagagggccagtcggttgtctgtttcatgacagaacaatgttcctatgtactggagctttggacaaaaagaaaccatcatgggtactcaatgtctgaccctcattatgtagccattgagaccctctgcccacctacaaaaacaaattcttaagagtaaatgtaaaagaaataatatacgtatgtataatggaaggcatacacacaaatgtaaatacataatggataatggatatcctattggataatagacatgttcaggtaatccctaaatttaatcgatagttttaactttttttcacccattgataacaaaacaa

SEQ ID NO: 228163 - DNA, 717 bp, Homo sapiens
ggtggtctcgaactcctgacctcaggtgatccacccaccttggccttccaaagtgctgggattacaggcgtgagccaccactcccggcctgaatctttcttgatcagatgtcttctgtctatccactctggctctgtctactcccttcccaacacatgccctattttaggtaaccatggtagttttgttttgttttgttttgcttttgtttttggagatggagttacactcttgcattccagcctgggcgacagagccagactccatgtcaaaaaaaaaaaaaaaaaacctgggatccctccacccccctctcctttaaatgtctgtcttggctactttcttctaagtcactaggagatggtaaaagcaataccatgagacttccgaggctagggcacgaaaggatggcttctgcgtggtgctccctctctcccagatcccttgctctgtaggaaaccaacccccaaggcctgaagacacccaagcagccccatggagaggcccatatggagaggaactgaggcatcccacccccaaccggcagctcggggctttgaaaacagatccttccgccccaggcaagccttccaatggattgcagccccagccaatgccttgaactgccaagttcagccacacctaaattcctaacccataggaactgtgagagataataaaagtttgttgttgtttcaagccactaagatctggggtaat

SEQ ID NO: 228164 - DNA, 308 bp, Homo sapiens
ggtggtctcgaactcctgacctcaggtgatccacccaccttggccttccaaagtgctgggattacaggcgtgagccaccactcccggcctgaatctttcttgatcagatgtcttctgtctatccactctggctctgtctactcccttcccaacacatgccctattttaggtaaccatggtagttttgttttgttttgttttgcttttgtttttggagatggagttacactctgttgcccaggatggagtgcagtggcacgatctcggctcactgcaacctctgcctcctgggttgaagtgatgctcct

SEQ ID NO: 228165 - DNA, 402 bp, Homo sapiens
gtcaagttcccatcacattcgcccatgaggctatcagtcaagttcccatcacaaagccatcacttacagagccttatgggctagaaggtggagctcacctgctccctccaactgggacttcaaaaatagtcatctgtgagaacgcaaatggacagccacttgggaggacagtctgcggtttgttttcatactgaacatactcttaccatatgatctggcaatcatgctccttggtattcacccaaatgagttgaaaatttatgtccacacaaaacatctgcacacagatgtttacagcaactttatgcataattgccaaaacttggaagcaatcagatgtccttcaataagtgagtggataaagtatggtatatccagacaacataatactattcagcacta

SEQ ID NO: 228166 - DNA, 576 bp, Homo sapiens
  misc_feature (3)..(3): n is a, c, g, or t
  misc_feature (39)..(39): n is a, c, g, or t
  misc_feature (79)..(79): n is a, c, g, or t
ccnaggttaagggattcccggctaagcttccccagtagntgggactacaaaagttgccaccatgcccgggtaatttttngtatttttagtagagcggggtttcaccatgttggcaggatggtcttgatctcttgacctcgcgagccaccgcacccagccatattggaacactttaatcacctcccaaagcaatgccatactcattagttgtcgcccctaacctcccctctccgtgtcctaggaaacctccttttcttccaaaaattttagcacgtattttcatatgttagtgtgtagatcaattcaaataatagatacaacaaatactgtaatatgttgtgtaccttgtaattattccagctgtatcgcagaaatattttataaatttaatagggctgggcagttttttttggaaatgcttgatcatttgcaagtactacatgctcttgaataatatattttcatttttagaaacatttagaatatttagtgtacaacccctgtctcccagtaattctgctgcccaaggaaatcagttactttattttttcttttcatttcttagctatagtcttt

SEQ ID NO: 228167 - DNA, 251 bp, Homo sapiens
acagttttttttttctcctgaggacagtctcactctattgcccagactggagtgcagtggcatgttctcagctcactgtagccttgacctcccaggctcaagcgatcctcccacctcagcctctcaagtagctgggactataggcacgcgccaccatgcccagctagtagttcacgttttaacagagtacattaaaaactgaatttccccttcataatttccttttttgtactaacaataagattgtaaat

SEQ ID NO: 228168 - DNA, 455 bp, Homo sapiens
gttggtgaggctggtctcaaactcctgacctcgaaagatctgctcaccttggcctcccaaagtgctgggattccaggtgtgagccaccgctcccggcctattccctgcttcctttattgagccatgccaccttcctcagttggattttggtatcaataaggatatgaaggttttggtgacatatttctaaataagaggctgtttccctaggatgcagaggttggtgacaaatgtcagcttttcagttctttcactcaagaaggatctgcaacttgaattcagcaggtttggtcttcagtggggcctggaagtggaagggatgtggtggtgtccacttggtttctgatcaccttggctctttcacggcctgactctcctcttccagtgaaaacctgctatgccttgagcttcagaggacagaggtccaggtggttgtttggtttggtctttttaac

SEQ ID NO: 228169 - DNA, 399 bp, Homo sapiens
tcacatctggctctggagtgctcagtggggctggtgaagtatagaccaaaatatccattttttcaagttccattcagaaatattttctgggccacatgcagtgcctcatgcctgtaatctcagcacttttgggaggccaaggtgggaggatcacttgagcccaggagtttgagactagcctgggcaacatagggagaccccatctttacaaaaataattaaaaatattagcccagcatggtggctcatgcctgtggtcccagctatttgggaggctgaagtggaaggatctcctgagcctgggagggtgaggctgtagtgagctgtaatcataccactgcactccaacctgggtgtcagagcaagactgtctcaaaaaaataaaaacaagaaaaatatt

SEQ ID NO: 228170 - DNA, 328 bp, Homo sapiens
tggcctagtactcttatgtgaagtctaccaagcttgtgctcaagggaaccaaggcgaagaatttgcctgaggttgactgtacatacaaatattgagcatttcctcctggtctccgtgataaacagaggttttgatattgttaggcgagatggaaagaaagtatcaaggagtgagctgaagccactgcccttgagaaccctctcgaggagtctggcctcatgaagatgccagaataaatggcaggtatatcctgaatgaatgtgagatttttactctgtgaatttcctgtgaggagtgtaagaagaaaaagaggaaagataagaagaga

SEQ ID NO: 228171 - DNA, 4395 bp, Homo sapiens
  misc_feature (153)..(153): n is a, c, g, or t
  misc_feature (319)..(319): n is a, c, g, or t
  misc_feature (1472)..(1472): n is a, c, g, or t
  misc_feature (1712)..(1712): n is a, c, g, or t
  misc_feature (1714)..(1714): n is a, c, g, or t
  misc_feature (2206)..(2206): n is a, c, g, or t
  misc_feature (2952)..(2952): n is a, c, g, or t
  misc_feature (3147)..(3147): n is a, c, g, or t
  misc_feature (4210)..(4210): n is a, c, g, or t
  misc_feature (4266)..(4266): n is a, c, g, or t
acaaggcggaggaactcccaggcagccaggctggcttcggcgtgtggaggcgggaggggcacagccaggtgcgagggaaggctggcatctggcgcccactgcctgcccacccgcccgcccgcccgcccaagtaggtctgggcttccctgcctntaataaccatccccaccgcagaggaacggaagctagaaacacaccggctttggcatttcaggcgagtcgagggtggattatcagggcatttagaagaaggggaagggaagaaaaagagcgctggagaccgggagaccacacagggagacagtgcacagagctgccncagccatctgccgcgacttcatatgccgccccggaaactgacagacactgcttcagcaaggcccagcccgtcagatgagtcaatcaatcaaaaaaattcttatgaaacttaatcatagagggtcatgttagggagtggggaacagattaaattaccacagtattagatacgggaaatgatttctgtcaaaaccatctttactgcaattataatatgttaattatgtatttcattaagtaagtggattagagtctgcacagatgaaatcatgtggaggctttgaatcattcgccgagcacggtgggaggacttctgtgaatggatctcgtttaatttggaaaacttttgcatgcaaaatgtgatttttttccccttcttttgtgaccctggccctcagcctcagtggagaaaacgcccgggttgctgagaggagaatctgctgactgcctcctccatgctctgaagtcagcccgtgaggcccgtgtgctgggagccagtcccgggctctttctgtcttgcttctttcagcttgcagtgggcaaagcgatgctgatggcctgcaagggggatgggcacctctgggtgcctgctcatcttctagcacaattaggcaaagtcttcatgaggttcaaaaccaaaggacaaccagtgcatcaagaagacagccagggtaccatatcctggtgcatccacgtgtcttctggccacatcgcatgacatgcatctgcccttttcatttggcctttggggataccctgcccactgggaagacagctttaagaagctcagtggagtcccttgcaagggagatggctgccccactacgggcaggatggcccacagcgcacggggcagacacaatcagattttttgcagcacatatttcaggccagctcttcaatcctctctgccattgggccctgctgtttggtaaaagggctatttagccacctggtttccaggtatctttttttgtagttctgaagcaaggaatgggcgttgggcacacctgtaccaccgaagtccccttgggccaccatggtgtggtctgtccctccatagatggaccctagtatcttgtccctgctcatcctcagaatctaagctggacatcaggagcctgcccatctcagcttcagttcaaggcaacagnggccaccaaggagaagaccttccatatctctgcaactcttctattcttcttggcttctgaagatcttctgggatgtaaggggcagttgagtcataaacgaaataagagttaatagttattcttcagaaagaggaggtatccagtgcacatacatttcctgggtccctaagtattccattatcagtaataaccacagggaagttttgacgaagaggagaaaagagaggaggcaggcggacngngcctgcttggagtgcatggcagtgtaagtgacgggaaaaggttggctgatttgatgaaaaccccatcagcctctctagggagatattactttcctcattattccactgattggccttatttcatctgaagaatgctgtacattctttacaggcctggcaagcttctttaacaatatccagaaaaaaaaatctatcacctccttaatagaaacaacaaagaaattaacatgagccatcttcttccagggatcagtagagagacctggcctgatcccctttcttctgacctagccacccagtcttcaacccccaaaattatcaaagaaattgtttaaacgttgtacacataggatggttgagggaggagcttcttctactatatgacagcagctgaggatgtttcataaattccataaggagaacaaaggctcaagtctggatcccagcatccccctttgcacagaaacaaaatctcgatgtgattggatggtncaggaagaactcagttttcagggagagtctgtctcgatgcaagagaatcagtttcgtccctgatgaaacatagggcttctcttcctagcacaacaacagagagggaagaacaaaaatacactcgtgaaattcaggctgagactggcgttatcaatggcctggagcttgcaataactattaattaagtgcattttttcattattctttagcaaagaggtaagatttaatgatgtaagctaacaatggatgataatttaaagtggtgacaatagtttaattattcacacacacacaaaagttaactccataacttatttctttgtgagaacaagttcatttaaaatattttgaactgtgcatacaattatcacttaaactctttccttcatggctttgtagagacaaagagtcaattctccctgtaaatttctcactagacagttctacagatgaagaattctgcttaaaaaaaaaagaaaaagaaaagaaaaaaaatcgcaccattgggttttgcctagaatgtcctaggtctcaggaatgggatggatggttccatattactgtgtctttccattccaataagcaggaaccaaactcatgcaataacatgtgtatatgtgagcgtgtgtgtgtgtgtgtgtgtgtgcatgtttatgtggaaggtgcttctgttttttgtcagcccatcccagaaagctcgtttttccttttcgctgactattcagagttggagatgctatatgtgnaaggggtgaggtgggaggattgccgcttcaggggtgattagaaaagaaaggaagaagaataaataaatactgtaagtggaagacatcctcttgagttcacagccttttcatggctttgagacaatataattgtaacatgactgagtattcaagcagctggacctcaccaaggatgttcaggagtgccagagctcnagggccctgggaagagccagtgtcattgcagggagctagagttcctgattagggatggagtagaaccttcacgattatcctgtcatggaaaaatgcagaatttaaccatgtccagtgcccagtccattcctgatcctaacttcctctgtgcttccttgctgtgaaacacctccactgttaacagcagctccagggaccttacagaacccaatggagaggcatctgaggcaccatcaccagacccatgccttgaatggaagcaactcaaagtcccaatggacccaaagtcatgaagccatgattaggaccacacagtgcaagtattcagatggatattttataatatcaaatatataaatggatttgtcaagccaacaaatacttgaatattgttaagcatttgaataatccaatataacaacttcatttaggctgtcttttagatgactcatttctcagtgtaattatctcactggatggtttcatggatcaggaactctggttagaatcatactaatcctgccattggagttcagctgtttactacggttgggtgttgcataaagttgatgataccgtgtgacataagatactgatgtataaaggccagttttctaccatgattactgttcgtcaaaaagatgtttaggaaaaaatataacatggcactcaggattcctactaaaaaatgtacattctagactataagtcttctaaactctggtgaaacattctacaaaagagaaagactatgtgtaaaattaattccctctccttcatcttacttatagagaaaggagtggaaggacagtcatttaagctgagaataaaatggattgcagttttggcagaataagaaactctatgatcatcagatggtgatgtctgattggtgtttgataaatatcatccatagtttgttgaacagacatgttctcactatttaaaggtactccacataccacgtagttgctatcacttgacttcttgttttattttgtattatcataaattaaactttttgttgttgttaacttatttattgtcttccagagcaagagcnttgtccttcttgtttgctatggtaatgcgggcctaaaacagtgcctggctcagagngagtatctaataaatatttgttgagtaaatgactaaatatgtgcttaatatggttgttgactgttaggtaattttccctcccttagtctagtaagtgtgttgacataattcatttaataaagagattac

SEQ ID NO: 228172 - DNA, 505 bp, Homo sapiens
tgtgaatcttatactctagtatgggatgaggggacagataatacacaaagtatacaaattagatgtgtgtgttagaaagcaagtcctatggcaaaatagagctgcatacgtgagattgggattgtagggacaggggaattttaagtagggtggacagagcagggtaggccttactgaggagtcttttgaatgaagacctgatggaagcaagaaagagagtcccacggaaaatgaggggaaaagcattctagtccgagggagatgcagtgcaaaggctctgaggtacacacctacaaaagaaagcaaggaaggctgggctcagtgtctcacacctgtaattccagcactttgggaggccaaggtgggcggatcacttgaggtcaggagtttaagaccagcctggccaacatggtgaaaccctgtctctactaaaattacaaaatttagctgggcgtgttgggaggcaccagtaatcccagctattcagtctcaaaaaaaaaaaaaa

SEQ ID NO: 228173 - DNA, 370 bp, Homo sapiens
tttggctttactggctaaaatagccagttcctgcttattaatactcaaacacatcaattattcatctgcacttgggtatattacacacgccgaatcatccatcctcctgccctctttgttaaaggaggctttgaggccagcagccccacggggaaggcgtatagttgggactcagggctgactcagagggccagccctggccagctcatgtctgaggtcacatccgagggagaggaggcagcagagctgagtgaacagaatcttgttctaacaacttcccaggctccacactgccttgccatgctgagctgtccatgtgaggtcagggatttgtcaagatgaagggctagacctttgagggttttgctct

SEQ ID NO: 228174 - DNA, 560 bp, Homo sapiens
actagaagcccagggagatctgaggaaagggagggcttttctgatctctcccaattagaggattaggcaattggcagcgcagggcggtaactctgggcggggctgggcgccagggctggacagcacagtccctctgagctgcacggagacctcgcaggcccccggaactgtcgcccttccaggatgtggctccctgctcttgtcctggccactctcgctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctga

SEQ ID NO: 228175 - DNA, 357 bp, Homo sapiens
gtgagagattggtaacatggagacaatttatgaggctctcttgggaacccaagtgaaagctgttgggggtcaagggggaacaggaatagagagaaagggaaggatatcagacggtgttgagatgtgattatgggacttggaaactccctgtcctgcacagaaacttctccacgttcttacccttttcaccctccttagccccacctgtctttaactaaacttggctttcccttgacatgcatgacatgcattctgtgtttgagcagtggctgcctgctctttctttttttttttttttttttgagatggagtctcacggttatttggtcccgggtttcggacctcaatttcgtattt

SEQ ID NO: 228176 - DNA, 752 bp, Homo sapiens
gtgagagattggtaacatggagacaatttatgaggctctcttgggaacccaagtgaaagctgttgggggtcaagggggaacaggaatagagagaaagggaaggatatcagacggtgttgagatgtgattatgggacttggaaactccctgtcctgcacagaaacttctccacgttcttacccttttcaccctccttagccccacctgtctttaactaaacttggctttcccttgacatgcatgacatgcattctgtgtttgagcagtggctgcctgctctttctttttttttttttttttttgagatggagtctcactctgtcacccagactggagtgcaatagtgcaatctcagctcactgcaacctccgcctcctgggttcaagcgattctcctgcctcagcctcccgagtagctgggattacaggcacatgtcaccatgcccggctaatttttgtatttttagtagagatgggatttcatcatattggtcaggctggtcttgaactcctgacctcatgatctgcccacctcgacctcccaaagtgctgggattacaggcgtgagccaccacgcccggcctggctgcctgctccttctgcacatgcttccctgaaatattttgggggccagggttgctactcttctatatctccaataatgtttcccattcattgtttctcatgcctgcttctgaagttctagacatgtgctttcaggctcacatctaactataatgcactgttatcctc

SEQ ID NO: 228177 - DNA, 509 bp, Homo sapiens
cagttaactcatctgtaaaatgagatgatcactcctcagaagtcatacgcaccaaaagagacatggtttgctgtggtaaatgtgtaagtcatttctatgtacaacataccttatccttattcctgaccccatttcattttcctttcctaaatttctatcttttcttattcagcttttaatctagttgtaactaaacatatattatgtatccctgcaatctacctgaagtcctttctgaaaccgcagaaggccatcaaatcaacaggggaaatgacacatcatatagatcgtgtaccatcacatccatagccagcctgctgtgaggtgccctataaatattatttttcccttcaggcaccgtgtttattttgatacctgggccagtcactgagctccagttctgttcttcgagcatcacagctgcctttatggaataataggctctctaagtcccacggttttatggtttatctaacaacaaaataaatgataaaaatattgtaactagt

SEQ ID NO: 228178 - DNA, 182 bp, Homo sapiens
gcctctcccatatagctccatctggccaactctctctgtctgagtgactttcactgactctctttctctcgctatctcactgtcttttctatcttgctgtctcttgtggtctctgcttctctctatgatgatctgtctctggctctgtatgtatctccctcacttctttctctgtcccttgc

SEQ ID NO: 228179 - DNA, 208 bp, Homo sapiens
tactcaaccccagggggccttggcttgtaggatttgtacattcgctgaggcaaaaatgggactgtcgctgcagggagctggtggccagggccttcaaagcacctttggcccactgtgccctgcagccactatgttgtgccctgttgatctttaaatttctctaaatgttggaatttaattaaagtccacaaatatttgtaagtatcca

SEQ ID NO: 228180 - DNA, 233 bp, Homo sapiens
cagagagaaatacaagcgtgccataaaaatgccagaaaaatttaaaaccagagtaaaagtcacactgagagatactttggtaagtctgaaaagaaataaacaacactgggctgggcatggtggctcatgcctgtaatcccagcactttgagaggctgaggcaggtggatcacctgaggtcaggagttcaaggccagcctgagcaacatggtgaaaccctgtctctactaaaaa

SEQ ID NO: 228181 - DNA, 993 bp, Homo sapiens
ctcatcctcactaacttatcttttaagattaaaaataatgtaaccaagtgggaagaaaaagagcaaatatgaacaaattgtcattgttttagaatctgcttcttttcctttccggtatttctgtgcaaggagagaatgatctctgaccttgtgaaaggcaaataccatgtgtattcatggttgttattcatttggcaacgacttgaaactcatgacactccctgctgaagatcctccacctattcttaacagctgggctccccagctcctggatcaccaaccagtaccagtctgtggcctgttaggaactgggcttgtacagcaggagctgagcagctggagagtgagcaaagtttcatctgtattgacagctgctccccatcgctcacatacattaccacctgagctcaacctcctgtcagatcagcagtggcattagattctcataggagcaagaaccctattgtgaactgcatgtgtgagggatctaggttgcgcactccttatgagaatctaatgcctgatgatcggtcactgtctcccatcacccccacatgggactgtctagttgcgggaaaacaagctcagggctcccactgattctaccttataatgaattgtataatccttttgttatatattacaatgtaataataatagaaataaagtgcacaataaatgtaatgcgcttgaatcatcccaaaaccatcccctgcttcactggtccatgtcttccacaaaaccggtccctggtgccaaaaaggttggggaccactgtttaccaggatgcatagcatgggtttatgaattccctatctttgcagcacatcctttatttctggcttgcatgggacttgaaagcctaaaacaactaaatgctaagaaaaattatttttaaaatgatgacaaaaatattttctatttcagatgtatagatctgcaatccagaaactatgaatttttttcagttgagtagtctgtttgccaaaaaat

SEQ ID NO: 228182 - DNA, 135 bp, Homo sapiens
atggtatgcttgtagcttttccttagatgaaaatttcagagtttgttcagtctgataacactcaagcataactgaacacctcatttagttataacctcaaatacttctttatcttgaagatgatcaagggcaaat

SEQ ID NO: 228183 - DNA, 563 bp, Homo sapiens
ataattatccttgttcagtttcattgagatgatttcggtgcctcataccaattttccaagctcagaagaatcccagaagcatttctcagtctcaggcttcctggggcaaggcagatattcctttgggggttacaacagcagcacagtactgacgtttcaccaagttctctttcaagtagtccccctggaaggctgtaatataaacttactcaaacaattaaggcatagttcatgactattttgcttcttgtctttatattttcttcactacctccatatatcattgcacctccttgaaaagcatgttctgtggctgtccaattatcactgaattttactcatatttacaattcgtatgcctggaaatgtaattttccgtaaacatttatgttcgttatggtttttatgccgcaggttttggaccagacagtaaacattaaaacagttgattttataacagatatggaaactgtcaagctgtttttcatttgtttattttttgagatggagtttcccttgtcacccaggctggagtgcagtggcacaatatcagctcattgcaa

SEQ ID NO: 228184 - DNA, 375 bp, Homo sapiens
cactagggtgctctgtttatttgttcaaattctagttgagttcttgactgatgtcttatgatcatgagtcaagaaatgaagaaattccacattctcatgttcatattatttgtttataaagttgaagttggaatgtaggctttatagttaaactgctataaagtttatatagttaaatacacaattagatttatatagtttatatagttgaacctacctccaactgagtgacttgcaaagtacttaagtcttctgtgattaagatttaccaaatttgtaaaacaagaataacagtagtatatacctactttataaatgagttaatactttctagaacatagtatttgccagaatgttacctgtatacagcacatg

SEQ ID NO: 228185 - DNA, 514 bp, Homo sapiens
ataatagtagtcatttattgaatattatgtgccaggcacttgatataggtgctttccttttatcaatcacttaattcttcaaaacgaccttatgagataaggttgatgattcttgtcctccattatggcataaggaagttaaacaacataccccaagttaaacagatgtaaagtgatataccatactgtgataaagacacaggcaggttggtgtcagagatcatcttcttaatcacggtgatacactaacaagttataaactaacaagttaacttaaagtggtgataatactgaactgctgtgaggagaactatgatgacactgttacctataacctgtgatggtttgtacttgactagggttttgtcttatagcaagacctccattctttccgtaagtggtgatgtctcttaaatgggcctgccacggccttccttggtcctccctgtggaaattctccccttttcccctctccttcccttctgctgacctgttctcagtggtgtgctggtta

SEQ ID NO: 228186 - DNA, 372 bp, Homo sapiens
acataagattttatgagactaaggggaagcaaaccaaaaaattgtttatctccagagaggtactattttaaagaaattaaaaatgagggccaggtgcagtggctcatgcctgatatccagcactttgggaggccaaggcaggtggatcacccgaggtcaggagttcaagaccagcctggccaacgtggtgaaacctcatctctactaaaaataaaaaaaaattagctaggcgtggtggcaggtgcctgtaatccaagccactcaagaggctgaggtgagaggatcacttgaacccggggggcacaggttgtagtgcaccgagatgatggcattgcattccagcctgggcgacagagtaactccatctcaaaa

SEQ ID NO: 228187 - DNA, 444 bp, Homo sapiens
ccaacgtcaatatgggagggaactagcaagagcacggatgctggaaagtctgacttactgggacattaatggaaacatctatcacacatgactttatgattccactgctaattttgatgttggttattggtttagaggagggattctttatcatgccacgtgagtactttcttgtttaactcaggaatgaaaacgtggttaccatctttacctgtaattctgtgaaaacactgactacctcagtattaaaatgactgttaatctaggtgtgtttatgaatttcctttgtccatgcttgccagcagttattacaatgtctgagtttccctgtgggaggactgcctggggccaggagtttgaaaccagcccgggcaacatggtgagacctcatctctacagcaaataaaaataaaataaataaaatgtctgagtttccacattgcc

SEQ ID NO: 228188 - DNA, 2507 bp, Homo sapiens
  misc_feature (1051)..(1051): n is a, c, g, or t
  misc_feature (1415)..(1415): n is a, c, g, or t
cttataatgagtttatcaggacataaccccatcatcagtcaaggtgctcccatagtatggaatggctggaagtggggggtagttaaaaagagccatgtgggctgggcgcgatggctcacgcctataatcccagcactttgggaggccgaggtgggcggatcatctgaggtcgggagttcgagaccaggctcaccaacatggagaaaccccgtctctactaaaaatacaaaaaaaaaaaaaattagctgggcatggtggcgcatgcctgtaattccagctacccagctacccagctacccggctgaggcaggagaactgcttgaacctgggaggcagaggctgcggtgagccaagatcgcgccattgcactccagcctgggcaacgagcaaaactccgtctgaaaaaaaaaaaaaaaaaaaagaaaaaaaaagccatgtgtgcgaagctaaaggagttgggctttatctagagtgcagtgggtgaaggtttgtttgtttgaggcagggtcttgctctgttgcctaggctagaatgcagtggcatgattatggctcactgcagccttgatcttctgggcttaaacaattctcccacctcagcctcctgagtagctgggactacaggtgtgcgccatcatgcctggctaattttttgatttgtcgtagagatgaggtctccctatgttgcccaggctggtctcgaactcctgagcttaagcaatcctcccaccttggcctcctaaagtgctgggattacagatgtgagccacagcacctgactgccctgaaggttttaagcaggaaaataatgtgatcaaatttggcatctagagagatcactgtgtctgcaggatggagtatgtcctggaatgaagaggtcagaagcggggagactagttggactagtctgcacaagaaatttggtgagatgcgacagtggcttggaccaaggaatgacaaaagagtatgaggacaggagaacagaaggagagggggaacaagctaatgctaaaatttatatagaagggggcagccaagatggctgaataganacagctccactctgcagctcccaccaagaaggatgaaaatggcaagaattctgcatcttcaattgaagtaccaagattctctcattgggactgacgaggcagttggcatgacccatggagagtggggaaaagcagggtggagtgagggtctacctgggagctgcatagggcaaagggagctccctcccccaggcaagggaggcagtgagggactatgctactcctccctgaaaaccatgcttttcccacagatccttgtaacctgtggataaggaggtcccctcatgagcccacgccaccagggccttgggtgccaagcacagagctgtgcagaatcatggcagctgctcaggtgggcggctgntcgagtaggcactgagacacgggagtttttgcatactgtggctctgggaactcaagtgaggcaggagatccatccactccatgggaagggggctgaagccagggaccaaagtggccgccctcagtgggccccaactccctataagctaaaatgactggcttggaatacccaccagttcagcaggctggagactgccctaaagaccaagttccgggcggagaggggtgaccaccatcactgtggctccagtcagctgttttcccctgctgcaggtgccagtaagactgggcattttggacagggagcaattccccacagtgcagcacagtggctgggatagtttgtggccagactgcttctttaagcaggaccccaatccactcctcctcaccaggcaaggcctccctgtgggaattgcagcatccccagccaggtgtttatggacagaactctgatatccctgagaggagcccctaggaggaggggtgcctgcagtatggtggatcagcagtcttaatgttttctgcctgctggctctggtgagtcagggcagcccggatgagggggattccccctaatgtagcacacctgctctgccaaggggcagccagactgcttatttaagcaagaccctgatcccgttcctcctgactgagtgagatgtcccaatagagttcgccagacacctcatacaggagtgttccagctggcatcaggttggtgcccctctgggtcagagctcccagaggaaggagcaggctgccatctttgttgttcggcagcgtccactggtgataattccaggagtgggaaggacccagggaaatagcgtctggagtagatccccagcaaatggcagcagccctacagaagagggacctgactgtgaaaagacaaatagaaagcaagagcaacaacaacatcaatgaaaaagaccccacaaaaaccccatttaaaggtcagcagcaggctgggcacggtggcttacacctataatcccagccagcactttgggaggccgaggcaggcggatcacctgcggtcaggagttcgagaccagcctggccaatatggtgaaaccctgtctctatt

SEQ ID NO: 228189 - DNA, 517 bp, Homo sapiens
aaaggcctagaaagaattagataaaaatgatagcaggagttctttaaagatatcagaattcttggtaatttttcaaagctttcaagaaagtccttcccacctttttcacacggagaagaaaaaaaaaatcagtaaaaatataacaaacctctcatacatcattggtcataagccagaagcgattctttaaattggattcagccaatgctgagtttataatcctagaaaatgtttgactctctttctccatccaacagatatgatttaaaataacagtttcagcaactcttctcatcacgcctcttaagacaatttctcccaaacttgatccagggagacctcctctggagatgagagagaagttcagtttggagttcaaaccttaagcagtgtctgaacgactccaataaagaaaaactgtcttttaaaataccttagttagcgtatctctttgcatctagcttacgccagccaagctagaggcaacataatcagctacactttatgaaataatgag

SEQ ID NO: 228190 - DNA, 299 bp, Homo sapiens
cagaatgaataccagagccctttaagtaaaaacttcctttaatctgttctctgcagcccctatttggtataccaagtgttctagatacctgaaatacacctgtacgtggctacttaaggtaaatttctttctaccgtagaacagagggcgagtcagctttaggcttcatcagcccagccctttcatttctctaaggaaaggtatcaaggtgggagctgacagtctaatgttacttcctaaatcagaattcagtttgtatcctttaataaacagcttgtcttgctgcatctcctcaatga

SEQ ID NO: 228191 - DNA, 250 bp, Homo sapiens
aacagcctctcccagaccaggaagctgtttttattttaacttcatgcaaatgttgctaatacaagatatattcatttttttaacttacccttttttacaaaaaagatggttctgaaattgaactgtatttaatgtctttaatggtgaaaaaaggaaaagtcatagatgacatgtcattattttgtaaaataataagatcatggtctggtactcactttggcagcacatataataaaattggaaagatcat

SEQ ID NO: 228192 - DNA, 361 bp, Homo sapiens
tggcacctggtatggcagtgagaatgctgcacacacgtgcacaccaggcctgtctcctttccctgtggtgcttggctggcgtacatatctctccttcccctgcactgggcaggtgggtgggcatggcgtggatctcccagccctggggcgttggctgtgatggactctaggttgccctacttgaccttctatgctcttgttcttgccttgatagctgggcagagaccccaaggcccatggggatgatggaagctgttgggtaaaagggaagtgaatcacaatgactgtttggaaaaagccttcctttgatccacattggattgtgatgtgaggaagaaataaacctttattatattccact

SEQ ID NO: 228193 - DNA, 414 bp, Homo sapiens
ggttatataaatctttacgtaacaattgctagaaccacatgaaactgccgaaattcagttggcccacaagaaagagcaatttcataaggttttcagggtgatgaggtaggaagaattataataaactaagcacactggctcacacctgtaatcccggtactttgggagaccaaggcaggaggatcatttgagcccaggagttggagaccagcctgggcaacatagcgagaccctatgtctaaaagaaaattttttttaattagctgggtgaggtttgtgcacctgtagtccccgctatttgggaggctgaggtgaaagatagatcacttgagcccagtaggttgaggctacagtgagctgtgatcacaccactgcactgtagtcttgggccacagagtgagaccctgtctcaaa

SEQ ID NO: 228194 - DNA, 456 bp, Homo sapiens
caggccagcccttgcctatcaactaagaaccaaaaatgagcttgtgctcacacacaggcatgctcccagctttagagagaaagactggttctcaggggtcataaactcagatggctgcagggccaggcttctaatgtaatgaatgaagtggctagaagggagcttggaggaatcagagagctagaatcttgccctggggcagtagacacttggctaaggggactgctgccaggctggaatgtgaaaattgcccccatcatctgcaggggagcattaagacatgtaaaagaactcagaaatctagttgagtcctgacactttacttccaaatggaatttgaccgggagaagctcaagatgtgctccagatcaccctgggggtgagggaggcagataagtcagcagagacaaagctaaaaccacccctctatgcccccacttttttccatccagtgac

SEQ ID NO: 228195 - DNA, 423 bp, Homo sapiens
agaccttctcagagcacaagaaaaagttttcagataaaagacccttctcctcacaaacaagcatccagaaaaatgaatgaaaattactccaaaaagctacattgttaggacatttcagaacagtggatacaaaaagaggattctattaacttgggccaggaaggagatgttctacaggtagtttgaaatcagaatagcattggacttcttttttaaattgcattatttatttattttttatttgtttgttttctgagacagagttttgctctgtaacccaggctggagtgcagtggtgagatcttgacttactgcatcctcccccctcccaggttctagcagttctcctgcctcagcctactgagtagctgagactacaggcatgtgccaccacacctggctattttttttttcttgtatttt

SEQ ID NO: 228196 - DNA, 441 bp, Homo sapiens
ccaaaggtataagcaacccaagtgtccatttatagacaaataaataaaccaaatgtggtctatacatacaatggagtattattcacccttaaaaaggaaggaaattttgacacatgctacagcatacataaaccttgaggatattatattatgctacatgaaagaagccaatcacaaagacaaatactatatgagtccacttatgtgaaatatctagaatagtcacattcatagaaacctaaagttagaaagtagaatggtggttgtcaggggctagaaggaggggaatacggagagttttgtaataggtatagagttgtagttttgtaagatgaaaacttctgtaggttggttgcacaagaatgtgaccacacttaacatcactgaaatgtacacttaaagatgataaattttaccttatgtgtattttaccacaactaa

SEQ ID NO: 228197 - DNA, 479 bp, Homo sapiens
tgtaatgggaactggactgtgggggtaggtgtggagctccccgcttggggctcagctggttcccaggagagctagcgtgggaagcggcctggaaacgggtttccccaggtgtcagcgccagagctggtttcccatgacctcacctggtgggtggagcccctcccctccacccctcctttctagagcaccatgctcagcactggagctcaaggtcagtccccagccttctaacttttctgctctgttccttctggcagttcacagggccctggggctcaggttaggggaccatccccccctccgacctctattcacagcctgaacataaagggaacccatacagcctaaacctcaatcactggccaaagttcttagacttgggttggacccagtcttcagccttggcacctaaggagctagtgaaggtcagggtgctgcttgtgaacaatttaaatagaggtttatccccaagtatcctg

SEQ ID NO: 228198 - DNA, 469 bp, Homo sapiens
tgagggctgcagcatccctgcgggggctcagaccggctggaccgtagcgtagtttctggccccggctagctggcgaccgtgggcctcagtaccctgtctgcggggtggggcgatgcgaacctacaccctgggatgggggtgcccgcccagggcagtgctgtctgtgatcttgccatgcccagggcacccactccatgacgctggctgtcggtgctttccaggggcacagtggagtgtgtgaggaaagacccctgcagacggcctccggcgggcttcgggcagctctccctggttggggtcccagggtcttcagggaagccccaagtcctggtcctgttcatctttgtgtctctagtggacaacatgtaagaaatgctacttaagctgacctgttagcatatgtaacataatgccgggaaaagagctgtggctgaattgaatgatttcttaaattgattttatattgtgt

SEQ ID NO: 228199 - DNA, 332 bp, Homo sapiens
actgttattattctgaccttaaagataatgaaactgaggctcaaaatgatttagcaacttgcctaatgtcacacagccagcaaaggacagctggaatccatgctactggctgcagagtttatgtttttaacctccatgctgttctgaatatctcttagcaaagctggaaagaatgaagcccaggaatgtaaactgactatataaatcacacaaggccaggcacagtggctcacacctataatcccgacactttgggaggcagaggcaggtggaccactttagcccaggagttcgagaccagcctgggcaacacagtgagaccctgtctccac

SEQ ID NO: 228200 - DNA, 325 bp, Homo sapiens
ccagccagcagacatttgtttttatctggtactaggaacttgactccagggaactatcccatgccccacaactaaatggttctgggagagctaccaatcaccatgtccatttgtggtcatgaggaatggcccaggatgaccatgccaggtttgtccgagctctttactaggactgggcatggtattaaaaaggtgaagaccggccgggcgcagtggcgcatgcctgtaatcccagcactctgggaggccaaggcgggcggatcacgaggtcaggagatcgagaccatcctggctaacacagttaacacagcgaaaccctgtctct

SEQ ID NO: 228201 - DNA, 601 bp, Homo sapiens
ggttttgttttatttctttgaagaatgtcattagtattttgatagagattgcattgaatctgtagattactttgtttaatatggatattttaacagtattgattttccaatccataaacatagaatatccttccatttttttatattctcttcaatttcttttatcagtgatttatagtttttattatagagatctttcaccacttttgtaaaatttatttctaggtatttaattttgtatgtttctattgtaaatgggattacttttttgaattcatgttcagattgttcactgttggcatatagatatgctactgatattgattgattgcttgagatgggatctcactttgtcacccaggctgggttgcagtgacagtcatggctcactgcagccttgagcttctgggctcagtctgcccacctcagtatcctgagtagctgtcactacaggcatgtgccactatgtccggctaatttttgtgttttttatagaggcagggttttaccatgttgcccagctggtctcgaactcctgggttcaagcagtccacctccttatcttcacaaagtgctgggattatagacatgagccatcatg

SEQ ID NO: 228202 - DNA, 492 bp, Homo sapiens
agtagagacaggatttcaccgtgtcggccaggatggtctccatctcctgacctcgtgattcgcccgtctcggcctcccaaagtgctgggactacaggcatgagccaccgcgcctgggcagaaggtagcattctttccagccattctatgcagctctcccttggtttcccctgccaagtgcaaagagacacaggatctccatgcatgaggaaaaccccaggcccttgtttgctctgttctgcttcctgagctggcatttctcagtctgttcttttttactcatcaacaaaagtattcgagccaaattctcttgtaatttcagcccaggtgtgatcaacatcaagttacctttccatttggcccaagaagaagttataacttccttgcataagctcatctgttatcttaatcctttctggaacagggaaaatgtaaataagtattactctatccctctcttaagtttttcaaattacagcaggtggttgggaaa

SEQ ID NO: 228203 - DNA, 414 bp, Homo sapiens
ctcactggggccttcttctgcctcactggctcctgcaggatggcccatctgccagcttggtgagcccacttggagttagaggccgagtgtatgttgaggcctgctttccaggtgatggtgccctcatctgcatgctcatttttgacctgggcccaaatagacaaaccctgagcattgcagaggaatccctgggctggcacttggtggcctgggctctgggctctgctgggccctggtcacctgcaggtttggtccctggaaggtttggccccatctccagtatgtagacctgtcctggggtctgccctaactccgtgggctcctctctgcacatgcttggggtctggagagaggttgggcaggagtttggagctggccaagtactcacgtcaccatagcccactgccttcagag

SEQ ID NO: 228204 - DNA, 606 bp, Homo sapiens
ttgtaaatatactctttatattcttcctctcctggagcagctcaataatttggtgaaagttatggggaaagtttgataattgccagagccctcaggggaagtcccacctattagactgagttttgaattttttggagacaagcaggtaatatgcaggaatgtatctatggcacataacaaaccactccaaaacctagtggcttaaaacaacaacagtcctttatttttgcttaggaatctgttatttggggaggtcttaaaaaggaatcacatctctgttccacattttattgtcaggaatggcttgcctgggcctgggggatccactttcaaaatgtctcattcacatgacggcaccttggggctggctgtaggccaggagctcagctggggatgtgagccttgggcctcagtttctggctgtgtggacttctccatgggctgcagtcttctttacagcgtggtggtcggatttcaatattaaatattccaagagaactgtacgtatattgcattaccttttaggacctagcctcaaaagccatatagcattattttcattgtagtcacaattctgcccagcatcaaagggaggaaacatgggct

SEQ ID NO: 228205 - DNA, 367 bp, Homo sapiens
agctagatgaaaaagacataatatagaggaacaaagataaaaattacagcagttttttttttcagaaactttctaggaaaagtacattttctatgattccatttatataaaatactaggaaaaacaaactaatgtgggatgacaaaagaagctgtagttgcctggaggtaggacttacagagaggaacaaaagggaaatattgcaaaggtacacaaggaaacttttagaggtgatggatatattcctgatcttgaatgtggtgataattcaatgggtgtattcctatggtaaaacttataaaattgcatttaagagtgtgcagcttattgtattatggttatttctaaataaagcttttaaaaaata

SEQ ID NO: 228206 - DNA, 409 bp, Homo sapiens
ccaaataagaacactgtgtccaagtccacagttggcattccagaattctttaccataaagcactgatggagtgattttgacatagaaaatatcgacattaggagttaccaacattctgccttatgatattaactaaacaaacttaaggatacccagtttttaaaatttagtatagtatcttcaaaggtgaataggctgtgttgaagatataatttgctgaccacatatttctacgtagagccagttctgcgtgttttctttttatgtatgattttatagctttgctttccttttcatgaagaagatatcgaagcaagtcaagtaaaaagaaaatggctttacttctatcttaataaatagcattataattagtaacaaaaattttcttaaaaattgattttctagcacc

SEQ ID NO: 228207 - DNA, 360 bp, Homo sapiens
  misc_feature (262)..(262): n is a, c, g, or t
  misc_feature (326)..(326): n is a, c, g, or t
tcttgtaccagacctcaatattcacatatatacgtgcatagcaaaaacaaaaatttcaagaaacaatgcttgtccatactatgtgatactctctattctacccctttttcccccaaagtgctgttggagacctaccaaattggtttcatgacccattcgtggtcatgatctgcagtttaaaaaacaatggactaaagcatgcagtaaagaatgtggctttgcaattagacaggcccaataccaccttcctgctcatggccgnctccatctatctccacgaccagaacccggatgccggcctgcgtgcgctgcaccagggggacagnctggagtgcacagccatgacagtgcagatcctgc

SEQ ID NO: 228208 - DNA, 504 bp, Homo sapiens
  misc_feature (387)..(387): n is a, c, g, or t
ggcatctttcatctgtttgatgtttcatgcttttaaaaatttaaatcacatcttattaaacactttgagactaagcttttgtattcgttcccaaagcttctcaacatcaaactgattggcaaataagcctttggtcctctcctctaatctcgtttctgttacagcctttgtcacccttgaagacatttcagtttctttaagtttaaattgcctcatctttgaaatgaggttgataacatttacccagcttcccttaccagggtaattgggaagattaaattagaaatgtattttataatattttatgaactaggaatcactacataggaccgtatagcatttagtttttatgacttatattttaagcacatattgtggtgctatttngaagttttctttttttaaaagttgatttttagttccttgaagatctatatctttgtttctgccatatacatgtatatatgtctagcacatttctgcatcataagccatcggatattt

SEQ ID NO: 228209 - DNA, 291 bp, Homo sapiens
caggcacctgtaatcccagctacttgggaggctgaggcaggagaattgcttgaacctgggaggcggaggttgcagtgagccgagatcacgccattgccctccagcctgggtgacaaaataaatgaatgaatgaataaataaataaatacataaataatatatttgagtatactcttgttttcggtgcctagcctgtattgggtgctttgcttcaattgtagaatgaattctaccctgccttagtttcccaaaccagactctgagacaagcattggggtgcaagtagtttac

SEQ ID NO: 228210 - DNA, 601 bp, Homo sapiens
ggcgcagtctcggctcactgcaaccttcgcctcctaggttcacgccattctcctgtctcagcctcccgtctcagctgggactacaggtgcctgccaccatgcccggctgattttttatatctttagtagagacagggtttcaccgtgttagccaggatggtctcgatctcctgacttcgtgatccgcctgccttggcctcccaaagtgctgggattacgggtttgagccactgcgcccggcctgtttttgtttttcatgcaattgaattcatattgcttatactgtttccttttttctacctagtttatttgcaccacttcccatgttgttttttggaagcacttttaattgctacatcatgggacatcacagggatgtaccatagtttactgatcccgtccctcggggctgcacacctgggcgacagagcgagactcatctcaaaaaaaaaaaaaaaaaaaaaatcagccgggtatggtggcaggtgcctgtaatcccagctacttgggaggctgaggcaggagaattgcttgaacccgggaggcagaggttgcagtgagccgagatcacgccactgcactccagcctgggggacaagag

SEQ ID NO: 228211 - DNA, 286 bp, Homo sapiens
tgcagatgtgtcatctttgaaaagcatctggtcaaatggtccctcacaagacagggccatggagctctgagtcttttgggaaaagcacttcaccctagaaaaagtgacagtgatctccaggactcatcagtagtggctatgagctcaggctgggtttggctcagccatcctgttacttttctaggcctctgtgaagttatttaatctccccaagcctcagtttcttgttccaccacatgtgaataataatagttcttacctcactgggatgttgggaggattgaaa

SEQ ID NO: 228212 - DNA, 294 bp, Homo sapiens
attttgttgtgtgagtaatgaggagagagttgtgatttgtatttagtgaataataacaaacaaaaggcatttagctttctggaacatggtatgtagtagaacctcatgaaaatactagctgttgataaaactagactgaaaaaagctttcaaagtcaacaacagtatgaggcagtgaaggacgtagaggagaagctgctgctgcagcctgtagctcctggaagcccgttttgtccatgatttagcaggaactcattacctttccatgaggacactgcccacagaaaccaaggcc

SEQ ID NO: 228213 - DNA, 421 bp, Homo sapiens
acaaaagaaagagatcattacattcttaggctcttcagggatttaaatctggagcctcctgcagctttctgacatttgagccttactctagggtgatttccacggttcccacgtccctttcaagagaacagctatcacttatattcctcagtgtttcttctttgctccagactggttgtgaagccgtaaaaagggtaacgctggagcccagaaatcagctggtgaataccgcgccaggtgccaggtccatcgcggcgaggctgcaggagccctggaggggagcaaaaggagccccgcgcgcaccggacaggctgtgctctttgttaaagaaacaaatacagaaaacgccgcggcggggaatggtggtggtgaagaaatagactgaggcgtttgtatgcattaactgtgcctacaaagccca

SEQ ID NO: 228214 - DNA, 470 bp, Homo sapiens
atcagtaacagtgtagtattatgtaattttattttctgttctgcagtatcactcaaaaaagaaacttgttgattattgagggctgaaataaactcatagaacttccttcggtttttaattgcttgcaatgtactgatgcatttgaaagattagatctcttgagagaactgtgctttttttttttttctttcttcaggctttattcattaaggatactaattttttaaatgtttagaaataagtagattggaatttgtggcaaagtcacaaaatcagcttttattcaacagttttattcaacacattaatttatgtaattaaaagtaacaggcctcacattttttgctcaaattgtcataaaactggctttcataataatacatgcaggattaactaatagagggaaaaaatgcagttaatgttaaatacttatctgaaaataaaagtttcttacctgaaaataaaagtaa

SEQ ID NO: 228215 - DNA, 394 bp, Homo sapiens
gattgtcctcagcattcagctgaggaaaccaggcccacagatgtcatgtagtttgaaggtgatggaaccggagccactgttagcccagtgtgtacattttccagcacaccccattgcctgctgttaataaaagaaatggaaaaaattccacacagatgcatgactagctagagtcattaaagatactgcagagtgtttgctgggatgactgtgggcagtaaagctattggggagtagtcaggataatgttcttttcttggaaggagagtcctgtctttatttacctgacacgtatcttctgttgttgctggctgttctttgttgaatacttcccctatgcagaatactttaattgtagcagctaatttttattgagtatttgctgtatgtcagg

SEQ ID NO: 228216 - DNA, 332 bp, Homo sapiens
atcctgagtttttaaaggtgctaatgtgtggtctacacaatcttggagactgcatttgagcaattcagagatcctgtataggataatcaactcttaaaccccactaacctttcatcagacattcaagcttgagttcttcagatatttctattcacgtaagcgggaaatgtgatattgcagaattcaccttaattttgacttttccaattttaaataacaagtttattaaaaaaaaattatatgaaattcctgggcattcatgatataaataatttactagttttttttgagtccattaaagactgagactgtggaactcaagctatctcccc

SEQ ID NO: 228217 - DNA, 500 bp, Homo sapiens
gaaataaagtgaaacatcctttgctgctctgtagaattgagtgacagcttggttctgtatcactgagcctgctccttgtctctttcccatccacctttgataacctgggactagaccatgatgtctcagcagtcagtctgctgagcactttatggagagtacttcttattaaccactgggatttaattgttggcacctgctaatgggccttctctgagaaggagaggatagatacttctgtcagcagcaccttttaggggtgatctccagccctgaaaacctcaatatatcctgcttctgaggttcaggatgatgaactcagggcctgagaccagccagccatgtgatatatttggaccagggtggtccagaaaggggaacttccttgtctgtgcacaacatctgagcttgttcagggaagttggtttggaccaggccctttttgaatgtcccttggaagtttttgattcagcttgcagagtgggactcttttctatatc

SEQ ID NO: 228218 - DNA, 428 bp, Homo sapiens
ataggagaaaatatttgctaatcatatatctgacagtgggttaatgtctagaatgtaagaagaacttctacaactcaacaacaaaaatcaaataaatgattaaaaaatgagcaaaggggctaggcatggtggctcacacctgtaatcccagcattttgggaagctgaggcgggcagatcacttgaggtcaggagttcgagaccagcctggccaacatggtgaaatcccatctctacaaaaatacaaaaaattagccaggcgtggtggtgggcacctgtaatcccagctactcagaaggctgaggcaggagaattgcttgaacctgggaggcggaggttgcagtgagccgagattgagccattgcactccagcccgggcaaccatgtgagactctgtctcaaaaaaacaaaaaacaaaacaaaacaaaa

SEQ ID NO: 228219 - DNA, 476 bp, Homo sapiens
cagaataaataataactactaaataagctcacaatttaaaaatgtcaaaccacccaagaaaatgagggaaagttaggagacataacgggcaaaatgagtattccaagaatccaagatagcagacaatttgaaagagactagaaaatgattaaagagatgaaaaagactagaaaccattataaaagaataaaatgccatgacaaaagaaggaacagactagaaagagaatcaaataaattttctagaaataaaaattatgatgtgagaattaattaaaaattcaactgatggattaaataccagataagacatagctgaatagaaaattactgatttgggaggagacaaagctgaggaaattctcaggaacatagcatagaaagctaaagagttgggaaatatgaaagaaaaaggtaagagataaaacaaaatatcatgagaaagtccaacatacaccaaatagttggcatggaaaa

SEQ ID NO: 228220 - DNA, 155 bp, Homo sapiens
aattcctttgaagaaatctccgtttgggagtttgcttgattctgcccaagagatgccctaagaaccaattactcaggccaagaagatgcctgggatgtgctggaggcttgattagaagcctcggccatggcttccagctctaagactctatcaaa

SEQ ID NO: 228221 - DNA, 304 bp, Homo sapiens
ttgccaggggctctctggcctttggccagaccaaaggctgcactgtcagcttccctacttttgaggatttgagactcagactgagccactactggctcccttcagcttgcagatggcctatcgtgggacttcaccttgtgatcgtgagtcagttctccttaatacactccctttcatatatacatctatcctattagttttgtccctctacaaaactctaatacatttcttactttaaaaagatgatttctatacttttgtttctgaacaaattaatgttaataaaaatccccatcatcaaaaa

SEQ ID NO: 228222 - DNA, 190 bp, Homo sapiens
accctattggctatctcttctgttccaaaacactggacaaagtttcacatgatctttttgaaatattgtgatgatggctgggcgcagtggctcacatctgtaatcccagcattttgggaggctgaggcaggcagatcacctgaggtcaggagttcaagaccagcctgggcaacatgacaaaaccctgtct

SEQ ID NO: 228223 - DNA, 476 bp, Homo sapiens
agccaacatatcactgttgttactgataaggctggttgaagggcatggctcagtgcaagagccaaatgggtttcctcatatggaacccaagaattagaagcattcacctacctggtcaccggggactccccttctcttcttccccagaaagaggagaaggggaggagcagaactgagcaagccccgctgattgtccccaaatttactaaatttactatttttttttttagccagaaggattgcttgagctcaggagtttaagaccagcctgggcaacatagtgagaccctgtctacaaaaaaaaaaaaaaaaaaacccaggtgtagtgactcatacctgtaatgccaactactcaggaggctgagatgagaggatcacttgagcccaggggttggagattgcactgagccatgatcgcaccattgtactccagtgtgggcaaacagagcaagatcccatctcttttaaaaaaaaaa

SEQ ID NO: 228224 - DNA, 4457 bp, Homo sapiens
  misc_feature (2062)..(2062): n is a, c, g, or t
  misc_feature (3153)..(3153): n is a, c, g, or t
  misc_feature (4055)..(4055): n is a, c, g, or t
  misc_feature (4131)..(4131): n is a, c, g, or t
cagcaccaggctgtggcaggttgggttttgctctgtgctgtgatttctgttggagttggaaagttggctgtgagtcggcccagatgtgaagcggaaacggggaggagggaggtgagtgggcctggctgggtggatggggatctgctcgcctgcacggtttcctctttggtaaagtggggcctgcactcgccccatctagacaggcatgtggggactgaggtgattgattcccagcgtggaggagcatctcgctcagtgccaggcggaccatggcctggaggtggccggcattttcccttctcctgaggggatttattgatcttgtgctgcaggtggtgtggcctgagggcaggtgtggcttgcagagctcatcactggggcaggtgcagggctctggggtgctgagctgtcactggcgaagggcctcaggtcccccccaacagctcccacctgctcagccacagcgtggatgcgtcccgggctccccggccccgggggataccataagcacagaggtggcctctttaatcaggggcttcccagggagggtctgaggctgggctgcgggattactccttccttgggaagcaggcaggggtggccaggcacagtggctcacgccagtgatctcagccccttgagaggctaaggcggatggatcgcttgagtccaggagttcaagaccagcctaggcaacatagtgagctcccgtctctacaaaaaatacaacaacaacaaccaaaaattaactggtggtgaaaaaattataaaaaattatggcagtgagtgcccgtggtcccagctactcaggaggctgaggcaggaggatcccttgagctaggaggtcgaggctgaagtgtgagccatgatcctgccactgcactctagcctgagcagcagagcgagaacctgtctctaaaaatggaagagaagcaagcggggggacctgtgtggtgaccctggggttgtgccccgccgagcaaaaccaagatgggtcagcagtccctggacttggagcatccacgtggctctgctaggcagtggaggggccccgtggtggagcagcgctggcccgggaagcgtgtgtcactaggcttgtgatcagacggctgcctgcatccctgagagttgctgaatttagggagttgtggggcagaaagagcggtggcttcacccacagagtccagggttcgagacccggccgatccacccacagagtccagggttcgagccccagccgatccacccactagctctgtggcgtgagacactgctgtagaatcagtcataatcatctgagccacgatctcacccagggcgatctaatcttaacccaaagggacactgggtgatgtctgggcacatctgtggttgtcataacttgggggagctcctggcagggaggggcggcggccagggatgccgctcagcaccttgcagtgcccctgacggccccaccccagagaacgatccaaccccgatgtccacagagccaggggttagaggcctggttttctgggccctggttttctcatctgtaaagtggagacagggtttttgtcccaggcagatgaaaagttcaagttcctagttgggtgttaaccctggtggcaggaagtgacgatggtggctaagggccccaggatgggctggggaagttcaggcctttctggtcactgcagcgtgggtgggactcaagtcctcctgccacctgtgcccaggctgccctgagcagtgtcccccagccggtcctcaccaggggctcccttgtgacaaaccattgaccctggaccttcttatggtgcagactctgtcgtcactgcgttcacagtgggcaccgtgttgtgttgtgttgtgtttttgagacggagtcttgctctctcacccaggctggagtacagaggcccgaccttggctcactgcaacctctgcctcccaggttcaagcgattctcctgcctcagcctcccaagtagccggaatttcaggcatgcaccatcacgcctgtaatcccaacactttgggaggccaaggtgggcggatcacgaggtcaggagatcganaccatcctgactaacacggtgaaaccccgtctctactaaaaattcaaaaattagctgagcacggttgcaggcagctgtaatcccagctactcgggaggctgaggcaggagaatggcgtgaacccagtaggcggaggttgcagtgagacgagatcgcgccactgcactccagcctgggcaacagagcgagactccgtcttaaaaaaaaaaataacgtatttgtatcattgctatgtttaatgtcgtatttcattgaccataagtcccacagggaaggaggaagttgttacttcctgtgtggggctggggccagggtctccccctgggtattgagtcattctctggggtggagtgtcctgggcactgcagggtgctgagtagcgttcctggcctccacccactccatgccaggagttcccccaaaacctgacaaccacagatgtccccagacatcgtccggtgttgaggggcagaatcttcaccgtgttcaggcctgtgggggcagggggcagggtggtctatccctgactcagcccgccaacatcctctgggccacgaggcaaatgagaagaaaaaggaagtggtcgggggtgtgagccactccaagcacagacaattcccaccggggacaaagggatgggctgagctgggacacctgggtggggagtcgcaccctacgtgccctggagaaccaaggcagcctgagtcaccatgccagctctgccgggctgcagatgctggtttcagaagcgcctggcagctgcggagctctggggatgcggacttggctgggctaagatggatcgggtatcggggcccccagaatcccctcagtggagtccctggtagattagatcagaggggaagctgccaatctagctgaggtcttgccccagggcagttttgcccccaggggacttggaaatacggggcagtgcggggggtgcatttgtgtttgtcacaactagaggaggggctgcccctggcatggagtgggtggaggccagggacattgctcagcacctgcagtgcccaggacaaactcacccagagaaggatccagccctgaatgccaagtgggggactgcattngttatttgggaaaaaaaaatcaagtctgctccctgctcacaccagacaccagaataaactcccaatatggcagacggtgtaaaccaggggacctcagctcctgggattctcttcctctccccctctgtggatttcaatgtgtgtagcctcctgggacctcagcagagcagaggatcatgggccacggagtctcttgggggtccgtggaatcccctaacccaagaggtgtcaattgagggtaattctgcccccaggggacactgggccaagtctgggacatttgtgtttttctcatgactgggggtgctcctggcatggagtgggtggaggccagggacgctgctcagcaccctgcagtgcccaggatggcccctccccagagagtgacccacgccgatgtccacagtgcagagagtggaaacgctgccctagtggcagacgcagcagattcagaattgaaggatctgagttcaagcccagacttgtaccttttacctcccaccctcaggcgaggcaactggcctcagcttctggacgtgcagcacgggtgagcccctcccgccagccaggaaatgatgagtttcacgagagcaggtcctccagggccccagcaaatgccaggcctgtttactaatgacagcaaaggtccaccatcacttagcaggaatgagagcattcgctttcagcctgccctgccagcctcacagggctgcggcatgaacccctgtagggttagtttatgagtgcgtagggaagtgctccccagaaagcaggagaaacacggatggccagatacacgtttgagcctctgacaactacagtcactgtgtactaactagtggtgaggttggcaatttgtaaaaattactcattaaagagggagacagagccaggctccgtgnctcatgtctataatcccagcactttgggaggccaaggtgggaggactgctcgaggtcaggagtttaagaccagccnggacaacatagcaagacccccgtctctacaaaaaatacaaaaattgccgggtgtggtggctcatgcctgtaatcccagcactttgggaggtcgaggcgggcggatcatgaggtcaggagttggagaccagcctggccaatatggtgaaaccctgtctctactaaaaatacaaaaaaaattagctgggtgtggtggtgcgcacctgtagtcccagctactcaggaggctgaggcagaagaatccttgaacccgtgaggcggaggttgcagtgagccaagatcgcaccactgcactccaacctgggcaacacagcgggaccccatctc

SEQ ID NO: 228225 - DNA, 485 bp, Homo sapiens
aagttgtgagcatgttgacagcagggatgtgtccactatgttccatggtaatgcttggcattgttccctacccagagtgggtactccatcagggcttcttactagtggatctgttatgctcaataggagatgctgttcagagaaatgatcctagagcccagttgcaaaagaaaaggaactgtatactaaagcaaaaaaccttcccacaactccccactttacctagtcttcacacaaaacctcaatgattttctagctgttactaagagaaaggaggctttcctttgaatatggaaggaaccttatggattatctattccaaactcctcactacacagacagaagactgagacctagaaaagatgggatctgaacccagatcccctcactccccactcagaccagttctctttccacatcaccatgctggctatgtaagtggccataaccaaacaaggtagagagagaaaaaaaatgagcgaccg

SEQ ID NO: 228226 - DNA, 690 bp, Homo sapiens
  misc_feature (1)..(1): n is a, c, g, or t
ngccagaatcagtgggatggaagttttgctacatgttatccaccccaggccaggtggaagtaactgaattattttttaaattaagcagttctactcgatcaccaagatgcttctgaaaatggcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgattttactggtagtttaagagagcattaaataggctttttattggtctgcacatctccacaaacagcaataagctctacatctggcagatggatgtgacaaataagattatgtaattaaaattttttttccaaccagttgtgatttcagagcctttctccctacatcattccatctctccattctattaggtctagcaataacgtaacttcttggataccaagtaaatcagttactttttattttttggagggggttgtttcttctgacttgtttactatttgcctcttctgtgttaatcacctaattatgtttaccacaattcttttcattaaactatgttgccttacaaatagtgc

SEQ ID NO: 228227 - DNA, 487 bp, Homo sapiens
atatatgcatagttttatgttagaagttgaaggacattaaactacttaaagaatctcttgctacctttaacatatatccagtagactaaccaaagaaccatttcccaaatgatcatgaatctacaatcttttaggtctcaaggaagctgggtcaataattcataacccgttaagtctcaaggcagctgacttcctctactttctaaaactttcaggttacccagttggtaacatgttgaataataagtcttctctcagctattccttgtttatcatgtggatcagcaacttctctaacatttccgtggaattctattatttggacctagccttctaccaagaatttgaatttgagtttatagaccaagctcaaaccccttccttctggaaccatttgaacgtctactacaactgcttccaggaatcacttcttccatttttggaaaacctgtgtcatcaataaacttgctttttcactaggcacagt

SEQ ID NO: 228228 - DNA, 551 bp, Homo sapiens
gctcaggtggccccagaggcccaaacccactgctcccactttctgagacctgggaccctcacctccccaactcccaccatagggcgacactgaaaagtgtccccttcccccccccgtttccaagtcaccagcttgaggatgcccaaggctcaaaggctcctccgagtggcaccccgcatcgggctgcagaggtcggagaggggaggggatggtgggtgcaaagggtggcttcttcaggaaagggaagcctgtccctggctcccagcacctgtcacccctggcgatctcaccccgcggccatcattcccgtcctcacggcccatttcagggacactgaggctcaaagagccacgtgatttattcaaagcagctcgagccaccacttggagccacaagaaagccctggtccgtgcctcctcgccttggtccctggcccttcactcttcgtccaggctctctgacctctttccctctgcgcccctgcctcttccccaggcctgggtccccaaggcactcggccacgcgctgggtccggggaagaggcgcggccg

SEQ ID NO: 228229 - DNA, 467 bp, Homo sapiens
aaagaaccaagttaatacattgaattgagcagtctgataagaaggtagtgtgggggggtctccgggtccacagaatttccttgagtgtggattgctgtgtaggaaaagctctctaaattttttctgctggctgaatgtagagtaatgtgaccctgttgctctccgtggtgagctttccataattgagatattcctggattcattgccaggagtggacttcctttacctctgccctgccacagggtggctgctgcctttctcctttaataaggtatgttcagtttcccccactcaaagaccatttcatcccttagacattctacccaggacattgaaaatagaaacaaggccaggcacagtggctcacgcctgtaatctcagcactttgggaggccaagatgggcggatcacctgaggtcaggagttcaagaccagcctggccaacatggtgaaaccccgtctctatt

SEQ ID NO: 228230 - DNA, 476 bp, Homo sapiens
ggaaaaatgttcaggtttttattatggtgaatgatgaatttttaacataccccaaagtagatagaactttaccatgaaattccacatacccatcacacacatgtaacaaccatctagggcccatctgccctgtctataccccctgcacttcttccttcccagcttggcagtgtcaaaaatcaaaccccattggtctgcctccaaaaccctccaccaagctggtccttgctttgtcctagcactgggctttattataacattcctaaggtccacttaaaattatcatttcctggcacatttctctttttttaaaaagtcattgtcaaaatgaataaatttgatagaacattcaaatggactatagagaacatttcagggcttatcctcagatttccatttgccaggcaaagttcgaaggtgccattattaaactaccttggtgattgttgagacgatgttaaaatgggatagaattc

SEQ ID NO: 228231 - DNA, 122 bp, Homo sapiens
aggaatcactagaacaaggatctgcaaactacagcttgtgggccagatctgacttgctgcctgtatttgtaaataaagttttattgggccgagtgcagtggctcatgcctgtaatctcagca

SEQ ID NO: 228232 - DNA, 434 bp, Homo sapiens
ctaggtctacagagtctaaaaacttcccttaggacctcctcgcctgttagaaacagagcaaagagtaaaacacaggtctcagccaggcatggtggctcacgcctataattccagaacttttggaggccaaggtggagtagatcgcttcagtccaggaattcaagaccagcctgcgtgacacagggagaccccgtctctatgaaaaatacaaaaatgagccaagcgtgatgagacatgttctcagtgatacctgggctgcggtacagtggcaagatgatagttcaaggcagcctggaacttgggctcaaatgatcctcctgcttcagacttctgcctcaatgctgattataataaacatattctatttcatagagcagactgacattttcttagcagctaatttcctgataaaaacattttgttcttggctgagc

SEQ ID NO: 228233 - DNA, 395 bp, Homo sapiens
aaatatggtttgatagaagaaataagacctagcagtagattagtagggtgactatagtttacagtaatctattgtatatttcaaaatggctagaagagaagcattagaatggtgctagcataaagaaaggacacatatttcaggtgatggatattccaagtacactgatttgatttttacaaattacataaatgtattaaattatcataaaaataagaaacaaaacaataaactgagaaaaaaatttaaatgacctacaacctaatttttaatgcctgcatggtattcttgtgtattaatgtgttatttttacttaaccaatttcttactattgaaggcctgtttactgtttttcactcttctaaaccacaatgcaataaaaaccagagaaaaat

SEQ ID NO: 228234 - DNA, 350 bp, Homo sapiens
agcaggggtgagtggagcttgaggtgaacctggaggagtggtagatggctgaggtttctcttagtgaaagagggaaggtggaaggatcatagggatgcattcaggtgggagtgctagcaaaggagcatatgtaggaaggacaagctttggtcagaggataaggaggacacacacctatgtggctggagccgaacttcccctccttctgagaagcttgattagaaggatagatgggaagaagaggatgccagactgacaaattcaaattttgagcaaagagtagcatgtgaaagtggagttttgcaagattaacccagtgccactgaattaactaactcagacaaaacgag

SEQ ID NO: 228235 - DNA, 467 bp, Homo sapiens
caatgcctgggctccagtcatgtctccattgctaagtagaatgagctgcagaggaggttccagtcactgttccatataatctgttgcttaaaccctgatattttttccttatctgtttttaattttagaaaaaaagttttaacatggagattatggcttccactgaactgggatttagtatttcgaaacatataaaaaggatttctaaaatcaaaagatctatacttttttctctttccatctggagtcaactgaatattcaacttttccattgaacaaacaaacaaacaattgtgctcctgactttttccaggcattaaacaatataataacaaaaatgaaatgcaaataaatgtacttttaaaactttaatcctacagcaaaagattctactggctaataatgctacctgcctgaaactttatattctgatatttttccttaataaaaaagtattttttaaagtt

SEQ ID NO: 228236 - DNA, 394 bp, Homo sapiens
cctcaaacttcactttcagtggagtttggtagcacttccggtctcagactccacacttgtgaagtttgcgagttacataaaaaattaaattcctggccgggcgcggtggctcacgcctgtaatcccagcactttgggaggccgaggcgggtggatcaggaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaa

SEQ ID NO: 228237 - DNA, 389 bp, Homo sapiens
aagtgctggaattacaggcgtgagccactgtgcgaggcctaatttttaaaatttttgtatacagatggggtcttactgtgttccccaggctggtctcacactcctgtgctcaagcgctcatcttgcctcatcttcccaaagcgctaggattataggcttgagccactgtactatcctgcagaacaaaggacagggagattagactaaaggatggaggcttgagacatcataccacaagcaaggatgtgtatcataacagaaattaattgcggccaggcattgtggctcactcctgtaatcctagcactttgggaggccaaggtggccggatcgcttgagcccaggagttccagaccagcctgggcaacgtggcaaaactctgtctctac

SEQ ID NO: 228238 - DNA, 375 bp, Homo sapiens
atagatgaaagcttccatgcaaccctggaatatgggcttccgcccacagctggttggagcgtgacaatcaaatgtgttaccatgtttctcacagactcccacaacatcaaggaaatatttctgactcctggcatgaaacttgaagaaagagaatgtagcagccactaatacaatggaaagcgcaacattgacacgtctatctagaaaattttaattgtctaagttgtgtgactcagatatctttgcatttctgcaaaagatcaaggtctactctaattcttaattaaattaagaattcctttttattacttgttagcaaataaatggcttgtctctaacagaatttttccactggtagaatttttctttagtaaa

SEQ ID NO: 228239 - DNA, 499 bp, Homo sapiens
cacgcccagccgggagagcagcccctccctgcccaggctgcctctcctggagctggactccaccctctgtgggggtcttccctgcccagagcccaggcactccctccacaagaaggaaagaggaactggtttcctgggggtcctcaagcagggtatctgctcccctccctgagcctgacttgtagggagaagacgtaaggtgagttaaccttgagtctttgataacagaggagggttaaggaggagggaggactccagaccccagcactcattttttgctatgggggtcaacactcgctgcctctactctgctgatcattggctgctcccaggacacaccacagcccatcgcctgggcgccctgtttcctcattcttgaatgacctccttcctttggggagaactctggcgcttcagagactagttcaaatgtcacctccggggcagagcttctcctcaccctccagactcccctgacctttcagaactctgggtcagc

SEQ ID NO: 228240 - DNA, 402 bp, Homo sapiens
ctgagcagggtttcccctgcatggtagcttttcctaaacaaatctgaaaatcaatgattcccttcagttctctgggtcaacacagactacagccagaggttctgagctggaggtgtttgtgtcgtgagctctggatacaaatggaggtcagtggctagaaatggctagaagctttgggaggcagttttcttccttagctgtcttttggcctggtgaccttcggctttggttttcctctccttacaaaacccactcttccttttaaataagcttaagacaacccaggtgcttcttaaatattgtttcacagaaaagaagcatttttctatttataggaagagaaaaggtgttgtgaaaggactgaacagcttccagctgctgttgaggaagggaggcaaggtg

SEQ ID NO: 228241 - DNA, 882 bp, Homo sapiens
agttggagtgcactggcacaatctcagctcactgcagccttcacctcccaggctcaagtgatcttcatgcctcagcccccacaagtagctgggactacaggctcttgccatcatgcccagctaatttttgtattttttgtagagttggggtttccccttgttgcccaggctggttttgaactcctgagctcaagcaatccatccaccttggcctcccaaactgttaggattacaggcgttttgagcctctgtgccaggcctagaaaaaacgccttttaaaatattattccccattgaaaaaaaattcagtgtccaaaggaaacagctatttctaaaatagttgctgctatctctagaaataaaactagaacatcccttttttcttcttgatttgcatcccttttgatgtatattccagtactacattggtagagggaagcttttcaggactgtcagctaatggtacagaaataattgatttttgttatctgaatgcatttcccttgagaaaggctgtaggaggtattcagatacctgttgaataagtgaatacaggaatgaatgagtgagagaccttgtctattgtacttatgctgactcatctaagttttatgacttttagcaagttactttacatactgacggctctatttccttgtctgtaaggtggagtttataatacctattgcatatttagtaaacttttgttgaatatttcacataagcactagatcaaactcagatctactgagtcgttttttggggtgtgggttatagatctttgttctcttaatagatctttgtcctcttaataggatctactcaaggttctcatgcacccaaagtttgaaaattactcatttaaactctactatttattgg

SEQ ID NO: 228242 - DNA, 731 bp, Homo sapiens
gcacggggaacagcgtgtgtgagggtcccgccatgtctcagccctttcctggcccccgcacttagccttcggtgcccatcttcagggtcaggggaagcccaggccaaagcgggccgggaaggggccctgtggataaggccgagagcctgtcccaaaatagggccggcaggatttcccacccataaaaggctcttggaatctggaccccggggaccccaggcagccaggcccagctaaaactcagctgccaccactgccccagcactctgcccacagcagccctggtgtcaccaccctgcagaatcctgtcagacaaccacccgacatgacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtacgtgctaatgaacgcaggggagcccctcaacgaggtggaggcggagcagatgatgaaggaggccgacaaggatggggacaggaccatcgactatgaggagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagcccgaacctgtg

SEQ ID NO: 228243 - DNA, 520 bp, Homo sapiens
tgaacatcagaaacactgatgttcaagaactttgattaccctcatttatctgggagctgtgtgacatctgaggcacagttctaagtagaagtatcattcagaaccaggagcaagaatcagatactcgtgagtaaaggtccaaaactgagtggcaatgtaatacttttggttttcaaataaagagattcataagatttatctaatcaatctactaatgcatggctctatataagtttgctagcataatagattaatcatggtaaatctatttctaatctattccttataacttactatttctccttctactatgacatcttcattttttgtctttaatgctcatccattttttcttctctgtacgtgaatcttagagcccacaggtaactgacacagaatgttgagaatagtaggatacaaaaagtagtggcattttggagatctggtagtcccttagacaatattccttacatttgtctatttggtttgctctcctgcattttgtagactcattcctagc

SEQ ID NO: 228244 - DNA, 833 bp, Homo sapiens
ttcttgtcggaacagctttgtccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcagggcatagtggaaaacaccctgaccc

SEQ ID NO: 228245 - DNA, 1050 bp, Homo sapiens
tacctaacttcaggccttattagtctcttgcgtcctgcttggtttctgtcctagcactgctccacctggtcatcccagatgccagcttccagtctctattccaagtaaaagccccgtatagctgcctttaggttcggagccaaactccctagcaaagctaccttgctgcacaactccaaaggacatacctacatagaatttggtagttttgcaatctggtaaccctgcatccctagatcaaccttcaaagctcttcccagtttgccatcagctctacctcctgccgctcactcacccacccaccgaactagtcatccaaagttatttctggttcatctaacacacatgcctgactttcctgcctagcaaatgtcctgtcatccatggttctaatatgacattattcctttatgaacccttgcctgttttccccaaggattttcttgtctctgctctggatgactgcgatgtttcctcattagtgtttctgcgaccatacacacacatttctgggtttattagccaaacagaaacctgatcatgtcatttttccactgaaaactctggaatgcctttccaaaacacttaagataaaacccaaagttcttaccatggtcttcaaggccctgcaagaccttacccttgcctaactaatcatctagccacgcaactatcctccagccaggttggcctttctgatccacatatacctaacaccaaccttatttaccacctcagggcttttgcactctgtctccctccttatacactacagaaaataagctatactagagtaggaactctggctagctccaggacccacagcagtatctatctatcctacagtagatactcatcagtaagtatttagtgactgacttaacattgaagccacaccataatttttacttttgtctgtctaccctgtaaactatggggtccttgaactagggctggatattatctctgtatcactagtattagtacttagtatatagctggtactaataaccatttgctgaacaaatggtgaatgtgcttttgctcaag

SEQ ID NO: 228246 - DNA, 1129 bp, Homo sapiens
ctgactttgtcactgttttattttaagctctcttaaacctgggtgcagtggctctgcctgtagtcccagcactttgaggaggccaagataggaagagcacttgaggccaggagttcgagactagcttgggcaacatagcaagacccagtctctacaaaaacaattaaaaatgagccgggcatcttggcatggacctgtattcctggctgcttgggaagctgaggcaggaggatccctttagcccaggggatcaaggttgcagtgagccgtgatcgtgccactgcactccagcctgggcaacagagtgagaccctgtctcaaaaaaaaaaaaaaaaaaaaaaatagaatctacctcatggatatgttggtaagattaagtttggtgcctgacatataagtatttaataaatgttagttgttatgattatttttctcttccttttctttttcaccagccctcattattaaaaagtaagctttgggaggaaggaccactattacgcttttgtattatgcttaataggaaaattataagcattcatccaagtgtgttgagtactttgtacttgtcttgaggaacagtagggataagagagacctgctgtcatagagtttacaggccaggagaatgcagacatttatagattttttaaaaccctacctataataaattgtatagcattactcaaaggggaaattgtaaggcatcaacctaaggtgagtatataccaggagaacccaataaaacttagtggattgttaaagcctctttgaaacctggaagcggggtaagagttagtagggagatgtcatcagtaaattttattaggaaaaagggcagaatttcaaatcccacaaggtctgaaggaactgggcacttttgaagaacagaaaaaaggccagtgaagaacaggaaagagagaagggcctagttctgtagaggaaaatggaaactagatcaggtagggcctttgtaagctgcataaaggattttggattttatcctaaactcagtgagaaagcatttttgaagggttttggtggggtaggatcagtgtacatgacctatcagatttgcctactttttaaaggcttttatgagccatataaaaccattgtagcttttaaa

SEQ ID NO: 228247 - DNA, 824 bp, Homo sapiens
aactcctgacttcaaatgatccaccttcctcggcctcccaaagtgctgggaatacaggcgtggaccaccgtgtccggccataatctagcaatactgataatgtggtgatgtctgtgactttatcttacctgaaataacaaagaaagcaaaacaaatcccatataatcatcttcacttttagttgaaagaaacatttagcccttcaatcagttaatccaacaaatacttgttttgtggcttgtcatgtgtaaggcactatgtttaatctactttccggaaactacagcctagtaggctagacaaaattgaacacagtaagacaaaattgaagctttgtaacagaactataagcaaagtgctatggattatagggaaataaaagaacatgcctacctagaaaatattcggatttctgaagaggtctcaagaaaagcattcctcatccttgcagaatttctagacaaatggagaaaacaggagtggcagctggagaccaaaattattaaaagaaaccaggttggaagatctggttttcagtatgtgagccaaattgtatctgttaactgaagtctatcagatagacatccccagcccgcagttctaagcagtcctataccaaatcaagcttctcaacgcaggagagagcctggccctgaagaaatggagaacacttgttcagaaagggtagaaacacagaactctgagccaagttgcacttcattcttccatgatttgccagtcaaataagattaaaagactaggtaacagctatgctcattattaaagattcgctggccgtcgttgtacactcaggaaacggctat

SEQ ID NO: 228248 - DNA, 1001 bp, Homo sapiens
aactcctgacttcaaatgatccaccttcctcggcctcccaaagtgctgggaatacaggcgtggaccaccgtgtccggccataatctagcaatactgataatgtggtgatgtctgtgactttatcttacctgaaataacaaagaaagcaaaacaaatcccatataatcatcttcacttttagttgaaagaaacatttagcccttcaatcagttaatccaacaaatacttgttttgtggcttgtcatgtgtaaggcactatgtttaatctactttccggaaactacagcctagtaggctagacaaaattgaacacagtaagacaaaattgaagctttgtaacagaactataagcaaagtgctatggattatagggaaataaaagaacatgcctacctagaaaatattcggatttctgaagaggtctcaagaaaagcattcctcatccttgcagaatttctagacaaatggagaaaacaggagtggcagctggagaccaaaattattaaaagaaaccaggttggaagatctggttttcagtatgtgagccaaattgtatctgttaactgaagtctatcagatagacatccccagcccgcagttctaagcagtcctataccaaatcaagcttctcaacgcaggagagagcctggccctgaagaaatggagaacacttgttcagaaagggtagaaacacagaactctgagccaagttgcacttcattcttccatgatttgccagtcaaataagattaaaagataagttatacttaatctctttaaagaagtacagaggagccaggagtgtgtttagagaaagtttttccttgtgtaaaccaggagtggggaagaggcattcctctctacaaagggggtcagaaaaggtttcatggaggttatgccttgagctgagcattaaaaatgggtaggtttctatatagacgttgagaagccacagagatgagacagtataagctatgtttgaaaaacaagtagtctgatta

SEQ ID NO: 228249 - DNA, 538 bp, Homo sapiens
acttcatacccaggcttgtcccacaacggcgagcatcttctaggcacccacttagagcccctcaacagacatgtgtccattcggtcctcgaccctaacaacctagtgttcaccccacactgtacagatgagcgaacagggaatggacgttgagaagcttaagcttctcaacgcaggagagagcctggccctgaagaaatggagaacacttgttcagaaagggtagaaacacagaactctgagccaagttgcacttcattcttccatgatttgccagtcaaataagattaaaagataagttatacttaatctctttaaagaagtacagaggagccaggagtgtgtttagagaaagtttttccttgtgtaaaccaggagtggggaagaggcattcctctctacaaagggggtcagaaaaggtttcatggaggttatgccttgagctgagcattaaaaatgggtaggtttctatatagacgttgagaagccacagagatgagacagtataagctatgtttgaaaaacaagtagtctgatta

SEQ ID NO: 228250 - DNA, 707 bp, Homo sapiens
gcatgcctgactagctacccactgtaacattttcccactcaagagtccaagaccccaaatcttcggaagaaaatggatgaagggtatgagagtcatttgtggcataacttcaacagacatgacagggctgactttgagttgaattataaaatttccaaatgaggatgtccaggaaccagatagacacgtgagttagaagctcagaaagcaggtcaccatcacctcttatctgatcattgcaacacttgcttacttgtcctcctatcaccagatctggctcctgacaattcaccttgcgtaatgagagggataaaaaccttatatatgaaactttcactaataacctgaaacatcaccacagagacagttgggttatcctgtttgtttggacatccacttattcacttgaaatgcaggaaatctatttgaaaaaaacaaaacaaaacatgatcagttacttgatacaatcatgagatgtgatcgagaaaaacttattaaggaattattttgtcagagtcagtctctctcaacaaggtaagctactttttcaatgtttctgattagagtagatccttgatgtttattatcagtgtcatcatcattaatgaaaatagtacgagaatatacaaagatgcataagtgagtaatggtgtaacattctaacatttctaagatgtgaatttggatcttgccatgcaagatcgaaa

SEQ ID NO: 228251 - DNA, 816 bp, Homo sapiens
gcatgcctgactagctacccactgtaacattttcccactcaagagtccaagaccccaaatcttcggaagaaaatggatgaagggtatgagagtcatttgtggcataacttcaacagacatgacagggctgactttgagttgaattataaaatttccaaatgaggatgtccaggaaccagatagacacgtgagttagaagctcagaaagcaggtcaccatcacctcttatctgatcattgcaacacttgcttacttgtcctcctatcaccagatctggctcctgacaattcaccttgcgtaatgagagggataaaaaccttatatatgaaactttcactaataacctgaaacatcaccacagagacagttgggttatcctgtttgtttggacatccacttattcacttgaaatgcaggaaatctatttgaaaaaaacaaaacaaaacatgatcagttacttgatacaatcatgagatgtgatcgagaaaaacttattaaggaattattttgtcagagtcagtctctctcaacaagatttacaggccagttgttgacattgtagtatcctctctttgaacactggaattgagcaacttcaaagagtcattggaccaaggtcttcatgcttcaaataaacctgcatcaaagaaacctggctagaagacaaagatcatgctttattcccccacaaaaggattatgtttagatttaatgttgatgcctcagttaagtgctcactttgaaaatcaatacaacattgtgtgcttggttggctcaatacctctcagtcaatattaataaaaaaacagcaacaaa

SEQ ID NO: 228252 - DNA, 230 bp, Homo sapiens
ctgtgcccggtttcctcatttgtaaaacaaggacaataacgtcctttccacaagagcgtttgtgaagttgaaggagatccaacttgtaaagcacgtaggacaggccagacccagtgaatttgtgactgtggagtgctggtggcttctcagctactcagggtgagataggaggttgagactgcagtgagctgtgatcacaccactgcactcaagctttctcaaaaaaaaaa

SEQ ID NO: 228253 - DNA, 462 bp, Homo sapiens
aaaccagcagttggagctgaacaccaagaagtgggaattcctggctcagagatggagaggtgtctgtctcgaagtttcacaggtggcaggtgacaatattcttggtagagaccctggttaaagggttgaagttctctctgggggtgctctttggtatgtagagcagcttcctgagctcttgcaaaatagtcggtgcatctcaagttctccgactctgactttatgtttgcacaggcaggcttgaggcccgccacgtcacctgtgatctgaccacagcactgctcaaatctgcggtgtaaatcgcagctttatccactcgctcacagaactgtaaattaattcttgtcctctttcctgatttcctaattgtccttgtttataaacgtgctttatggtaaaggccattagtttatctcacaagttaaaattaagaagaacaaaggctagtctaaaatagagcag

SEQ ID NO: 228254 - DNA, 330 bp, Homo sapiens
ggaggctgaggcagggtaatcgcttgaacccaggaggcggaggttgcagtgagctgagactgcaccattgcactccagcctgggcaacaagaaccaaactctgtctcaaaaaaataagcactgattttgatgtatacccagattatatgagcatacaaggtagagtcaaaatagcctggcatatgagactgctcagacctggatcctaattacttctcaaggtacattccccttctggaaccctattctgtattcaaatagaaatactgaatatcatattctctcaagccggcaagcctcatattgttcctcctgcctaaaccacccaat

SEQ ID NO: 228255 - DNA, 580 bp, Homo sapiens
tctgtcagttttggggtccaggtgcctcagtgctaggggagaattatttggagtgaaagttcctatattagtttcctgggacagccatagcaaagtaccccagccagggtggcataaactacagacatttattgtctcgcagtcccggaggctagaggtccgagaagaaagtgatggaggggctggtttcccctgaggcctcttttccggctcagagatgctgccttccccatgtcctcacgtggtctgtcctctgtacatgaccgtgtcctcatctcctgttataagcacaccagtcacgtaggattagggcccatcctaatggcttcactttaactttatcacctctttaaaggccctgtctccaaatactgtcacattctgaggtactaggggttagggcttcaacatatgaattggggggaacatggtttagtccatatcagtgcctcacgtctcaatacatattcagggaaagatgtttgcatgggctgaaactcctctgaccccagggtagatcttcacattcatctcttatccaaaccccctccagtaatccctaaccttcttgccctgcctg

SEQ ID NO: 228256 - DNA, 538 bp, Homo sapiens
ggagggacctcattcagcctatggcacaagtcattccagcctttagaagcatcagtttgaggctgggggtgctagcttagtgcccctcattttatgggtgagatcagtgttcacactggaaggcactgattgagaatcacacctttcaaagggaggagctgcctgcaagtcaaccacctggaccttcagtggagcagcatactcaccctcatgaatctattcagtctcttcaccacctccagcctggatgtccccttatccaccagtgggaataatatgaatgcctgtctcctagcttttctgtaaggattatgtgacagggctcatgtgaagtgcctgggatacatttggatgtcttagaacattagctacaatcactgcttttcttgttggctaagttcccttggaacttaagggtctatgagatgaatccgtgcttttcaaaggcttcctaagtactcactaattactcagcagtatccctggcaggccaatggctcaggagtgagtgaaaataaaaggcaagagaaacttcctt

SEQ ID NO: 228257 - DNA, 541 bp, Homo sapiens
ctttgagaccagcctgggcaacatagggaggactttatctctcaaaaaaaaaaaaaaaaattagccaagtttggtggtgcacacctgtggtcccaacctccggttgaggctgaggtgggaggatcacttaggctggggaggtcaaggctttaatgaggcactgcactccagcctaggtaacagaatgagaccctgtctaaaaaaaaagaaaaaaaaaagaaagaaaaaaataagaaataagaaagaaataaaatttaattttgtattcacgcaaggttcatttgcgtcagcaggatgagtgaggtggtctgattcacagtgatttaggaccccagtagcttttcattgactaacccaacattgtaggaagtcttttgatgttctctatgcatttggtaaatgagggagagagcgtggatgatcttttaggagattttgcgggccagctccagaagtggtccacatcacttcccttcacactccactgagaacaccttttcatggccacatctaactacaaaataaataaacaaacaaacaa

SEQ ID NO: 228258 - DNA, 543 bp, Homo sapiens
ctttgagaccagcctgggcaacatagggaggactttatctctcaaaaaaaaaaaaaaaaattagccaagtttggtggtgcacacctgtggtcccaacctccggttgaggctgaggtgggaggatcacttaggctggggaggtcaaggctttaatgaggcactgcactccagcctaggtaacagaatgagaccctgtctaaaaaaaaagaaaaaaaaaagaaagaaaaaaataagaaataagaaagaaataaaatttaattttgtattcacgcaaggttcatttgcgtcagcaggatgagtgaggtggtctgattcacagtgatttaggaccccagtagcttttcattgactaacccaacattgtaggaagtcttttgatgttctctatgcatttggtaaatgagggagagagcgtggatgatcttttaggagattttgcgggccagctccagaagtggtccacatcacttcccttcacactccactgagaacaccttttcatggcgtctcaccctaagatgttgatcaacgttccggtcagga

SEQ ID NO: 228259 - DNA, 560 bp, Homo sapiens
tgcatcaatgccgattttctctgcagatgcagatctccccaccaaagatagcttttcagctattatttccagcccttctgtatagccatcttgaaatatgtcagagaagtctattttggggcaaaatattttggtttccttgagaataaaattacacatctggatgggttggttccattgtaaattcctagcttccaacttcaactctgtctgcatcatgcctagatgcttgctagctttttcaccttagctcaatcctccacttgccacagggctgctgggcctgcactcttgtcagcttctccttcctttagtctttgtctcagccaatcagatcagctcttgctcagagaaaaaagaagctaatgggaacttcctcctctttctcctgccagatctagaaatctgcccgtgcttgcctcctcccctgccttttcccccatgaggtggaagccgtcctgctaaggccagttttgtggtgggacccatgccctccagccttctcaggaaccgtatgcagagtatcacctctttcccatacacccgtctctcctgccgcg

SEQ ID NO: 228260 - DNA, 336 bp, Homo sapiens
cagtagccaaggatgtagttggaacttttctccccctcgggtttgatcccttcttatcctgattttgtcttatttaacacaatgttcaattgctgccgctttcacctgggaatggcatgcttctagaggaattgttttcctcccaggctgctggattgtgtcatctttgaaagtgaaggatcttgctaagttcacctgctcagttgtcaggcccagggatgctatgtaaacagtttttccctttattaggcattaagtaaaactaggccggccacagtgcatttttttaggaattaataaacatatagcaagggccagcagcccccgaaggatcgc

SEQ ID NO: 228261 - DNA, 412 bp, Homo sapiens
ttacacacagaatttaagataaaaaatgaccatgtgaagacacaatagtatagtccagggattggcaaaattttgggtaaggaatcagatagcacgtattttaagccatgagatctatgtcttggccaggtgccgtggctcaggtctttaatcccagcactttgagagcccgaggctggtggatcacttgagcccaggggtttgagaccagcctgggccacagggtgaaaccctgtgtctacaaacaacgcaaaaattagccgggtatggtagcatgcacgtgtattgccagctacccaggaggctgaggtaggaggatggcttgagccatacagctcactgcagaggttgcagtgagccgagatcgagccactgcactccagcctgggtggcagagtgataccctgtctaa

SEQ ID NO: 228262 - DNA, 254 bp, Homo sapiens
tgggtaatatgagggtaaattctgtgagtgccaacctgaaggagcccttaagtcctccctgaggagtatgttaaagttgctctggtaatacagaacgtgtttcagagccttggactggagtgagaggacagaaattacaaaagacactgaaacctgaataggattgaagcacaaaagccaggagaagggaggcagaaggatgtgggcagtaggaaaggtctaagtagtgaaaaacagtgttgcatgggtacaga

SEQ ID NO: 228263 - DNA, 342 bp, Homo sapiens
cttcccctacaccccactctccaaaggaaggtactttcaactctttcacactctcttcttggttttgctttcttatttctaaataatgtacttgtactgacatgactcgatttgcttgcaattctagaagctgtctcttaacttcctcctgtgggaaatgattagttctttcattgtccgcccacacacatgctcaggcactcacacttctttctctgtgctaccaacagagttaaactacaattgttagttatcactcattgttttcattttgaccatgttagccaggatggattttcccctttgtctattataattcttgccctaaattactaccaaact

SEQ ID NO: 228264 - DNA, 416 bp, Homo sapiens
acttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatcctt

SEQ ID NO: 228265 - DNA, 415 bp, Homo sapiens
caggcggatcacgaggtcaggagatcgagaccatcctggctaacatggtgaaaccccgtctctactaaaaatacaaaaaattagccgagcgtggtggcgggcgcctgtagtcccagctactcaggaggctgaggcaggagaatggcgtgaacccgggaggcggagcttgcagtgagtgagccgagatcgcacccctgcactccagcctgggcgacagagcgagactccgtaaaaaaacaaaaaaaaaaccttgcccttcattccccatttctatcataatctacacagagttttgaacaggcattttaaaatcaacaatatattatttacaattttgttagtatacataactctaactcactgttaaaaatcacctgtctttatatccattaaatgacacttgcatatgctccaa

SEQ ID NO: 228266 - DNA, 1032 bp, Homo sapiens
acgtgatcttggtgcactgcaacctccgcctcctgggttcaagtgattctcctgcctcagcctcccaggtagctgggattacaggcacgagcctccacacctggctagtttttgtatttttagtagacacggggtttcacaacgttggccaggctggtctcgaactcctgatctcaggtgatccacccacctcagcctcccaaagcgctgggattacaggcacaagccaccgtgtctggcctcatttatatatatttattctgatccctgattgtttcctcaggatgaattattaacactagaattactttgtcaaagattatgaacctaaggcttttgaatatatattccctgccaaactgcattccagcaggattataccaagttatcttctcacagtatgtgagattgcccacattttgtattcttgcaattatttattataatttaaaaacagccttttgtttttcaaaacaaatttattcctttattatctctttggaaactagtgaggtttttcactttcacttttatgtagttttcttttgtaaatattctgtcagcttgtatttttatcttgtttgcttacagatacatatgaccctttaaatatatgttagggaatgagtgctatacaatattcgtcacagtatattatttgcccactttgttaatactttctagaccttgtagattcagttccaagataattgagacctttttttgaagactttttcttaagattgagctccacgtacctctttctgcattagcagatgttaaacttaattgttttccttgtgtatctccatctctggactctgagctccttgagggcaaggagagttgatgccttatccttttctccccactgccttctccagtgattgacagtcttaagttcaataaatgctttttgaatgaacacatgaaaatccttgacataacaattgtaggaagtaggaagtaagagcagtaaagaattaacatttggaagggtatatctaattgtgacgtggagaaaaaatgtca

SEQ ID NO: 228267 - DNA, 391 bp, Homo sapiens
gcttcttcccaacacacttgactgaagtcaggtatttaagtttctatatctaagctgaagtcaacagtatttccataagtaggatcttgtcacaacagaaaaaatgaattataagcaatgaatagaggtgaaatatattcattcagagtcagtgtgaatacattccatctttcttcacttcctttaacctctcattttctccaggctgcttacaaatgtattcaatgtgttaacaaaaaaatttaataaagacattgccagaatatcagcattgggaacaaagaaaaatactttctatttggtgttagcataactgtgcattttaactaggtgtatatctctctgtgtataattaacatgctatttgtaaataaagtcaaatattaaatat

SEQ ID NO: 228268 - DNA, 136 bp, Homo sapiens
gaactttattgttatccttttgggtggtgatggtaattattcttcacagcaaccgtataagttaagtactattattatccattttacatatgggtaaactggatgccagaggtgatcttctggaggtgatcttctg

SEQ ID NO: 228269 - DNA, 607 bp, Homo sapiens
ccacagacagtacctatgtataatggactgacttgccagccctctcaaatggccaccatcagagcaaagacatgtcaccagggctcatccaccaattaaaggtgaaggggaagaaactgtaaaatgtggcaggaagcagttgggcacctacagaccattgaattgccacatgatggcatctacttcacatactggccaggccaagaggccaggtgaaaataacaactacaggagccattaggatgtatggcctgtcccccacccaagcaccaggtaattgagcagccaggtcattgaaccttacagcctttgggcaatggatgtgtgatatgcttgttcccgtgcaaacatctaggccattctgaatctttgtgaccattcctgacccagagtgggacctagcaatcgcaaggcacaaatctgaaatctaagattaacacagagataataactgtcctattacatgttgtctgcaaaaaacgacacatacttaaaagcatcttattggaaatgaagagattctagcagaagaggaatgataaatagaaattaattggaccattcccactgttgtgaatttaaaatgtgtaaaatattacaaataaaa

SEQ ID NO: 228270 - DNA, 440 bp, Homo sapiens
taaattattgaataaatgatgaattataggcagaacattcatctgtgcattcaataatggattgagggtcaggccctttgatgggtcctgggataaaagaagaagaagatgtagtgccacccttgaagaaatccgtcttatgggaaagatagacttgtaaataaaaaaattacataatcccagtacttcgggaggctaaggcaggcagatcacgaggtcaggagttcaagaccagcctgaccagcctgaccaacatggtgaaaccctgtccctactaaaaatacaaaaattagctcagcatggtggcacgcacctataatcccagctactcaggaggctgaggcaggagaattccttgaacccagcaggcggaggttgcagtgagccgagatcctgcctctgcactccggcctaggcgacagagtgagactccatctcca

SEQ ID NO: 228271 - DNA, 254 bp, Homo sapiens
gctggacatttttgatcctgtgttttgtctccagctgcacccaggctgtgagccagggaggctttagagttttagtggggaccatggagctgtggagagcattccttggccgaagtggagattgtatagactagctaataagacatctgtgcaaactgtttttttttttttaattgaggttatattcacataatatgaaattcaccattttacaagtgaacagttcagtggcatttaatacatttgcaatgctg

SEQ ID NO: 228272 - DNA, 416 bp, Homo sapiens
catgaggtaaaaatgaaaaactaagctacaggcaatagtgatattaaaaagaaaaagctgcctagcacatagcgtatactcagtaacttttttttgaagagttaagatacatttgggtttctcattaaaagcaaaggtaaaaatataaagtaggattttgggtatcaatgtttccagaaggggagcaatgtcacggaccatgtataaagtttattggagaattaacttggcaggaaaaaatgtaaacaagacaaagagaaaacaatcacaatttgagaaaaatgaataggtttgaaaaatgatacataaacaacattgggaatttggctggtttgttgtttgttgttagatttataaataataatgtaactatcttttataacaaagagctggtaggaataaacaagtcaaaacat

SEQ ID NO: 228273 - DNA, 499 bp, Homo sapiens
ggctttacagtctgggctcgtgatactcatggtgatgggttattgttgcttgtgccactgttaaaccaagtactgctttgaaaacaattcaaggccattttagaggaacccaaatgtcaggtctgtctgattatagtacacgcagttgtcaagctagaaaaaccagcatccgttggtgagctttgctgtccatgagctgtgaggagtcagtcaggttcctagggaacagccctccactgtatttaagacatagggctcactcccagatcgagctgctccaaattgccattttactcaagatcaagcatatcagaagtcatgttgtaagcagtaggggaactattaaattgagctgaaatagaacagctagaaagaagaaaataaatgtgtacttaaaagatgcaaggaggctgggcctattcaccagggtcctcctgtgcagaggtagtagctttttgtttgccctggactagtttaagaatcctctgccacgaagatt

SEQ ID NO: 228274 - DNA, 143 bp, Homo sapiens
gctcggtacctgcagaaatcacctctgcagaaatcacctcctccctaccagccaatactcaaacaagctttgatgagcatctgcaaagtaccagatcctgtggaaaataagaaaccattcgcccggcatggtggttcacacct

SEQ ID NO: 228275 - DNA, 453 bp, Homo sapiens
cctatcaaatgatatctaggttgtttccattaatatttttaaaattctgacctggtaccagcagcatgatgggctgagctaatgcaatctcttcccaagacataaggctcatagaaatactaggtgtaaaagaaaatatgtgtacttaaaaaaatttaggccgagtgcggtgactcacgcctgtaatcccagcattttgggaggccgaggtgggtagatcacctgaggtcaggagttcgaggcaagcctggccagcatggcgaaaccccatctctactaaataaataaatatatatatatgaattagccaggtgtggtggtgggcacttgtaatcccagctacttgggaggccaaggcaggagaatcatttgaacccgggaggcagaggttgcagtgagccgagatcgtgccactgcactccagcctggtcaacaagagcaaaactccatctc

SEQ ID NO: 228276 - DNA, 455 bp, Homo sapiens
caaacagggtgggctctagcgtcctccgtggaccctggacacacctgcctgaccaggctgggtgccgagcctgtggcaccctgggagggaagatggccgcagcacccacatctctgagagtcttggcagaagggcctggtttggaagttaaaaataggccccctcccaaggccaggcgcggtggttcacgcctgtaatcccagcactttgggaggccaagggcgggcagatcacctgaggtcagcagttcaagaccagtctgcccaacatagtgaaaccccgtccctacttaaactacaaaaattagctgggtgtggtggtgcttgcctgtaatcccagctactcgggaggctgaggcaggagaattgcttgaaccccggaggtggaggttgcagtgagccgagatcatgccatcgcactccaggctgggggacaagagtgagacttcatctcaa

SEQ ID NO: 228277 - DNA, 187 bp, Homo sapiens
gagattcagaggcactttattttgtagcatggacaggaaggcagctgggttgtctgtgttgtggggaagtggctctgctgttacttttccaaggagagggcaggatttctatgccaacagcagcctctgtgagggcaaagctggctgtgggtcaaactcagagctggccgctggcatctccacatcc

SEQ ID NO: 228278 - DNA, 464 bp, Homo sapiens
aatatctctaagattttggaaataaaaggaagtagttgcatggtttttcagccttttacataccctgtgtgaaaagcctcaagcagaaaatttatgttttaattgtcccaggaagcagaggtaaatggagctcctctttgcagcaatatatcttcaattgctgggccttaaagttcccacagaggccgggtgtggtggctcacccctgtaatcccagcacactgggaggccggggcagatggatcatgaggtcaagagatcgagaccatcctggccaatacgatgaaatcccgtctctactaaaaatacaaaatcagctgggcgtggtggcgggcgcctgtaatcccagctactagggaggctgaggctggagaattgcttgaatctgggaggcggaggctgcagtgttccgaggtggtgccactgcactccagcctgccaatagagtgagactccatctcaaa

SEQ ID NO: 228279 - DNA, 399 bp, Homo sapiens
caggtctaattcaagaatgaaactcttattagaactgattattattgccctctgctatagtttaaatgtgtccctccaaaattcatgtgttggaaacttaattgctgttggaacaatgttaagagatggggcctttaagaggtgattaggccatgagggctctgctctcatgaagggattaatgctattattgtgagagtaggttagttatctcaggagtgggctcctgataataagataagtcctgcttccattttctctttgtctcacatacatactcgcttgcacttcatgtgatgtcttccatcatgggatgacccttcccagatgcaggcatcatgctcttggactttacagcccccaaaactgaaagccaaataaacttttgttctttaaaaa

SEQ ID NO: 228280 - DNA, 534 bp, Homo sapiens
ctacacatgaacaagaagttctagaaacagttcgttttatctgaagtgctttctcttcctgcccactccgtccagcctcaggcccgctttctctgcatctccgcagagctgtctctaatccttcaggagctccctctgaatactgggagtctggttcttctctcactccacaacttgaaactaataaggagctgtcttacgtgacctgagatgtgtactctatttcctggctatttcctcaaatcctttcctgcagagacccctctctgccataagtaagagcccacctcgtgtttatgcccatgggagcccacagttggtattgtgtaatcacttttcggagttttattgactgcttatttccgaaaaagccacacctaccctagccactagtcaatgaacagcaaaatggaaaaacaggccagcaagctcaaatccctgttcagagaaaaccagctgccttgacagataacgtcaaggctgaaattcaatgtctggggcactcaagtcaataaaatatttattgagcacatg

SEQ ID NO: 228281 - DNA, 652 bp, Homo sapiens
ccaccaccattgcaactaatgtgtgtatgtgtgtttacatcatattatggatattgcttttttttttttcttactgtttttaattttttgtagagacagagtctcactgtgttgcccgggctggtcttgaactcttgggcttaagcaatcctcctgccttggcctcccaaagtgctggaattataggcatgagccaccgtgcccagctgtattctttaatttgcatttttactcagtagtgtcttgaatatctttctcttaacaaatatacattattattattattattattactatttttattttttaagatggggatcttccaagcaatcctccagtcacagcctcttgagtagctgggaggtacaggcacgtaccactgtgccctgctgatttatcccttttaaacaattctgtcataatgtccatgagatgactgaattctaataatttttttatttgagacagagtctcgctacaggttaatttttgtattttcttttttgtagagacagggttttgccatgttggccaggctggtttcaaactcctggcctaaagtgatctgcctgccttggcctcccaaagtgctgggattacaggcgtgagccaccatgcccagcctctaatcctttttttttaagtttttttt

SEQ ID NO: 228282 - DNA, 235 bp, Homo sapiens
aaccctcacccgcaccagcccactcctgaagaaggcctttgaatgactattccacagaccaaagcattttagtcagaggcaacatttccacaaatagtgtttttaaaaaaattacatgctactgaatatcattggcagtgttatctaaaatacatatacacagatatatatacacataatatacatgtaagtatatattaacacatgtgtattaacgtgtatgtatgtgtatttg

SEQ ID NO: 228283 - DNA, 239 bp, Homo sapiens
attatcaagggatctaaatatcaacgttagctctaataatcgatattagcatctcattttttgatccaactcaaaaaagagtaataaggatgtagaataaccaaaggtaattatgtccatttagaacaagtactttaaaaaagaaattcaaggaagttttttataacccaaggcataactactactgtgttaactcgttaggtcattagggtataagaagtatacatttaattaattag

SEQ ID NO: 228284 - DNA, 596 bp, Homo sapiens
aaaataatttaatactgaaatgactctgtcaaccttacattttctgttttaaaacaccacaagatcaccgtgttgagtttttgttggacaaaggagctgtttatgttatgctttctccttatttttttcaaatgataatctctatctctctagattttctttcctttttttttttaagaaaaatagaggccaggtgcggtggctcacacctgcaatcccagcactttgggaggccaaggtgggcagatcacctgaggtcaggagttcgagaccagcctggccaacatggtgaaagcctgtctctactaaaaatgcaaaaattagccgggcatggtggtgggcacctgtaatcccagctactcaggaggctgaggcaggagaattgcttgaacctgggaggcggtggttgcagtgagccgagatcatgccactgtactccagcctggcaatagagctagattctgtctcagaaaaaaaaaaaagaaaagaaaaatagaggccaggtgtggtggctcacaccttaatcctagcactttgggaggccaaggcgggcggatcccttgagttcaggagctcgtgaccagcctcgccaacat

SEQ ID NO: 228285 - DNA, 586 bp, Homo sapiens
  misc_feature (29)..(29): n is a, c, g, or t
gtctcaaaaaaaaaaattgtcagctgagnccaagagttcaaaaccaggttggggcacatagcaagactgtctctttttttaaaataaataaataaattctgagtatcaggttcttctggacaataagaataatggctcctgccattttctttcctttttttttttaagaaaaatagaggccaggtgcggtggctcacacctgcaatcccagcactttgggaggccaaggtgggcagatcacctgaggtcaggagttcgagaccagcctggccaacatggtgaaagcctgtctctactaaaaatgcaaaaattagccgggcatggtggtgggcacctgtaatcccagctactcaggaggctgaggcaggagaattgcttgaacctgggaggcggtggttgcagtgagccgagatcatgccactgtactccagcctggcaatagagctagattctgtctcagaaaaaaaaaaaagaaaagaaaaatagaggccaggtgtggtggctcacaccttaatcctagcactttgggaggccaaggcgggcggatcccttgagttcaggagctcgtgaccagcctcgccaacat

SEQ ID NO: 228286 - DNA, 268 bp, Homo sapiens
atccaagaagtttacatccatgcacctccctaaaaaggataaaacttagcctaatgtccaaattaaaacagctattcttgcatgcagtcattcaaccaacactaagtgagcactgacacaacagtgttagccacagtacatgcagggcaaatgatgtgtctctgctgcatcccagaggactcaggtcagtaaatgactgcaacaggaactgatgtgggttactaacggagacatttcccacagcttaggaaatggaggggatcaaggg

SEQ ID NO: 228287 - DNA, 280 bp, Homo sapiens
acaggatttggagttgaggaatttgccattgtctgaaagttatttgagtagtaactcagatggttctaacaaaatctagcttgttgacaagcagatgctcagttttggctttcaccacagggagagttttcttggattattaatgaggtttagcttattttctcacctttacttaatggttctagttcatatttagtgaatagtcctccattcatgttctttgcccttttatctataacggtgttatgtttttcttattgatttatctatgttattaacc

SEQ ID NO: 228288 - DNA, 428 bp, Homo sapiens
agtccagatgtaggtgatggcccaggctatggcccatctggggaaaggtctccttccaagcttatgtaactgttcttaggattaacctctctgacctcatcaagaagaattcattagtgaattattggaatcacttaaacaattaatactaatttattacaaattattcccataatgtggagaaggcatgatttcccattgtatactgatttagtttactctgataccacaactagacaaagacatttcaaatatggaaaatgaagagcaatataccttatgaatacaggggcaaaaatcatcaaggaaatattagtaaaacaaaccagaaacatgtaaaaagtattatacactatgtcaagggtatttacctcagaaaagcaaaatttagttcaacatacaatacaattagtgctatgcactatatt

SEQ ID NO: 228289 - DNA, 487 bp, Homo sapiens
cggcacgaggattattagcacaaattttgacttaggctataagcttcacctgtgaaccttttcttttcccctcgttttactcttaccccagtatcctattatctcatacctaaggcagtgatggtttctcagacctcttagattgagaagatgtggcatgggtgtaaggtccctcaggtaattctgagggttgggtaggtctggtatctactcttttacttaattgacttcctccagcctggtggacagagcagactctgtctccatcatcatcatcatcatcatcatcatcatcatcatctctcaagcatcagtaagaccttattctataatgatgatggtcacacaactctgaatagactaaagactagtgaattgtgcacttcacataggtgaaatgtatagtatgttaattatatccaagaaagctgtttatttctaaagggatttatcattctaataacaaaaataaatgataatagtgtga

SEQ ID NO: 228290 - DNA, 388 bp, Homo sapiens
gctggggctggccggaggaaggggccctgggtggccttcagctgctagagagcaaaccccacaaacctaccgaggatgaagttgagggacccacggttaatcctacgtggcctgccagtgagtcccgggctccccagggaggctctgccccttgcaagcctgagacttggccaagtcactgtagcgagctaaacctcagcttcatcgtctgtgaactgggaatgccagaaaggatagaaccagggagactgtaagaaaatgccttgaggctgggcgcggtgactcacgcttgaaatcccagcactttgggaggccgaggcgggcagatcacctaaggttgggagctcaagactagcctgaccaacttggagaaacactttctctactg

SEQ ID NO: 228291 - DNA, 280 bp, Homo sapiens
aaaaaaaaattctgaacatattttgaaggtaaaatcaataagctttactgatagatttggatttggcatataatataaaaagaagagaaagacaagaatgactccaaggattttagctgtaacaattagaaggagaaaagttgacagttattgagatgtagaaggctgtggaagtcaggcacggtggcccacacctaaaatcccagcactttgggaggccaaactgggaggattacttgagttcaggtgttcaagaacagcctaggtaacacactaatac

SEQ ID NO: 228292 - DNA, 574 bp, Homo sapiens
gtggaatcattaaagtaataataattattaataacagtaatggtagccgagtggcacgcgggggcgtgtgctctgcgggacagtcccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgagacctggagggcagctggagccacaggagaggccgtctccaggagccctgaccttggagagggacacagcgacccggcagggaggagctgctgctgtacactgacctcacccctcctgaccgcttggcttgtctaccggctacgcattggctgaactaggtggaggccagggagcaacgaggccccatggatcctgtacctacagtcagcttcccggggcacagagcaggggctggcatggggcaatgggaagatgtccagcacctgttttgaagtgtgaataaaagcatcgtaga

SEQ ID NO: 228293 - DNA, 356 bp, Homo sapiens
tttaaaaatagagaaaagagtttatctttaaaaattaaataactatatttaaaatactttttttttccaaaataaaataacaatctggaagacaatggaattatattatcaaaataacttaagaaaatatctgctaatctagaattctgtacagcaggataccctcaagaatgacaattggcattatctgtcaaatttaaaaatatgaaaactttattccaagtagctttatacctaaggtctacccaaggtaagaaatgtgcacacatgtacacctagggacatgtatcactatgctcactacagcattattcttgttaaccataacttgaaaacaacccaaatgtccatcaaca

SEQ ID NO: 228294 - DNA, 479 bp, Homo sapiens
gtggggctgctttgccttctagaggagatgcagttattttcccctagatggtttgtctctacatgcccattaagacgtcactctactataggcagttaagaactgacaatagctttccattctgtgttgttgatgaaaatttttattttcacaaaggcttcctgggtgggtaaatcacttcattcctcttcaggaagtgaatcagtccatagaatagcgctgatgctgcaaagccatctacaatctcctctaggatttcaaccctagcccatgtgctcgcagctccctgtacagaagagttgggagggcaaggcttatttattcatccccttgagcatctaagagcctaggttctttgatgaaggcaaaagttttaaataaattgatcatacaatttaagagataacacataaaccctcacagacagcaaagaataattccaagactacttataaataaatgcacatggtatacattaa

SEQ ID NO: 228295 - DNA, 335 bp, Homo sapiens
ataaatttacacacgaataaattgacactgtagcactgtatattgatgttcatcatactgttgaaagtctgactaattactcaatttttggagatagcattatttaaacagttcactataaaatgatatttaagttctcaattttttatattgtaaatggcaagtgaatatttttatatgtgtctgcacagtgtgcttctgtaaaacactcctaaaagtagaattggggagtatattttaaaatggttattttaaactggaatgaggtaatctgtgagtttcaggttgatagatgaaaatacatgcttcttgttagacaataaatttctcttaaa

SEQ ID NO: 228296 - DNA, 406 bp, Homo sapiens
tgcaagcaattgcttattatatgttcaaaccctttttatgggtcaaataatgtcacagtaatgttatttaaattgtgttttgctctgctacctcatagatacattgagtcagttgataaatatttgtcttgcatattaataataaatgtcaagcaatcctatgaaacatgaagaaagaatatgaacagccacttaacatgagaagtaatagaaataatcaataaacactttaagaatgcttacagtttgaataagaaggaaaattaaaatgaggccttgataaatgtatcatattgctgctgcagtgttggatcctgtagtccccgttatttgagaggctgaggtgggaggatcacttgagctcaggagtttgaagccagcctaagcaacacagcaagactctgtc

SEQ ID NO: 228297 - DNA, 506 bp, Homo sapiens
atagtcatgctatagtgctgtagaacattagaactcattctttctatctagctttgttcttgtatccgttagccaacctgtggcagtccctcttctgctacattttatgacaatttgttgtatagttcaagatccttctttcagattttatttttaaatggcaggggaataggtacactcaagtacgtctacattgttagtaggcctgatatagatttggggcaagtggacatcaatagtccttcctcagccaggcaaggtggctcatacctataataccaatactttgggaagccaaggcgggtggatcactttaacccaggagtttgagaccagcctgggcaaatggcaaaaccccatccctacaaaaaatacaaaaattagttgggtgttgtggcacgtgcctgtggtcccagccacttgggttgggggtgctgaagtgggatccgcttgagccataggaggcagaggttgcagcaagccaagatcatgaccctgtctttaaa

SEQ ID NO: 228298 - DNA, 318 bp, Homo sapiens
ctagctaaccataccaagtgaagcttaaataaagaagctctatgtctggtgtttatcttgtgctcaggggtaggtgtaatcacttggcacactgtgtaaagaaaataggctttcccaaaacctcgctatagagtagggaggttccaccagacatctcacagtcttagagctcagagtagctaaacatgcaagtggtcagtgtaggcaaaaagcgacagacagacgttcacaagatcacagtgaaagttctgtctaaatactaggttaagggatagttatcaatccctagttataatgttagtagacacatttggagca

SEQ ID NO: 228299 - DNA, 477 bp, Homo sapiens
agccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaaaagttgtaaaaacttcaaagtgcctgttgtagtatatatctttaataaatactcccctgctatatttgttaaactataattatgagcatacatttcataaaaataaagcccatttactcataaactgtatgtttacatgaaaaaatacacattttataacccactccagacctactaaatctgggcgttagaatctcaatcttgggttttccaacctggctcctttttcgaaataacctggaacacttaaaa

SEQ ID NO: 228300 - DNA, 479 bp, Homo sapiens
gctccggcctgacctctccacggggtccacaggaacgtctccggctgccaggagtcgcaaggggccgagcaggatgaggaaaccacaggcggagtccgggggaagcagcgtggcatcccagcctcaggcctgccaggacggtgttcgggggtggagccaaccaaagtcaaagaagattgttgtatcttttcacagctcttctctgagaacgaagccacacaacgatagaatcttgaagaagaagctaggaatgggagatggcaacaatccctgtcactggaacactggtctctctggacaagtcaccagtttggcacccctccccttatgcctgtaccgatggcatggtgctatatcctgcctgggctctggcctctgctctgtcctccctcttgctctgtctcccctgtttctgaggggccttgatgtttcttgatctgtctgaatgtcttcaacaaagaccacttcccagtcctcca

SEQ ID NO: 228301 - DNA, 437 bp, Homo sapiens
gcctagcagtttgagatcagcctggacaacatggtgaaacccgtctctactaaaaatagaaaaatgagccaagtgtggtggtacatgcctgtagtcccagctacttgggaggctgaagtgggaggactgcctgagcccaggaggcagagaatgtagtgaactaagatctcaccactgcactctagcctgggtaacagagagagaccctgtctcaaaaaaaaaaaaaaaaaagggaaaaaaaaaatcactggaagatctgaaaaagcttttattatatgggttatatctactgatacttattgatatggtctggatctgtgtcctcaaccaaatctcaggtcaaagtgtaattcccattgttggaggtggggcctgcctggaggtgactggattatctgggcaatttctaatggttcagcaccatccctttggtgctg

SEQ ID NO: 228302 - DNA, 1080 bp, Homo sapiens
cttgagcccttcatgggctagcacaccaacaccatccccccagatgcttcagttgttggcttcgaatggcttactatttccatttctacggagaactgccatctcaggaatcacctcaccctggagtttattcccctcacccacagggtggctggcagccaacagctgactcgtacagagagtggcacaatgaagatttgaacccacgtatgtctcactggacgtatgcccaggaactggtaagctataaaaagacctcctttattgtctggagacatagaattagtccaaacggtgtcacctccaggaagccttactgtcacttccatggaggacagtggcctgggcccacaccaccctcctgcctgtcttcagcctttgctagtggatccttttcccacttcgaagactccccttacatcctcctccatgttgtcctccaaatgtgctggctgagagcccagcgcctgaatcagagggacctgggtttgaatcccacctctgccattgaacaccagctgtctgaccttgactgcgttcctttgcttctctgggcttcagattccccatctgaataataatagaagctaccttgggattgcctcaaggatcaaatgcgagagagttcaccttaaacaatgagtggagggcctggtgtgtaataaagcactcaataaatgttaactattattgatcttcaaaaaggacgaaaaaaactaaaacacaacagacaccgacaaaagaaacaagacaaaaaagagggggggcgccactaaaatgtcaaccagagagaggccaccagcaatacgagaacgcacacgaaatgtgtgtgacaaggggcccccaaaggggagctgacaaaacacagaggagacccacacgcgagagcgggaaatacaagaagcgcgggcgaggcacaaagtaagcacaacaggaaccatccgtggatgagacccaccacactacgcgcggacccaccaagtgacgaacccctccagaggaagagaagaacagagaacaacatagacggaagctggagaaggtgcaacacacacaagatggagcggacaaaatgacaca

SEQ ID NO: 228303 - DNA, 430 bp, Homo sapiens
cttgagcccttcatgggctagcacaccaacaccatccccccagatgcttcagttgttggcttcgaatggcttactatttccatttctacggagaactgccatctcaggaatcacctcaccctggagtttattcccctcacccacagggtggctggcagccaacagctgactcgtacagagagtggcacaatgaagatttgaacccacgtatgtctcactggacgtatgcccaggaactgattgggaaagtgaggcccaggggtgcaaaccagtccaatattagcggcagagctcttccctagacccgtcttgaagctgctgccccatcatttcctccaggtagctggtggatactgtttatctggtgctcactatgccctaggtaacactgtaagtgattttcattaaatttaatctcattcaatcttag

SEQ ID NO: 228304 - DNA, 523 bp, Homo sapiens
agtgagtcatcatctgtttcatttatctggcattcctaagctacctttgtcgggctgcaggaattaatggaacacaccagtttctaagcaaactttttggattttaggcttcctgatgcttcaagcagggtcaccaggaccgctcagggagagagaacccagaaacctagcatgccagcaaaaggatggatcagagggcccctgaatcatccagaaaagagtgtattttcacaggtaaagaaagctttttatggtttaaatcttctggaaacattagagaaagactgtcattgctatccacactacaacaaaacttcatccacactacagcaagactttgggctttggattcatggcctcaaaactgagaagggtccctccacatttttggaactgtgcacccattggaacccttgagggaaagctaaccagggaaatttgaagaggatgccatccttgatgggaacagcttttcccaaggtcacagattaagacttatattgtcatgaaaatcttacctttg

SEQ ID NO: 228305 - DNA, 1233 bp, Homo sapiens
tagatatttggtgtcagggttgcccaagacataacctagaggaagatgggtcagagaatgcttctcagagctgagtcttcaaggttgtgtagaagttctccagaggacaaggtggtagaaaggagtctaaacaaaggaaggaacttgtacaaagacccagggcgagcaccactcatttggagagtcgggagagatccggctgaaggggctagcagggttcttgaaaaccacaccaagaggtttaggctttatcctgtaggtggtgaagaatcaatgaaaggttttaagcaggaaagagaacgtgatgtgcttcaatacattctctgatagcatgtgaggaagtaattctcagtgggagagacagctgtgattgcttgattccacctctcccttgccccaagctaataatcatcagatcccctgtgctttgctggaccctatcccagacttacagagtcagtctccaggtctggatcccaggtatctattgttgaattgttcccaagtgactctgacatgtgactgggtctgggagctgctgaattgagggtgccagggggatctttgaggagacctagggtattcttcaaacagtgggtttcccagggaggagcttttccataaacaagaacagaaacaaccttagtttaaaacagaacaaaaaaccttcccccagttctgatctattaatgatatttgccaacttccattgtgtataatcttccattgtgtatccaaacacttacctgtgcctactctgtgctacagcttctgctgaatgactgcaatacagtgacttgtgggacacaggctctgcccttgaaaagctcacagtattgtggaaaggacagatttcaaccactagaatatatatgataagctctattctagagatacgtttttaaacaaaagagtgttaggatatcctagagcaaagccaagttcattcttcctgtggacttaacaggatgtaacacccagatcgagcctaaaaaaaagagaagaaaaaggcagaaggaacagcatatgggaaggtgtgactactttatgtatttggtccttcttggcaggatgtgcagaagcagagaaggactgaggagaggcatgctatgtcttgggaagggccctgtgtgtgtgccttcggttctgtgcctgtgagcctgccttcatccttcagactctgggtggctcccagcacagcagctgcatggttgtgcagcctgtgggccaaca

SEQ ID NO: 228306 - DNA, 664 bp, Homo sapiens
tgaaacaacagcagcatttggtttgctctacacccctgccacccctcgcccgcaagcccagggagtggtcagcagtggggctttgtgacgtcgaagccaccctagggctgccattggctgggacactgcctgtatgatcaaacaaagctcaagggtgtggctttgccttgtcaccaggagggtatatacagggagggcaagagctccgggccactgcgaagattcaaaacctacaaaagcctgccgctgacattgaagaaccaatatatacaatggacaaacaatccagtgccggcggggtgaagaggagcgtcccctgtgattccaacgaggccaacgagatgatgccggagacctcgagtgggtactcagacccgcaacctgctccgaaaaaactaaaaacatctgagtcctcgaccatactagtggttcgctacaggaggaactttaaaagaacatctccagaggaactggtgaatgaccacgcccgaaagaacagaatcaaccccctccaaatggaggaggaggaattcatggaaataatggttgaaatacctgcaaagtagcaagaagctacatctctcaaccttgggcaatgacaataaagcgcgatgcggccgaaagtcccttacctctgtcagcatagatagtatgaggaggtaaa

SEQ ID NO: 228307 - DNA, 620 bp, Homo sapiens
tgaaacaacagcagcatttggtttgctctacacccctgccacccctcgcccgcaagcccagggagtggtcagcagtggggctttgtgacgtcgaagccaccctagggctgccattggctgggacactgcctgtatgatcaaacaaagctcaagggtgtggctttgccttgtcaccaggagggtatatacagggagggcaagagctccgggccactgcgaagattcaaaacctacaaaagcctgccgctgacattgaagaaccaatatatacaatggacaaacaatccagtgccggcggggtgaagaggagcgtcccctgtgattccaacgaggccaacgagatgatgccggagacctcgagtgggtactcagacccgcaacctgctccgaaaaaactaaaaacatctgagtcctcgaccatactagtggttcgctacaggaggaactttaaaagaacatctccagaggaactggtgaatgaccacgcccgaaagaacagaatcaaccccctccaaatggaggaggaggaattcatggaaataatggttgaaatacctgcaaagtagcaagaagctacatctctcaaccttgggcaatgacaataaagtttgagaagctga

SEQ ID NO: 228308 - DNA, 316 bp, Homo sapiens
tcctggcctctccctgttttcttaacagatgccggagacctcgagtgggtactcagacccgcaacctgctccgaaaaaactaaaaacatctgagtcctcgaccatactagtggttcgctacaggaggaactttaaaagaacatctccagaggaactggtgaatgaccacgcccgaaagaacagaatcaaccccctccaaatggaggaggaggaattcatggaaataatggttgaaatacctgcaaagtagcaagaagctacatctctcaaccttgggcaatgacaataaagtttgagaagctgatggctgtgtata

SEQ ID NO: 228309 - DNA, 1162 bp, Homo sapiens
cagggggcagtgagatagtgttggcaatcaactgtaggcattagggagcaattggtaaagtagcagatccagggtactattaacaatcccattacaaaggctaaacatttatttatttacacaaaatcctgtaatgaacaattagaacatgaatatcagctaagccaggacaaatggtgcaaaacactgcccgcagaatgcaatgtattaatttatgaagtaggctataatagcctttatcatgcaaaccttgtatttataaaaagttaaattagtcttaccatgatggagtaacttgagactagcccttccaccaaaactactaaaaaactggacaagatacatgaaacagctattcttggatgctgaacaatagcaccgaactgtgatccctgagagaagacaagcaaattacctgtgccttatgattgtcaaagctttgtattttgaggcagtttccagaccccagccagaaagggagaaactgagaatctagggagggtggaaacccaatcagaaacttaaatgtgtctccgaaggctgaagcagctgtaatttgtgaggcactactacatctttactaaattagctgcacatgtattaggtgagatttcacgagggtaggcaaagaacaaccactgggtaacaagcaactacttgggaactataaacacaactaccagagtttacacaggcattctccttctgactgattaaagagaccttactaaactcaggccattcagctgaaacctttataaacacagctcaactagcccgagggcaaaggctcctctacaggcccagatgaacaaagctttaaataaaaacaagcctaacgttgaattatggattttctaacatatccaaaagtaaactgtatgacaatagcaaaaagaacagaagataggaaaatggagacataacgccataggattcttatacattaagtggtatataatttgaaggcagaatgtcgtaagttaaaggtatctactatagagcagccacagagaaaaatagaacaaataagtatatctccactaaaagaggggataagatgaaatattacaaaatctttcattcaaaaaatgacagaaaagaatagacgggatgaatagaaaacaaatggcaaaatggtagactgaaacctaaccatatg

SEQ ID NO: 228310 - DNA, 229 bp, Homo sapiens
tgggatgggggacagggtctcactctgtcacccaggctggtgtgcagtggtgcaatctcggctcactgcaacctctgtttcccaggctcaagtgatcttcccaggtactttaaaagatagaaagatgctcatcctagtgacagaccaagagacaatacaacccaaattggacaattaaggtgccgtgattccctacaagtattgctttattcccttctgtcgtcttctc

SEQ ID NO: 228311 - DNA, 358 bp, Homo sapiens
ggggtttggggcggtgtcctcagtgcgcagagcggcttaaatcagaggctgagcccggcgcttccatatcacgctgtactctagctaaggactgggaagcaagtctatccaaggctccttcatgtaaccacgcggcagttggcaggcactagtcctagacaactgagttctccctgaagaagagttaaagcaaaataaaaactcacaaaaaggaaaacaacacgaataaaaagaactagcatgggacctaaaggacgttgctgaacaaggaaaagagcccatcaggtagaagacccagaggaacaccaggcctctgaaaactatttctgaacctaaaataaagatatttagaaaactg

SEQ ID NO: 228312 - DNA, 463 bp, Homo sapiens
agtgcccatgagggaagcctgcaagttgctgatagggcagcatgagtttgtcagtaaatatcagaagaattacggaaatagttgatgttctcatttaatcttactcctttaatcttcaggatttaatctctcttttaaggttttagagatacgacttttgaaattatcttggatcaaacaaatcggtacattaaataaatatattaaagtcacatgtgtaacagtgtatcaggaaagcaatcatgtgattcaggggcattcttactggcattttatttaaaacgttttttcctttcatgttagatctaccatttattgcattctttgaagaatacaaaagaacagattagatttgagatttgaacagatgagatcccttgtcctaattcatgccagaatataattgaacttgacttcagattacgtttatccttgacacttgaagtggaaaaaaacccataaa

SEQ ID NO: 228313 - DNA, 377 bp, Homo sapiens
gaaaggagatcctacaggggcccagagccgagagacttgaaagaaggcaaaagaaacatcagcaaagtatgctattgatctgtgacccagtgaaggacagactccttcactccggggtcaccctttctcccttcaggggcaaagaggaagtcataagattccatttcatttcattctagttttatttgtagaaataatcccccatacttctagaaaagattcatggaagattacagttaaaggcagggtaaacaagagcagaagaactaatgttaaataaagaaaatgaaacaataggcacaccagaaacccaggccaagaatagctacaacaattgatgataaaagttagttctgagcttctttgtcttgagaatt

SEQ ID NO: 228314 - DNA, 529 bp, Homo sapiens
accaaggggactctgcatgggcacatcccggccctcctccctgcatgttctccaagccaggtctttgaaacctccagtgatgggaatgacagaatctgggatgattttcttctgtttcttatctaaaaaaacaacaaaaagctcagcatacacggactcacacaaaccttttgctagaggcagctctgtagacttaagacgctgtcatttttcagaagaacccagcttgctttggaactacagtcagccctgcaacccaccctcaccttggaccctgctgctgctgtctgtaaagacaatgctgcgatgaatacacctgtgcattcttttttagaacaagtgtaagaattcctatgtggtaagtctgtttaaagagaatttcagattcacgtgtagatgtgttaagtttgagcgatgttgccaaactctcttgaacttataccctctgtaataatatattgggatatttgtttccttttgttcttgtcagttttcatactataaaacttaaacatgtttgacaatctga

SEQ ID NO: 228315 - DNA, 254 bp, Homo sapiens
acctgcatcctccagaacttgcttaatcatctgtaagttcttcatttccactgaatccttctcttctgcctacatataggctcagttctccataaaaataccattaacaacaactgaagagaattttgatcaatcccaacacccctttcaaggtatcttgaatgttcctttgttcccttcttctataatgacataagagcgccacctgccctcacttccccaccaagaccacattctagtgacctctgtcatcg

SEQ ID NO: 228316 - DNA, 507 bp, Homo sapiens
gagtgctcattaattaaatttgtttggctttatatgtaaaatgaacattgatgaaattttaggtctagtatttttctgcaacagaagaatatgatttctgtcatttgggctagattaggtctggtaggaatgacttttggcatatatgcaaattttatagatagcttctcctgtgtggccctatgtatgctttaaatgccatgaaattgtcgatgattgtaatcagatacgatcccagagctgcctttttcctttagtaagggactgttctctaaggttaattttgtcaggctttgaactttggtaggggagtcatatagtagaaggctaaagaaccacagaagattagcctagtgattttcaaactctaacccaaggcaccctacaagttgttcagaaattcttcagtgccactgcaggagagttggaaagatgaaaaggcagaattctcatctccatatctcactttaggaggagcatcttttatctcttttatattgagttttc

SEQ ID NO: 228317 - DNA, 326 bp, Homo sapiens
gtaaatctattctgttccacagtgaagggtcagagttggctactttctcccaatgggtcagaagtgagactgcacaggtttcattcagcctctacctcctgctgtgccaccttaatcaaatgcttatcctctccaggacctcaacagattcgtgttactaaaatacctacaaaaatgcttgtgtttatgtttaaagaacaccttccaggccaaggtcagcccccgtggaagactccccaacagtcgtggatgggctggaggagagaagtcacaacatgtttcctgttaaaagaaactttaaaccgtaaatcactttctcacaagga

SEQ ID NO: 228318 - DNA, 484 bp, Homo sapiens
taaaccccaagggcccattatatgccagcacggtcctagagattccacactcattcagttccttttcatcataggaagtgggcattataatatcaggtccactgtaagaggtggagcctgggcatggtggctcatgcctataatcccagcactttgggaggcctacctgtgcagatcgcgggagcccaggagtttgagaccagcctgggcaacacggtgaaactctgcctttacaacacatataaaacgttagctgggcttggtggcatgtccctgtagtcctagctattcgggaggctgagatgggaggatcgcttgagcctgggaggtcaaggctgcagtgagcccagattgcacaactatactccagcttaggccacagagcaagaccttgtctcaaaaaatacagtaaaataataaaaagaaagaaagagaaaggaacagatcaataggtacaataaagtaacgtttgtataaaaaaagc

SEQ ID NO: 228319 - DNA, 672 bp, Homo sapiens
gttcctataagatcagtgccagaagttctctctgcaaagggaaacaaggtcaaagttccagattcgatgaccacattggtgtaccctgcccatgcatcccctcaattgcatccagcttgggcctgtcttgaagacagatgggaaagatggagagaaatgcctgctctagatcctggcacccaaacctcatgctgttccagggactgtctcaaagtgccacagacttgggactgggaggatcctgtggaggacaccgagtctcctacctcaaataaagaggcttcatctttcctcaggaaccctcagcagaggtgatgcacagttctcccagaagtctagcccaaatcactctccttgctgcaagttctgcccactctcttttccatccttcaagtggacagaatgaactggatccaacatgacaaatcttcacacatgaagctacagaaggctttatccactaaaacaattccgctgtggattccccatcacagggtttcagtatgagccaaggatgcattcaggaaataccaaaggacagacatttagagacacatatgcatgctgcccctgtccaacctcaactgtcctaaaggaatacccccagaaaaagcctaaaccatcatggctaaatccgctgtaaataaagataaaccattatttcctccttca

SEQ ID NO: 228320 - DNA, 603 bp, Homo sapiens
gtgctgttctcagatatcctctgaagtgtgtaggtgtgaagggccatgatatttgtactttctctcaaaggcatcagcaatcatcataacaataatatacacatgtagaaagagacagaaagaaatgtgacaaaatgctaacaattgttgaatctaggtaattgtagctgggcattcattgtactatccttgcaacttcagatagacttgaaatttttccccaaaaaaatatatttttaaactaaaagtgctatctgccttctgtcctgcttatgctttgtgtgtgtatgtgtgtgtttgtgagtgtgtgtatatgagtgtgtgtgagtgttgtgcccaccacccagttggtgacttgggctgggtagccctcatcttccagcctcccctttgaaaactggctcatcctgtacaggttggccctagacagttctcagtgatgtgaccaccagctcagaccttgtcacttgtcacagactcctgctcccatgaaactgctcatggaactgctctgggtgcagggccatgtcttttccttcccacttcccaccagttttttcaaacctggggctatctttcccctccttgaatcttcaagggaga

SEQ ID NO: 228321 - DNA, 499 bp, Homo sapiens
aatcacctcacccctctgggctctgctgccttcacgagtaaatgaagtaggctaatccaaggggccccccagcccaagtgactcgcactcttcaactctaccaatcttccatgctatgcagaagagccaggtctaaaactcaggcataaacccgtgctggactatcaggccagtgctctttccacttcccctgccatgccacttctaataaaaggcagtagaaaagcccccaaagcagctcttcaacaaatcactccctcagcagctaggacttggcctctgggtacctcttcccccaacttcctgccccatccccagggcaagttacccagggagctaatgggttgtcctatcttccaggaagggagtggaggacagcaggtgtcgaaaggagaagtgaggccattgcatccagggggccagcccggaaccacaggggagagatgtataacagagagataaatgtacacttttggttctcactccctagtttcctcct

SEQ ID NO: 228322 - DNA, 356 bp, Homo sapiens
aaccacgagatagtggggattgcagagccctgcgcaagagaaggaaaattaagacgcagcggagcccaggaggtgcccgcacgcgggaaggactggcgtgcagacgaggcagggggaggtttgcactcggcgtggcgcgggtgagccgcgtgctctcgggcacccggccgccagttcggatgcttccgatcctcggggagccggggcgctgcgccggagtcacttcagcccatgttgttcaggtgacacccggggaagagcagactccagtgtgcaaaacgtttcggggtttccgggccagcggttccgggcgcgcctcgcgggcggcggcgcagaactacaacccccaggctccc

SEQ ID NO: 228323 - DNA, 414 bp, Homo sapiens
ggatttgcatatgttaatatggagaactgcaactatttaatgagaagcagtgggccacgtggcctcccttgacagggcagctttagtgtccgtgcttcccagaaccagtgctgcatgctcacctgctggactcccccaggatgtatagacatctcataagagtgggggctgcctctgggaagggactggaaaaaggctaaggggaaggagctcgggggctggcaagcccggatgcgacaaagcaccgaggtgggcttgaatatggatttttctccccagaacatccctgggaatcatttctgtcagatgcttcactggatgtcccttggtctttacagccatctatcctccttctccaacccccacctcgaattgcaacttgctattttaattatagtttctcttgccacactt

SEQ ID NO: 228324 - DNA, 470 bp, Homo sapiens
catagaatccgggccttgatgcccaggcctcgccatgcatacctgctggccggcatctccctgagacccgtctggcacaggcaacggcagggcccggcccttggagcacagggatggcagagcagggtcatcgaagcaggtggcgtgcagacagtggcttctccgcaagagctcctggctctcagggagctgagggctcctcaatggggaattctggctgagctccaggggaaagcgggttggaggcctggctcctccgcccccatctcctctgccccaaccctggaagggggtcagatatcaatgctaacatttgtgctgactcaattaattcaaacgattcacaaaaacaaacttgcttaaagtattaatttcctaaaaagaactaaaatgagttcaaataattcacataattaaattattttaattgttaatttaattaaaacatctcagttttcaaagcaaaaaaa

SEQ ID NO: 228325 - DNA, 568 bp, Homo sapiens
agataaaaaacaaatataacagcatttaagatgtatgtagaatcattgaaattgtacaatttgtatttcacagtacacgcatgcatatgtattttgttcttactaaaacagtggaaatgcggcatgaaactaaatcaatttttaaaaattttatttcttgatatgtgcatattccaccaatactctacttttggcctgctgatgaagagtaaggaaggactgaaaggaggagaaactatgggttgccttttccttctgtcatctgttcagcgtaagtggttggcagctttaaaaaaccatttactttgtactctcattggtcttctggaattcactactcatagatgtattgaaaacactatatatgaatggggcctcaaggaacagcagcagacatgtgtctgtaagtgctgatgtataaagatttccaagataccatattaataaaaaaagtgtatggaacagtgtatgggtaattgagtgtaaataaaaaggaatatgtgttatatatatatgtaagtactttgtatatgcataacttgtaaaataaaaataattttaagaaact

SEQ ID NO: 228326 - DNA, 206 bp, Homo sapiens
tataaactgaaatcatgttgagatttaccatcatacaattctgatttaccatcacacatctcacagctctgtcatataaaatcaagatttaaaaaagtaaatgctatttttgtaacataaaatacaaattgacttttaaaccaaaagtattcataatatttgatgaagattaattatttttaatttttaaaaagttttataataga

SEQ ID NO: 228327 - DNA, 457 bp, Homo sapiens
caatagtagatgcaaatcaatggaaagacagtccttgttcttggaagactcaacaaccaagaaagacgggtgccagacatgacgtgagagtatgtgaggatgaccctagatagcctgacaagggtatcgcctgagaatgtgtgaagatgaccccagagagccttacaaggctatcttgtaaaggatgttcagatttacctattcaaggcccatcttgagctctccctgccacagccctgggatcagccatttctcccaggagccctggtccgtattcatgggggatggtatttaggagcagtgttctgggtgccaggagtgctcagtgccactgggatgtcattgcatccaagtcctttcagcatttctgtattagtcagtattcacactgctattcagacatacctgagactggtaatttataaataaaaagaagttgaatggactcacagttcca

SEQ ID NO: 228328 - DNA, 382 bp, Homo sapiens
gtatccaaaaatcggaggtcagtgatgttgagcggtttgctcaggatggtagaggcggctctggaggtggccccacatctgctgacttccatgttcaggttcagagttgtgggttcagatttcagaatgcggatccatcagagaatctgtctggtcactcactttcctttgcacttttcaagaatttgatcctttttctttttaagagggagaacagagccctcttggctggcaggtgtaaatcttcactttggggtttgtttgtaccagggtatgttctttctcacacacccacatacttaccctcgcccccacttgcataggtaaacagcttttaaatgtgtattttctttcaaaataaagccacttaagctttaccaaa

SEQ ID NO: 228329 - DNA, 1965 bp, Homo sapiens
accagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataaataaagtatagtatataaatacaatggggccgggtgcagtggttcatgcctgtaaacccagcactttgggaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctc

SEQ ID NO: 228330 - DNA, 2241 bp, Homo sapiens
accagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataaataaagtatagtatataaatacaatggggccgggtgcagtggttcatgcctgtaaacccagcactttgggaggctgaggtgggaggatcactcgagcccaggagttcaagaccagcctgggcaacatggtgaaacctcatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatat

SEQ ID NO: 228331 - DNA, 1921 bp, Homo sapiens
accagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatat

SEQ ID NO: 228332 - DNA, 750 bp, Homo sapiens
tagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctc

SEQ ID NO: 228333 - DNA, 230 bp, Homo sapiens
gttacagcaaaaaatatacaagtttctatttacatatgagatttctttggatgcaagtattttttctgtttaatgagcctattccgatagaccatgttttgttcactaatttgaataaataatttttgaaacgaagcaaaatgttctcatttttttctacataatgattcttttttttcctcattttttaagtaaacactaaagtttttctgaaggttactagaagataa

SEQ ID NO: 228334 - DNA, 412 bp, Homo sapiens
agggtggcacaaagcactgtctccagtcacttttttgtccattctcccattcatttgtctgataatccagtggtgtactggtaaatatttaacaaccagtgctgcaggagaaagagccctgatttgtagcttttgctgattcctacagtgtaaactctgtcaccatggctgatttcaagctaccaatgtgacaacactgaaagaggagttgggaagagacatgcagcacaggctgttatgtagtatctccaccatacagtagatgtagtaaaaggtagtaaaatggctgggcaaggtggcttatgcctgtaatcccagcactttgggaggtcaagatgggtggagcacttaaggtcaggagttcaagaccagcctggctaacattgtgaaaccctgtctccactacaaaaaa

SEQ ID NO: 228335 - DNA, 313 bp, Homo sapiens
actgatgtaagcaggtcagaaaatgactccagttggatggatgaatactatcagtgcacctatgctttcaggactatgtgcgttgtttaagtgaaaccagttatccttgtgctgtctccacagttagttgataagtgacagaattttgacttagctgaaaactgcatgcggcctgttcatgattctgccatttaatgtggagatcagtggtttccaggcctgggtttgtggcactcacagacccaattatagcattcatggctatccaattagctttaggatgtgccaagaaatgatcaaaaaagttctcaga

SEQ ID NO: 228336 - DNA, 461 bp, Homo sapiens
taattacaaaggctgttgtcttgcagtctcatagtaacaagatctcacagtctcacagccttccggtcttgaaatcccacaccttgtaatatggaaatctcagcctgttaaacagatggtctcagaatctcaggatctcacaagttcaaggtctaacaggctcaaggtcaagcagttttgagatctagcaatatcatagtgtctggttctaggactctcctgaaggaagagcctaaattcactatcataatgctttgggagctattgtgaccaaatcctgacacaatccaacttacgatatagtcaaaaccatcagccctctggcagcatagaaaatggagactgggctgacaaatacaatgtcttaggcagctactatgaaacatatttcacagaatagcaggaaaatcagtaaacttaaatataggttaatagaagtcaaaactgtagtatagaaagaa

SEQ ID NO: 228337 - DNA, 350 bp, Homo sapiens
caaattggttctaaagtttatgtgaagaggaaaaagacccaggagagtaaattcaatattgaaagaaaagagcaaagttagaggactgacaccactcaatttcaaaacctaccataaacttacagtaatcaagacactatagcattagtgaaaaaacagacaaatagatcaatggaccagaatatgagctgagaaatcgactcacctaagtataatccattgatttttgacaaacgggcaaaggcaataaaatggagcagtctcttttcaacaaatggtgctaagacaactggacattcacatccacacccctaacattaatctagacacagaccttgaacctttcacaa

SEQ ID NO: 228338 - DNA, 367 bp, Homo sapiens
catcagcatgcgatttgatttctgtaggccctccatggaaaaaccattaaaaattctgttttcttttccatggggatgttgagatctggttattatatcttacaaatatcaccatgttatgggtttgcctaaagaatattgagttctagtcatagagtgaatcttttaatattatggatcttatctttctataacaaatcacgataaaaccaaccctttcatttacaaggaactacatgtgtggcaaaagaagaaaaagaaaagaaacataccaaccccttcacaataaaaagcattcatagactcaactattagcctgtttattttcaagacagaagaatctggataatctctttggccatcacac

SEQ ID NO: 228339 - DNA, 486 bp, Homo sapiens
gtgcaatggtgccatcatggctcactacagccttgaactcctgggctcaagggatcctctcacctcagcctgcccagtggttcagactacaggtgcatgccaccacacccagctaatttttttcattgtttctttttttgtttagcaatggggtcttgctatgttacccaggctggcctcaagcaatcctcccacctcagcctcctgtaatcccagcactttgggaggccgaggcagggggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagccaggctcagtttcaaaaattaattaaaattattaaacctccaaaaaaa

SEQ ID NO: 228340 - DNA, 301 bp, Homo sapiens
ctatatcggtaggactatatatatattatcatttgtgacagaataatgtgaagttaagtaattactaaactctaaatggaaatagtattcaagaaactcaagcactgaacttgaatataagagtattgttgctttaatccagtgtatttgtttatggaaagaaaaacacaaaggcagactcgaataaaaaggaacattaaaatattctttaaaactctgtattactactattttggaatttacccgtttataggctccaaaaataaattttcaaataaaatatttttatgaagaaaaaagt

SEQ ID NO: 228341 - DNA, 315 bp, Homo sapiens
tgatcaccttatgtttgcacagtttattctctttgagttagttaaatttcagaataatatgacaatttaaaaacagtattttaggcagcaatcatacctttatctcaaatgaaatttctaatcagaattgctatcaaagaggaacattaatttccattcccctgctgcctgtcccacccatgctcatagaagaagtaatgaccaaggagctagtcagaaaacagtagcaagaaaacaaaacaaaaagctggacaattcacaggccaaagaggtaatcctaaatatacaaagattgattatattgtgggtctttaa

SEQ ID NO: 228342 - DNA, 356 bp, Homo sapiens
tgaacctggaaggcggaggttgcagtgagctaagatggcaccactgcactccagcctgggccaaagagcaagactccatctcggggggaaaaaaaggtctttagtgcagaagaaactggacctgttatcccttgactccatgagtggcacagtgatcacttatataactggccatttacccagtgacttgtagcttgtttgaagttaatttctgattaaggcaagtggggattcagtagcttgtatgtatagatttaaggtagagaatctattttactacaagacaccccaaaaaaaacttagcttagaaggaatattttgcctaggttgtgtatctactagcccaatttaagaaa

SEQ ID NO: 228343 - DNA, 382 bp, Homo sapiens
ccaacatattagttgctgaagttacaaatcagtgcatttccaaagagacatgaatgtagtgctccagcaaaatttttttaacttaagatataaatggccgggtgtggtggctcacgcttgtaatctcagcactttgggaggctgaggtgggcaaatcgcgaggtcaggagtttgagaccagcctggacaacacagtgaaaccccatgtctatgaaaaatacaaaaattagccaggcgtagtggcgggtgcctgtaatcccagctacttgggaggctgaagcaggagaattgtttgaacctgggaggcggaggttgcagtgagccaagatcgcaccactgcactccagcctgggcgacagagctagacttcgtctcaaaaaaa

SEQ ID NO: 228344 - DNA, 430 bp, Homo sapiens
cagctacacgggaggctgaggcaggagaatcacttgaactaaggaggtggaggttgtagtgagctgagattgtgtcactgcactccagacagggcgacagagcaagaccctgtttcaaaaaaaaagaaaagaaaaagaagaaaactgtcaaccataactatacctacatgtaaagcccttggcattgggcctggcatataataaatgcacagtaaggagttataatattgtttcccaaacctcagtcattccccacatgaccttcatctttctacaacctgttctgctatttatctaatatttttcttgaaaattggtttaatatttaataatataataacaaatgtattttaagaagaaaggttaccttgccaccagaaaccagtattgcttgccagaaatagaagacaatagtaaaaataaacacaaa

SEQ ID NO: 228345 - DNA, 98 bp, Homo sapiens
gctaatttgtgctactaaaacatacattctttgagagaaaggcattttctgttttgttactttattccctgagccaagaacaaaatgtggcacagagc

SEQ ID NO: 228346 - DNA, 414 bp, Homo sapiens
gtcatcaggctggagtgcagtggtgtgatctcagctcactgcaacctcctcctcccgggttcaagcaattcttctgcctcagcctcctgagtagctgggactacaggcgcgcgccaccacgctaggctaatttttgtattttcagtagagatggggtttcaccatataggccaggatggtctcgattacttgacctcataatctgcctgcctcagcctcccaaagtgctgggattataggtgtgagccaccatgtccggccctttctttctttctacaggcagggtctcaccctgtcacccaggcatagtggtgcctcatggttcactgcagccttgacctcctaggctcaagtgatcctcctacctcagcatcccaagtagctgggactactggcacatgccaccacgcccag

SEQ ID NO: 228347 - DNA, 490 bp, Homo sapiens
cttctactcctgagcccaagcaatccaccgtactaggcctctccaagtgctaggattacaggtgtaagccactgcacccaccctgtctgggattctatgtcccctggacttctatgtccctctctctaggtctctatcttccctctgtctgggtctgtgtccatttatttcacggtctttggccttctctatctctactctgtctcacaaataaaaaatcaaaaaaaaagagggatgcaggaaggtctgattcatggaagatgtgaggatggacatagaggtcagagaagagaggatgccatggtgctggctttgaagtttgaagacggaggaacggccatgagccaaggaatgggggcggcttcccgaagcttgaaaaggcaaggaaacagactctcccctagagcctccagaggaaacagagccctgttttcgacgtctaacctctagaattgcattctaataaacttgtgttgttttaagccactaa

SEQ ID NO: 228348 - DNA, 500 bp, Homo sapiens
gcttgcttgtctttgataaaaagggagatccagtgttggagaggtaataaagacatattagcaccaatatttgtctttctccttgatatagcataaggtttgaaagagaatcgaaaagggaagtgctgtttttactttgcgagtcagtgttagttaaatgccatgtctgtgaaccacctcaaatgctgtcagtcagcttcccttgatttgagaaaattgtcttgaccagactaggcaggctgttctggagaagacgcctgtactctccaagcatcatccaagaccttcccagtaccctcttatatctatagagcacaaaatcccagaatcacaggacgacactgcagtgaatcaactaagaaacagcaggagctgagaagccaagacgagaagccccacatccctattcccttgcctacctcatgcattccctgctcggcacccagacttttgcccccattcctgctacttgtgaacaaataaagattcatatactcaca

SEQ ID NO: 228349 - DNA, 535 bp, Homo sapiens
caaccagaatgagcatgaaagtggattagtccttggaacttccagataagagcccagccagctatacttggatttcagcctgtgagattctcagcagagaacccagtcaagtgtgtccagacgtccaacctacagaactgatgcttttgtacaattcacacatgctttccacattgttctggaacatctgagaaagacacatcattgaaacaacttccatccattgcatgggtagaaattactctggctgctatgaagagaaagaatattcactgaaaatattttggatgtcactggatgcccctgttggatgctgccctgtggaaggagcactgtgtttcaaagctgggtgtagttgtagatggtaattaaaggcacaaaagagataaagctctgaaggacaaatgaattgaagaagatgcagtgattatgacaaaagtactggatgcccaattctatgcttcaacaagttcacaattctacttctcaagatgataatagagggcaatttaattaaaagataatggaataagaa

SEQ ID NO: 228350 - DNA, 277 bp, Homo sapiens
gcagggcagcctctggttgcagagagcagcacccggtttgacagctagcaatgcaattgtgacctcagacctacaatgtcaaggaattggcttctgccaacaaccagaatgagcatgaaagtggattagtccttggaacttccagataagagcccagccagctatacttggatttcagcctgtgagattctcagcagagaacccagtcaagtgtgtccagacgtccaacctacagaactgtgagataataaatagatacttattttaaactactcaa

SEQ ID NO: 228351 - DNA, 368 bp, Homo sapiens
aggacataaggacctcaacacttagaagaaaaaataagagattttattatattagggtaagaaataatttctcaagatttttttaatagcacagaccataaaactttgataatttgaccttattaatatttaaagccttgaataacaaaagacaccaaaagcaaagttaaaagacaagcacaatttctcttggaacacatgaagctgcaaaagacaaatttaaaaaaaacccaaaacataaaaacacatcatccgctagggcctccagaaagaacacagccctacggacaccttgattttagcccagtgagccctgggtcaggcttctaacctacagaagataataaatttgtttgttttaaggcaca

SEQ ID NO: 228352 - DNA, 408 bp, Homo sapiens
atgaatatacttattaaagactcagaaaatgtcttctgaaatatgtactctcaatgtacattttataataatttttatcctaggccatatagtatatagttgttttggctttttttcatgattctttcttgtagtgttttggaaagcacatgtattgaatcttattcatagttatgtaggaaaacccagttttatgaacaatgatttatagttgcctatgaagtcagactgattttttggatggaatgagctgcatgccaagggatgtgagacaccactacatgcaactctatgactggttctctatccagccccactgttatgtgtctaagccaaagggttggagagtctggtggtgagaactgaaggactccgttggatgacttttccattgaataataaagcgtg

SEQ ID NO: 228353 - DNA, 416 bp, Homo sapiens
tcttccttcaccccttccccttagcttcaggcacttacccacagaggaaacatgtgttctggggaaaatgataatcacggcccttatcttaaccttgtagatcctgtggactttctacacagccctagcattttcccatgagcatctcttttgattctaacaacatccccatgaaggccagtttgtttccattgagaaacccaaatctggcagcaaatgcatgagcttagaaagtaggccctcattcctagtccactgctaggagggatgaggacttgttcttaactcagccaggtggccgggtgtgatggctcacgcctgtaatcccagcactctgggaggctgaggcaggtggatcacctgaggtcaggagtgaaagactagcctggccaacatggtgaaaccccatctctact

SEQ ID NO: 228354 - DNA, 460 bp, Homo sapiens
aaaatgggtgctggatggggcaaaaaatcaggtgtcattcaaagttcactaggcttagggagctgggctcagaggccagaggcctgatcttgatcttgtcatcacttagcaaatctcctggccattcaggccttcacacttcctgtctgtaaatgggtttatcaccactcattcaagtcctaattattaccagcgctgagaaaccaatactttctttttccatctcgcttgtgtaatttcttcggagaagcatttggatggtctgaaccatttttaccctgagaaatgggacttaggaaattatgcagccacattttatatccattctggtcatttcagtaattggttctgagacactatttccccgagcaccatcccaagtataaactactatttccatctgtgttactggaggaaactggggaaagacatttgtgggttttttcccccccaggccaaa

SEQ ID NO: 228355 - DNA, 353 bp, Homo sapiens
gactacgtttctcattgtattaatttatgtataagttttcccaagaatggagtgctagaatattctgatatgagatataatccataaagtgatagtctaataatccagttgatttagttatgatatattaaaaattgtattgttacaaaagactgacaaaaatgttataataattcaccaaattacttttaaatcagattattggagatgattattttggtcaattaattgaaaatctgaattttaaacattttaattaaaaatcacttaatattttagtaaataatgtacaatgtaattggaaactctgctgggtatattttaataaatattttcaatttgcagtgcataca

SEQ ID NO: 228356 - DNA, 629 bp, Homo sapiens
agatggactgtggaacaaaggaaaccagagtatgcactttccagaccctgagagcttcctgcacggggctgtgaggacaaaatttggagagtgtaatcccttctctgactctgcatgctgccccagcagttgctgcaaccaaacccaggtgggcaagcctgagagctgactgtctgggattgggggccgcaactctcccacaactggcagagtggcctctgtactcaggcttgtacacagagtgggaccccttctctgtacaccactgcagccacaggcactgttgctgccactgggaattgggacaggcaagccagtgggttgcttgtctgaggctgtgagtgactactgcacccctcactggtggtgtggccccaactctcaggctcacatatggaaggaggaatccgttcccctctctgcatggctctatggtcactgctgccgccaagagcaggcaagcctgagagctgcatgtctggggctatgagtggcaaccccaaccctgctggccgcaaggtctctgtgctaaggcccacacacagaggttgcggtccctccccaactctacacaacactgcagtcactgctgtagccaggagccaaagcaaatgctacccagaaactga

SEQ ID NO: 228357 - DNA, 328 bp, Homo sapiens
ataggcctcttcaaagatggccaaggaagtgcccacaggtggatggatggctcagcccccacctacataaactgggactccaggaaattggatgataatggaaccaccccagcctgtgtgatgatgctctaccagggacactggagcaactcctcttgcaaatcagagtctcctgtttacatctgtgagaagaggcagagctgctgacctaggcccctaccccataagattggtgtaaacctcttgttgtgcatcctcaacctccatccctgccctctctgggctctgaatccccagaggcaacaataaaggacgtttctccaaagcc

SEQ ID NO: 228358 - DNA, 196 bp, Homo sapiens
tgtgaggttgtggaggagttgctggcagggggcctgtgtacttgctgtagatgaaaatggtattggaattagcagctcatgcctatttctcagaagtaagcagccatactgattatcattagctaactcttattagttttgattttgcagccccatgtatcctagcatgtaccctgctgtgtcccccacctgactc

SEQ ID NO: 228359 - DNA, 355 bp, Homo sapiens
gcatcatgtgagtgggcctcgttccccccggagaatcccagcgggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaac

SEQ ID NO: 228360 - DNA, 521 bp, Homo sapiens
aaactcatttaaaaaatccaaactatttattgaaaagctctactaaacaaaattagttcagacaaagcaataagatgacgaatcaagctctctccagagatgaaagaaaagccagtctcaaagatgactataactaacgctgttgctggaaagacaagggcaccgagccagccctgggagaggctccacttcttcaaagacaaaacgattccaaacgtggcaggacacagtgctcaccctacagtgaacctctgggaatatgttattttttaaattcagttaatctttcttctttttttttttgagacagagtctcctgtcgcccaggctggagtgcaggggtgcgatctcagctcactgcaacctccacctcccgggttcaaatgattctcgggcctcagcctcacaagtagctggaattacaggcatgcgccaccatacccagctaatttttgtatttttagtagagatagggtttcattatgttgtccaggctgggagacagagcaagaccccaactc

SEQ ID NO: 228361 - DNA, 544 bp, Homo sapiens
atttctaaaaatcaccataccatgcagaatcattactaaagaccccaggaagcttatgggaaaaataggtttagaagtacaacaataaaaagaaattgtttagtgaaacattaagaaaaaaaagaacctaataaaaatgatagaacagttgtacatgcattatgttataaagaaattcataaatactacaataaatatggtactttgccttgaaaaaactgaagtatgcttgtggaagttaatattgaaagggttgcagcttctgagttattgtaaaatggtatagggaaggttgctgaagtgggatataaagttgtaacaccatctattagtaggtatggcttataacacaaagggaactgaaatagctggaagatatttaagatgtgaggcctgttggcgcatattttaaatatttctactgggcttggtcagctagatgtagttttctgcctgcacctggtgtttctcacagtgatattcacgttatgctcaaattgcttccaaatacatcaaatgcacaggaacgaattttggttttctg

SEQ ID NO: 228362 - DNA, 339 bp, Homo sapiens
ggtcgatcctagaggtccccgaacaccctcctctttccagatccagggtacagtccaggaccaacgtccaaactactctgtcatcatcaccctcaattcatttgcatcccaatcactcgctctgctttatctatcccagcaaaactctaaccctagagcagtacagtcattcttccctgttcctccactggtaaaggaaaaacaaacaaacaaacaaacaaaaaaatagtagagaaaggggaggaagagaaagagaagaagaggaacaaagaaggaaaggctggaatgagggaaaatggtgggagaagggataagaagaggaaagagaggaagaagagg

SEQ ID NO: 228363 - DNA, 437 bp, Homo sapiens
ctgttggaatcccagtggaagaaaattctcttcttgatcattctactgcctgttaaccacacatgcaagctttctttccagtcatctttccaatatggttgtgccaaaatttttctcagtaggctgaggcaggaggattgcttgagtccaagagtttgaggctatggattgccctatttgaatagccactgcattccagcctgggcaacatagctagaccccatctcttacacaatattttttagttagttcagtattcagtataaatattatcattactttctaaatgatatttaaggttaagtcacataggcttctatgttgacatttccttttttccccctacctattttccttggagttaaaacagtctgtttttgtttatttgcttaatttcctatggatttataattaaataatcttctaattctttattt

SEQ ID NO: 228364 - DNA, 173 bp, Homo sapiens
ggtagtgaaagggagattatttattatatgcctttttatactttctattttttgaatcatgtaaatattctctattcaaaagcttagaattttttataaaaggaaaaatgcaattattacacatatatagaagctacagagctgtaaacacacgcatagatttatcaaaatga

SEQ ID NO: 228365 - DNA, 453 bp, Homo sapiens
gccccaggtgccttccgttctgtgcagctgacaccccgtgcagacctggcacagcattggtgatcacaagtttggcccgtgaatgaacacacaggtagataaagtgatgacctcttaggcttcttgaacttccagaagcatagtacaggtgttaaaagcatggaccctggagccacattgcctggattcacaatcctggcagccccctaccagctgtgtgttcttgagtgagttacttcattcttctgtcctccagttttctcatctgtaatatggggttatagtagtgcctgcctcataaggttgataggaaaatccaatgagtagtcagtattcataacaccttaaaacatttcctggcacaattaattgctggcacaagataagtgtcaataagtgtttgttaaaatctctcttacatatttatttaagaatttataactcaactctata

SEQ ID NO: 228366 - DNA, 723 bp, Homo sapiens
atgtaactggtttttgttagatttctgcaactcaagacccaatcctgggcaactgttggacacttaaacatccttcatcactagctgcgttcatcactaggaaaaagtaagagaaatctgatggtatgggattgtaagtgggtattagatccaacagctgaaacttaagatgtgaagatgtatattgacacacatgtgcgtacaaaatgtttatagcagctttattgataatagccaaaaaccaggaacaacccggatgtccttcaacaagggaagggtgacccagcccgtgatgcatccgtcacactgtggattgctgctcagcaacgaggaggcacagactcgatacgggagccagcctgggtgacgctccagagaactaccctgagtggagaagggcagtcccaccgtgtgattccattattatcacattcttgaaatgacagaattatagaaaggagaacagaggagtggctgccagagtttaaggagggaatggggaaagggggaagagcagcatgcgggatccttgtgacggaagcgttttgtgtcgtgtgggtgtctgtcagtttcctagctgtgatactgtaccattgtcttgtaagatgctgccatcggtggaaactgggtaaagcatataggggacctctctgtatgatttcttacaactgcatgtgaatttacagtggtctcaaaataaagcatttaattaaacaaaaaacc

SEQ ID NO: 228367 - DNA, 404 bp, Homo sapiens
catgttggtcaggctggtcccaaactcctgacctcagatgatccgcccaccccggcctcccaaagtgctgggattacaggagtgcgccactgcgcctggcctaagttgtgactattcagatatcagtttccctcctatctgtaaataagtttgtttcaattaataatgcatcctaaactcactgcagaaaatttagaatatgcataaggatatgcaaataaatttacccgaaatactatatgaaaattttgtttcatattctggattttttcttatgcacagatgtatattatttgaaataatagcactgactgaacaccctgtactggcactgtggtatatactgaaatttcattatctgatttgtacatttaattctcatgacaactttacattaactatgc

SEQ ID NO: 228368 - DNA, 592 bp, Homo sapiens
gggttctctagcctttgtacaaatagtttgaaaatgtcacaaatggatggctgcagctggaaacaagcaaaatctcccagagtgagagaataagatttctagaggtaccacattacaatactcagaaagttctgactacaacaaaaaattacaaagcactcaaagaaacagcaaagtatggcccatttacaggagaaaaaaaaaaaaaaagaattaccagaaagcatacctgagaaagcccagatattggaattattagtcaaaaacgttaaatgaattctctttatatagccaattagctaaagggaacaatggacaaaaactaaagaaaaacaggaaaatgatgtatgaatgtaagattatcaacaaaaagataaactggactttttcaaaatgccaatgttttgtgcatcaaaggacactaccaagaaagtaaaaagacaacccacagaatatgagaaagtaagtatttgcaaatcatatctattaagatatgaatcctgaatttctaaaaatgttcctacaactcaatcaaaaaaaaaaaatcaccaataaacacatgaagaaatgctcaacatcactaatcattagg

SEQ ID NO: 228369 - DNA, 468 bp, Homo sapiens
tcctagaactgttgcgtttttgatcttcctcttcgcagcatggacagtggatccccttgatctgcaagccctgccctgcctctctctgcacgctgggggttcagggaggctacacccttggggggcactgggagctgctggagatgtgcacagcgagcagtggagagcagtcgtctcttctgatctacatgcaggggaactggtgagagttgccgtaggacctctggtgaaattaccttggctactgactagtaaagagatgagaaaggagaggtactatagattttctttaagaaataaatattgtctcctctttctctcttttctctggtaaacagtgcccaaatttggaaatatcacgtgtaatttattgtcccactttaaatgtttcttgtaaccatgaattactattcttggatcagattccattataataaactcccacttggactccaaattcttttacaa

SEQ ID NO: 228370 - DNA, 513 bp, Homo sapiens
gattgtatgaaatggggcaaactttgagaaaattattaagccaatactggaattggttggcatatgcctttatgatttatttagtttgttttctactttgccctaccagggaagaatttaattcttcccatttcctgaaagtcaaaggattggaggacactaaagcaaaataaaccttaatttcaccccaaaagtagcttaggtaatgtcaggaagggctttgatgaaaccactgtccctgcttatagatcttattttccaagcctttcaatattttatttgcccttttctgaactctacaatttccctctcttgtagctggttcgatgcccagaactgaatgctgtgctccagctgtggcctcaccggtgctgaatagagaggaagagccaccttcatagcttacatgtgattcctctgcttatacaacccaatactggatttacttactttggcaagatagctgcattgtgcactgtatttaatgttacgtgtactgtaaccctgggtctt

SEQ ID NO: 228371 - DNA, 399 bp, Homo sapiens
aatatactgctcaggacctaactattatttttctagtagttttcacacatttttttccggcaaatgttatgttacggagtgattattttgtgttactttgtacacttaaggagcaatccatttttagcagttgagccctcattttgtaaaactaagctgttggcaatttgctagtttctttaaattctagaaaccactaagttttaccttttcatttatttccaaacaaagaagatgttagaaagttctgtaacttatctcttgaaataatattttctggccgggtgtggtggctcatgcctataatcccagcactttgggaggctgaggcaggcagattgcttgagcccaggagtctgagaccagcctgggcaacatggcaagacctcgtctctacca

SEQ ID NO: 228372 - DNA, 743 bp, Homo sapiens
aattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaaaataggagccgggctaggtggctcacacctgtaatcccagcattttgggaggccgaggtgggcggatcacgaggttgggagtttgagaccaccctggctaacatggtgaaaccccatctctactaaaaatacaaaaaatcaacagggtatggcggcgggcacctgtaatcccagctactgggga

SEQ ID NO: 228373 - DNA, 217 bp, Homo sapiens
agactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagt

SEQ ID NO: 228374 - DNA, 5443 bp, Homo sapiens
  misc_feature (5189)..(5189): n is a, c, g, or t
  misc_feature (5195)..(5195): n is a, c, g, or t
  misc_feature (5288)..(5288): n is a, c, g, or t
  misc_feature (5368)..(5368): n is a, c, g, or t
caattaaatctatgtctgaggatgaaagtgaaatgattacgactgttagtgaaattgagagtaaagcaccaacggttgagtcaggaacaattgccagcaaagagagaacgttatcctctgggcaggaacaagttgttgaaagtgatacactaacaattgagtctggaccacttgctagtgaagataaaccactttcgtgtggtacaaactctggaaaagaacaagaaataaatgagactctgcctatcacaactgtagctcagagttcagttctacttcatcctcaagaagaagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggtaggatgcagaaaatctcatcactacataaatcatttggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcaggtgagaaataaatggaaagtggaattgtatgcacaaggatatgtggacaaaagatatttattattttgttatttgtaatggtgaaaaatggtaaataaacttagttactgctgttaatggaatcgttatgatgcagttaactatattgttctatgcagttgttaaatgagtaattttgcttttaaattgttttattaaatgccagtaagaagtttatcaaggtaggagttttatacaattggcagcatccataaattttatgtttaagcctatttgtaacaatccatatctaattaaatactgttaaatattttaaaaattctatctgtgggcattctaaataagctgttttatgtttatttttaaatatttggaaaaataaagataattagaaggaaaaatatttaaatcacttaatcctaacacccaaagacagccaatgttaatcttctcgcttctgaatttatatatgtatatatatatagcacaggatattttatatataatttgtgtactgatcctacaaagtatagttgtagtactattttattagttgtaaggcatcttttaagaagttacattttggccgggtgcagtggctcacntctgtnatcctagcactttgggaggccaagactggcagatcatgaggtcagaagattgagaccacggctaacaccgtgaaaccctgtctatactaaaantacaaaaaattggccgggtgtagtggtggtcacctgtagtcctgtagggaggcaggagaatggcgtgaacctgggaggtngagcttgcagtgagccgagatcaagccactgcactccagcctgggcgacagagcgagactccgagactccatctg

SEQ ID NO: 228375 - DNA, 4590 bp, Homo sapiens
caattaaatctatgtctgaggatgaaagtgaaatgattacgactgttagtgaaattgagagtaaagcaccaacggttgagtcaggaacaattgccagcaaagagagaacgttatcctctgggcaggaacaagttgttgaaagtgatacactaacaattgagtctggaccacttgctagtgaagataaaccactttcgtgtggtacaaactctggaaaagaacaagaaataaatgagactctgcctatcacaactgtagctcagagttcagttctacttcatcctcaagaagaagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggtaggatgcagaaaatctcatcactacataaatcatttggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgtgttgaaaatcatgcagtgttaagttatgctgtggaggaagaacatgcatatttgggtccaactgtgaagccagatgataagagtcattttcagagcacatggatgatagcaagcaagaatctaccaccagt

SEQ ID NO: 228376 - DNA, 200 bp, Homo sapiens
agtagagatggggtttcataatgtttgccaggctggtctctgaactcctgaccttaggtgatgcacccatctcagcctcccaaagtgctggagattacaggcgtgagccaccgcactcggccctgtttgtagttttaatgtgttagccaacttgtataaagggtcagccagtaaatattcagctttgcaggccacaaata

SEQ ID NO: 228377 - DNA, 672 bp, Homo sapiens
gaagacactgaaaaatattttattgatttttactttgtaactatcattaaattttttcaaataaaaatgtaaataaaataatacagtacaaaaaaggaaacaaattaatacttttccattacatgaatgtgtttttttgaaaaaaattaaaggttcagggagacatgtgaaaataagagaaagggaactctgcctatatgtctcagaaaatggtgtgtatatattatacaataacagaactgaagttattcaatttgttttgacacctttacaatcacggcgctatcgtgtattatgaatctgctatttaaagctaggatttctatagtgccaaaggttggagataagagctgtgcacaaaacaagctgaaacaatttagaactgttaagaatgtacttttcaataccaacacacatataaagccgagtccttgtatgttggggacccagttgtataatcaagagttctttgaattaacttccccagagtataattaaaagataagcaataacaatgtgctaatttgaggcttacacgttactaaaattcaatagacaatcacagcatttatttagaacttaaatcaatggttctcaaccttggctgttttgcctttcgggacatttggcaatgtctggagacacttttggctgttaccattgtggggagtg

SEQ ID NO: 228378 - DNA, 357 bp, Homo sapiens
aaacctaatttttctggcagggactcccaatagtatattgaatagaagtgatgagaatggacatctttgtcttgtgcttaattttagaggaaaaagtcttagcattttactgttcaatatgaagttatatgttggcttgtaatatgtgacttttattatgttgaggtatatttcttctatacttaatttattcagtgtttttgttatgaaattatgttgaattttttaatgctctatctgcatctattgagatgattacattgttttgtcctctattctgttaatgtggtgtgtcacatttatgtattttcatatattgaaccatccttgcatctctgggataaataacctttgatc

SEQ ID NO: 228379 - DNA, 432 bp, Homo sapiens
gaaaaattatatctaatcagtggctagttacaatacatgttaaatttattacaaatgttaaaaggaaaatgttttgatttgtagtctaacttttgtttagacacctcttatggttggtctttgctcactcagggaagagatcatcaaacgttttaaagtgtatttgctagatgtttaaacataactaagacacagagcacatatcatccccaggaagataatgaggctgtcacagcacaaaatgttctttgtttttacgggttctattagttaatgtattagcaattttctaaatgccacttttgcttattaagaggttttgagagcacatgaaaacatacattttattcttgaatgcagcatttctgagattattagcaagtgtgattctgaaggaatattttcaaatactctgaaggagcatttggggta

SEQ ID NO: 228380 - DNA, 518 bp, Homo sapiens
tgctatttgccatgtatttagctgtatacttatttatgtctgtcttctctcagaccagaatagaagctcagtataagaacaggggccttgcctgtctcgtcctttcctcttgcctcagaaatgagaatggtgcctggcacatagtaggtattaaatatagatgtatgctgaatgaaagaataaatgagtacatattttgtgtcactacgaattttataaacatgtttttaatatttttcaggcctttgacatccattcagtctctcttggctttcatcaggaattaaaaacaattttactctttttcagacatcatctggataccctctaaggtctctcttactaatgaccttttctcctttttcacagagaaaatagaggccaccagaagttactcttttagcttcctgtacacatctatgtaattgtctcactccttactaatctttccttccacctttcctgtttcagagaaacaggttttattcttcttacttgagggtattatcaagcttgta

SEQ ID NO: 228381 - DNA, 609 bp, Homo sapiens
ttagcccaggagcctgcatagggaagaaaggacagacagggcctccttactggttgacactcaggaggggctggggcaagagagcagagggagcgcagggccaggcaggggctgctgaggatccatgggagctcagggtgcacaagggggctgcccttcctgggctgcaggcagcatcccctatgggagctgagaaagtccaatcctgagatgggacagtgctgcccaggggtgtgtggctgggccctgacaacagtctccccaaaagtgaccacatcaccaggctcagttccaggaaggctgagaagtgcccagtacactgaggatgcacctcagttacataaaataaatgaaactggagtactaacgtacagtttaaaggttatagttactatttttatatgatatactagtaatttttgaatagggtaaactttaggtgttttgacaccaaaagaaaactacatgagttcatgcatgtgttaaattgctttactgtagtaatcatttacatgtatatgtatatatgaatataattatgggctcattaaatttaaatattataaataggtgacaaagaataaagttaactggaaaactgtgtcatta

SEQ ID NO: 228382 - DNA, 501 bp, Homo sapiens
atggtggggatttgtctggtgatttgggggagggttcgaggtaacggtattctctggattggatggtgtcaggaaggaggtgggacaaatctatgacttatgggcatcttaatcgtacctagaacgctgaagaaatgaagcaggcccaaagtttgactggaaaagagcagcagtcactcatattagccaggataaggaggtatttggtaatttttgtcatttggacaaagttcctatttttttctaccttcagacatgattacagagtggttttgttgttttcttgacccattatgatcacagagtaaccctatctaatgttgaatgttgatgttctgtaaaacagtttatgttcagcatgacttcaaggcctagtgagtgccaggccgttgttttgctactaatttttccactagtaaaccaggttcattgctgtaaaactacaagttagtaaacatacctaagtcaaaagaaaaaaggttaaattacttatggagaaac

SEQ ID NO: 228383 - DNA, 407 bp, Homo sapiens
gaccttgctcagatagcccaaaagagggcagtagaagggaagccgcaacaacaacaaccagaagaaacaaaacaaatattaaaatagcagacctgcctgggcgcgggggcacacacctggaatcccagcactttgggaggccgaggtgacaggatcgcttcagcccaggagttcaagaccagcctggaagacatagggagaccccgtctctacaaaaaaaaaaaaaaattacctgggtgtagtgaaatgtgccagtgttcccagctactagggagactgaggcaggaggatcactggagcccaggaattggaggctgcaatgagccatgatcacactactacactccaacctgagcgacagagtagaccctgtctcaaaaaagaaaaataaattctccaaatactgt

SEQ ID NO: 228384 - DNA, 188 bp, Homo sapiens
aaggataatgataatatattggataaaaattcgaattcaaaaatgttcaaaatttgtatggcatttacaaaataatgtaacaattggatgaaatcatgttaaaactaatgttagtacaacaactcataaaaagtttgccaagcttcaaccaatgtgccattaagtaatattagatataattttaacat

SEQ ID NO: 228385 - DNA, 440 bp, Homo sapiens
caggttatctctctcctactgttttgcttgctatacgtttaattaataataatatcaacattgtttccgcatcccaggcatttaagctaactcactgagcctcttaatattgccatgatgtaggtgcttgatactgtttggatctgtgtccctagccaaatgtcatctctaattgtaatccccacatgtcgagggaggtcctagtggaaggtgattggatcatgggggtggtttcctccatgctgttcttgtgatagtgagggagttctcatgagatctgatggttataaagtgtggcacttccttgctatctctctctcctgccaccatgtaagacgtgccttcctgctgcttcaccttctgccatgattgtaagtttcatgaggcctcccagccatgtggaactgtgagtcaattaaacctctttcatttataaatta

SEQ ID NO: 228386 - DNA, 517 bp, Homo sapiens
tgagacggagtctcgctctgtcaaccaggctggagtgcagtggcgcaatctcggctcactgcaagctccgcctcccgggttcacgccattctcctgcctgcctcagccccctccgtagctgggactacaggcgcccgccaccacgcccggctaatttttttgtattttttagtagagacggggcttcactgtgttagccaggatggtctcgatctcctaacctcgtgatctgcccgcctcggcctcccaaagtgctgggattacaggcgtgagccaccgcgcccggccacagtaattttttaaataaaaacttgatagcccatggaaagagaagatgagtgggcaataaatctcagaacacatgtattggaggaaatgaatctgatgattaaactcagttcttagggcagtattgttgctgtcacaaatccccttcctggtgaaaaattgatgtggtaatcagtttcaggtcatagtaagtcagaaaaaaatacagaatttatttaggtaaaatgtt

SEQ ID NO: 228387 - DNA, 822 bp, Homo sapiens
cagcagacagatgatatcagctgtctttcagcctgataatgagtgattgattacacaactctttaagacctttgtcatctttgtggtttttataaaagagcacatatagggctgtaagaccaagctaatgaattagttgtaacatttatttcttattactatttataatggtaatttatgttgattattgaaacatttgcaaaatttaaatgtgcttagagaaaacagaaaccacttttgactttgtgcatgctatttagcagttctacatttcaagtgattgttattagacattatgactcactccatcttaaataaccaattaatccattgattcaacgttttattttatgcttgccatgtatgcaccaggccctgttctaggcatttgagatacagatctgtctcctgctctcatgtactgtagtggagaaaactgaaaataagccagtaaacaaataaatatacactttgtgatagctgataattcctatttttgtatttcataccagcacttttttccttatgcataagtagatgtaaaaagtatctggactttatggcatttttctagcctatttaatatgtatgaatgtaatgccagggggatagaatgacaatggcaatacagtggctaagagatatgtttgacaaagaaaaaggagatgacactttgggaggccaatgcgggcgggtcacttgaggccgggagttcgagaccagcctggccaacgtgaagaaaaatacaaattaatatacacaggagttgcttggaccccggagccggggttgcagtgagccggggtcgcgcactgactccgc

SEQ ID NO: 228388 - DNA, 723 bp, Homo sapiens
ttgcaaaatttaaatgtgcttagagaaaacagaaaccacttttgactttgtgcatgctatttagcagttctacatttcaagtgattgttattagacattatgactcactccatcttaaataaccaattaatccattgattcaacgttttattttatgcttgccatgtatgcaccaggccctgttctaggcatttgagatacagatctgtctcctgctctcatgtactgtagtggagaaaactgaaaataagccagtaaacaaataaatatacactttgtgatagctgataattcctatttttgtatttcataccagcacttttttccttatgcataagtagatgtaaaaagtatctggactttatggcatttttctagcctatttaatatgtatgaatgtaatgccagggggatagaatgacaatggcaatacagtggctaagagatatgtttgacaaagaaaaaggagatgacactttgggaggccaatgcgggcgggtcacttgaggccgggagttcgagaccagcctggccaacgtgaagaaaaatacaaaaaattaataaaaatacaaaaattagccaggcatggtagcacctgtaatccaagctactggagaggctgaggcaggagaattgcttgaacccgggaggcggaggttgcagtgagccaagatcgcaccactgcactccagcctaggcgacagatcaaattagtatttgatt

SEQ ID NO: 228389 - DNA, 789 bp, Homo sapiens
agcggaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctc

SEQ ID NO: 228390 - DNA, 905 bp, Homo sapiens
agcggaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggtgagtctgagaactgctggagttcaggaaagaaggaaacagggtctgagatgtgtggcatgtgggcacagacgaggctccccggggtgctaggatggcgggtcagatccagtaaggacacagccaccactgtgcagcatgacccatcccatgtccttggcctcttcgaagagcagctggatctaaaagatagggaaggaagaatc

SEQ ID NO: 228391 - DNA, 466 bp, Homo sapiens
tagtttgaaattctttatttttctctgtcttcctttccactggctgccttggatgggcaggaactcacaaaaagcctggaatctcccagagaggatgagcagttctatgcagcacaggtgagaagaggcaaggatagaggagggtggttacagccaggagttggccaagctggaaagtaaaaagctgcttgacgtgatggtggttgtggggatggtattccaagcacaaactccagctgtatccagagaatggtaactcctggggatgatgtccaagtttccttctctttcctccatccctcttcctgcaggctctgggatgcttacgcatcagtgacaagtttgtcatggaggcactacagcaggtggtgagtctgagaactgctggagttcaggaaagaaggaaacagggtctgagatgtgtggcatgtgggcacagacgaggctccccggggtgctaggatgg

SEQ ID NO: 228392 - DNA, 657 bp, Homo sapiens
gacttattgaattgtccacttaaaattggtccattttcttccatataaattacacctcagaaaagttaatttcttaaagcaaaaaatacgaaattaaacaaagaaaaagaaactattgtaattaatcctggattacacactttactaaagtacagtgctcaaattgataagatgcagccaaatttctactcactttgtgctgtgtagaccctgctagtttcctgtgcctattctagaagctgtggtagaaatatggccattagagaggaaaggcccgggtttcccttctggaaccatcatctaccaccagatgggcatatggcatgttagttgcctccaaatctcccctgcttcaagagtcctccacctccacctccaacgagtaccttctctgagcatctctggagcttcttcttcaatctgattctatctgtttttccttgctaggattcctcacagtttatggtccatgggaagattcctagtctagtctctgaatacatacatgtgtatatatatgtatgaacatgtgtgtgcatatatgtatatgtatgtatgcacacgtatgtgtgtgtttctatcatttctaatgacctggaacaggggaacactgtgtgtgcttagtccaccttcttgtaactctcagagcttagtttc

SEQ ID NO: 228393 - DNA, 603 bp, Homo sapiens
gacttattgaattgtccacttaaaattggtccattttcttccatataaattacacctcagaaaagttaatttcttaaagcaaaaaatacgaaattaaacaaagatcaaattgataagatgcagccaaatttctactcactttgtgctgtgtagaccctgctagtttcctgtgcctattctagaagctgtggtagaaatatggccattagagaggaaaggcccgggtttcccttctggaaccatcatctaccaccagatgggcatatggcatgttagttgcctccaaatctcccctgcttcaagagtcctccacctccacctccaacgagtaccttctctgagcatctctggagcttcttcttcaatctgattctatctgtttttccttgctaggattcctcacagtttatggtccatgggaagattcctagtctagtctctgaatacatacatgtgtatatatatgtatgaacatgtgtgtgcatatatgtatatgtatgtatgcacacgtatgtgtgtgtttctatcatttctaatgacctggaacaggggaacactgtgtgtgcttagtccaccttcttgtaactctcagagcttagtttc

SEQ ID NO: 228394 - DNA, 752 bp, Homo sapiens
aacgcactctctactgattaaaaaaaaaaaaaaacccagacatcagaacatgctctatggccaaactgtcatcatagtgaaaagtctgcgcagtacattattctataaaatgttgtttaactattttaatggctccttatgaagtcctaaagaatgaagataattacaaacctgtaattttatggctgccttgttgaaaagggcagaccaaggtgcctatatcaggatgaaagacctgaaaatctaaatagcctagcatattatatataaaacttttagtcattaattatgagattagctcagattagtgaaatatagcaagttttgcattgtcatctaaacttgaaattttaacgtgaacgctagttgaacaaagttggcagtgagaattgtgaattacaattagcactctacagaatggtgagacatactggaagtaaagctgaggatgactgctttttggtttgtttgtttgagacagggtctcattctgtcgcccacgctggagtgcagtggcacgatcgtggctcactgcagcttcaacctccctgagctcaggtgatcctcccacctcagcctccggggtttcaccatgttgctcaggctggtctcaaactcctaaggctcaaacaggcctccagccttggcttccaaagtgctgggattataggagtgagccacggcacccagccgagtgactatttaatgtttacatttttgtcaccaaggaagcaaaagagttttagcaattt

SEQ ID NO: 228395 - DNA, 698 bp, Homo sapiens
aacgcactctctactgattaaaaaaaaaaaaaaacccagacatcagaacatgctctatggccaaactgtcatcatagtgaaaagtctgcgcagtacattattctataaaatgttgtttaactattttaatggctccttatgaagtcctaaagaatgaagataattacaaacctgtaattttatggctgccttgttgaaaagggcagaccaaggtgcctatatcaggatgaaagacctgaaaatctaaatagcctagcatattatatatttttgcattgtcatctaaacttgaaattttaacgtgaacgctagttgaacaaagttggcagtgagaattgtgaattacaattagcactctacagaatggtgagacatactggaagtaaagctgaggatgactgctttttggtttgtttgtttgagacagggtctcattctgtcgcccacgctggagtgcagtggcacgatcgtggctcactgcagcttcaacctccctgagctcaggtgatcctcccacctcagcctccggggtttcaccatgttgctcaggctggtctcaaactcctaaggctcaaacaggcctccagccttggcttccaaagtgctgggattataggagtgagccacggcacccagccgagtgactatttaatgtttacatttttgtcaccaaggaagcaaaagagttttagcaattt

SEQ ID NO: 228396 - DNA, 687 bp, Homo sapiens
ggggaaagtttgtctcccctctgaaggatgcccgtgagtgtgtgctgctgagaggatggcagaatggcaaggtgggagcattctgcaagcatcatgacatcattgagctactgaatcaaccttccctagaactggcttccaggactttgggtcatatgagtcatgtgagaaaaatattctcctctacctttttctgagttaggcctcatgctgcttgaagctgaaaacatcctgttacacctcggttttaagcaccctcccctggcctctgagataagcctctcaggaacctgtggctctctaacccagtttgaaacgttttgctctccatagaattgtgtaccaggagagttatattgattaaattaggtcttacattttatgttatatattcagagacatatatttgtagtctgcatttcaggtaaagcgttttccatgttggaggtcaaatcccacgaggttcacgtatctattgctgctgctttaccctgttctggaaaagaaagttatttgcctgccgaacgcacagacatgagattagaaagtgatgacaagcgttaatgcttggctctttttatcatagactatactcttttctactctattatttcatctgtgtttgtgtaacatgtatctcacaatgcagaaatcttttttttctttttgttatgaaaaatttccaaa

SEQ ID NO: 228397 - DNA, 526 bp, Homo sapiens
agtgctccaggaagcttttgtgtcctcggatgaacacggactgccccaggaacaccttcaagggttttgtgggactcaagggagaagatgaagccctcccagaaggccctgtcactacaagctgaggacctccttgggcaaagaccaactctgactccagctctgaattccattgcagccaaatggatatttctcgtccctcggcccttggttgtttttcctaacattttttatttccaacctacccctaggttttcagtggcttccttagaatcagtaagaagccctgccagtgcagagcacgtgcctttgcttctgccccagtgccttcctaacagtccagagacagccacaccccaccaagccaaagccaggacaccctctgggttcctcatgctctgcccaagaacactgtgccacagtgagtgccagcctcaccaatttctccaggtaaacaaacactcctaaaattattggaaaattgttcctcacaccttttatattttcagtaaaaatgtaatagaaa

SEQ ID NO: 228398 - DNA, 563 bp, Homo sapiens
tagggagttaccaaaaatagtttctcagactgattcctttggttagtagctatagaatttttccccatggactttgagttccaaataacagacccttaagagaatcatgtaattagtggatgatagagctacgttaatatttactccctgatttcctagcctaaagtagattggaagaaggaagttggatgtaatagagaggttggtgataagggaaagactactgcagaaggcagacatattaatgacgagaaaaagtaactgctgacagccaaagaggagaccgagaagcaaaacacagaaactcagcagagtagtttggtctcaattaaagagggccattaacccctaatatctcaggaaccttcaaagggacatctctttaccacaccacagaataattgtatctagaataatgaccctgagtcatcaagaaaattttaaaatacgctctgtatatgggaagtccccaacttacgaatggtttgtggtccaaagttaattttcaaaacatttttttggaacgcaaaatatttttctttctttctttttttttttttttt

SEQ ID NO: 228399 - DNA, 516 bp, Homo sapiens
cagcattggctaatctgagcttgattcctccagacagggttggtgacagagtaacacactccagtctctgaccctctgtttctagactccagtactcactcattcatgcattctttttttcaacaaatatttaatgtcctcctgccatgcaagctctttcttggccccaaaagatgggaagagcacaggggactgaccctcagagtttattgcacagagaaggcaggtggtagctggatgctggaggagtgtagacagccattttctggccaccttgtctttgtatgtcacagccattttctgaaggaaatgaactgaaagagactgtcgtccttttttaatgacacagttcagatatattcaaattcatttgggttagaatacaagctgtggggggttttattggcatcatgctaaaaatatattcctgtctcttgaatttttaaaatttcattttattgtgatatgaacacataacatgagattgaccctcttaaattttaaaatgtacaatgc

SEQ ID NO: 228400 - DNA, 310 bp, Homo sapiens
ggttggggggtagttagggtcttgctctgtctcctaggttagagtgctatggtacaatcatagctcactgtaaccttgaactcttgggctcaagtgatctcccacctcagctgggattacatgcgtgcaccaccacatctggctaagttttaaaattttttgtagagattgggtctctctatgttgcccaaattggtcttaaactcctggcctcaagcgattctcctgcctcagcctcccaaaatgctgggattgcaggggtgagccaccacgccaggcctgaaacttaaattcttgttgtgaaaagtca

SEQ ID NO: 228401 - DNA, 785 bp, Homo sapiens
gagcaagacatctgcttattcctagcagtccactaaaatacaaggtcttcagcgcgaagatacttgtctgacttattcattgctgtatcccttgcgcttgcaacagtgcctggcgcgcagtaggtgctcgataaatatttgctgattgaatggaccctcagattatggaaagagggagaattctaactaatagttaaaggcttgataattgatagcaaaatcactatcctatctttcagttttaatcatttaacaaatatttatcaagtgcccactgcataccaggtactgagaattcagtggggaacaagacggacatggtccttacccctatggagcttatactcgaatagaggagacaaaataattaattaagaaaataggtgaggtattttggaatactgataaatactattttgaaaataaaacagcaagatgtgataaagagggcttgaggactgctttccatggtcaggaaagtaatcttttccaagaggaaaagtaatcaggtggtcaggaaagtaatcttttccaagagggtgacacttgagctgaatactgaaaggcaagaactatccaccatatggagtttcagaagagagttcttggtgggagaatccatgcatttgaccagagctgttttcaagctaattcactgccccaacgtctttggtttggaatctgtaaaggcctgtttttcctaacacctttcttctttcatttgctacagtatagagtagtgttcttttggcatttagtaggctggtgaactttgcacttccctg

SEQ ID NO: 228402 - DNA, 838 bp, Homo sapiens
gagcaagacatctgcttattcctagcagtccactaaaatacaaggtcttcagcgcgaagatacttgtctgacttattcattgctgtatcccttgcgcttgcaacagtgcctggcgcgcagtaggtgctcgataaatatttgctgattgaatggaccctcagattatggaaagagggagaattctaactaatagttaaaggcttgataattgatagcaaaatcactatcctatctttcagttttaatcatttaacaaatatttatcaagtgcccactgcataccaggtactgagaattcagtggggaacaagacggacatggtccttacccctatggagcttatactcgaatagaggagacaaaataattaattaagaaaataggtgaggtattttggaatactgataaatactattttgaaaataaaacagcaagatgtgataaagagggcttgaggactgctttccatggtcaggaaagtaatcttttccaagaggaaaagtaatcaggtggtcaggaaagtaatcttttccaagagggtgacacttgagctgaatactgaaaggcaagaactatccaccatatggagtttcagaagagagttcttggtgggagaatccatgcatttgaccagagctgttttcaagctaattcactgccccaacgtctttggtttggaatctgtaaaggcctgtttttcctaacacaatgagcaaatggaaagtttgatttttagtcacatagtttgagattgttatccctttcttctttcatttgctacagtatagagtagtgttcttttggcatttagtaggctggtgaactttgcacttccctg

SEQ ID NO: 228403 - DNA, 376 bp, Homo sapiens
gatgatacacggacacacagagagagtatgtataggcacacatataatatactgcctagagaaaccactgaaagacctatacaaggagatacactcaaaaacactttagattaatcaaaatgaaattgtaaaaaagtaacccacaggaaggcatgacaagaaaacagaaatgacagattgaacaaacaaaaacaataacatggggaattaagctctaacatatataattatcttaaatgtaaatgatcttaatacaccaattaaatgaaaaaaattagcagagtggataaaaaatatatgctgtctacaataattgcacttcaattataatgaaatagacaagttgaaagtaaaaaaaaaaggatggaaagagaag

SEQ ID NO: 228404 - DNA, 879 bp, Homo sapiens
tctaaaaaaatatatttttaattagctgagtgtggtggtatatgcctctagtcccagctactgggggtggtgaggggctgaggcagaggaattgagcccagaagttcaaggttgcattgagttatgatcatacgactgcattccagcctaagccacagagtgtgacatttctctgtggccaataagcacatgaaatgatgctccatatcattagccatcaggaaaatgcaaattgaaaccacaatgagataattcgcactcactaaaatggagaaattggaatcctcatacactgctaatgcaaatataaagtggtgcattcacttgaaaagtgtagcagttcctaaaaaaggttcaacgtagagtttaaaaataaaaaaatataggccaggagctatgactcactcctgtaatcccagcactttgggaggccaaggtgggtggatcatctgagctcaggagtttgagactagccgggacaacaaggagaaacaccgtctctgcaaaaaatacaaaaattagccaggcgtgttctcacacatctgtagtcccagctacttgggaggctgaggtaggaggatcacgtgaagctgggaagtggaggttgcagtaagccaagatggcgccactgcactccagcctgggcaacagagtcagaccctttttcaaaaaaaaaattttttgccaggcatggtggcactcacctatggtcccagctacttaggaggctgaggcaggaagatcgcttgagtccaggagttgaaggctgcagtgagccgtaattgcaccactgcactccagcctgggtgacagagtgagaccccatcttgaaataaacaagaattaaaaaatgaagagaagtagtatgggtgtagttgc

SEQ ID NO: 228405 - DNA, 495 bp, Homo sapiens
tgattagcaaatttcctttgctaaaaatgagttatatgccaattcctaaactagtcactgttagggtgtagaatcactgtgattggattagaaaagctctgcctcctggaactaggaatgatgttgtttgccctgaagcacatggatctgtggtcaggaagaggggtcttgcgggaaatatatatactgagtaagcagtgtctgatacaaagacgaaaaatatttcttttgacaggaagatttggtaaaatataaagtagtagaattatttcccattatttaatctgtttaatgtttcataaaaattagcaaacgtaatgaggaaacgtatctgtaagaatccactatgcatttgctgtttgctctgaaatcaacaggacccagtgctttcattactagaaagaagaaaattaggtaggttaataaaacaaacatctggaaagtatcaacactcataaaaataaatggaatcatcctgtgtatacactaaagcca

SEQ ID NO: 228406 - DNA, 264 bp, Homo sapiens
ccagaatttttaaatgctgcagtaacttacgcatttcctactatcacatacgtctgagaacggaagaaactgtgttgcccgaagctatttcagaaagggctagagacaagaacttgctggctcctccaaaaattctatcttactccaaaaatactctctcatctgagctgtgtaaagtatgtaaagagtttaaatgtacacacatgaacagtgttttttaaattaaattcatataaaggcacgaagaaccttcattgggtaaaa

SEQ ID NO: 228407 - DNA, 484 bp, Homo sapiens
ctgctttagctatatttcacaggctttgttatataaggtttttgttttttttagtaagtgtcttctaatttctattgtgatttttttttcagtgactcctgagttttttagaagtgtttttgccccaagcctgtgaggatatctttttttattattgatttctatgtacatttaatggcattgtggtcatggaatgtggactgtatgaagaccttgttacttaattagtagaaagattataattcttagaaacccatactgcaatactagaataaattttttccaattttaaattcaatgtgctagaaaatcccacaacaatatgctttagggtttgtaatttaaccaaatgaatttgcagtactctcattacttaggtttcttcctttgaatctgagatcttaaagtttagcagctgcatgaagagcatgtccacaaaattcttttcttagttaaaaaaaataaagttagattctaaaaactt

SEQ ID NO: 228408 - DNA, 430 bp, Homo sapiens
ctgctttagctatatttcacaggctttgttatataaggtttttgttttttttagtaagtgtcttctaatttctattgtgatttttttttcagtgactcctgagttttttagaagtgtttttgccccaagcctgtgaggatatctttttttattattgatttctatgtacatttaatggcattgtggtcatggaatgtggactgtatgaagaccttgttacttaattagtagaaagattataattcttagaaacccatactgcaatactagaataaattttttccaattttaaattcaatgtgctagatactctcattacttaggtttcttcctttgaatctgagatcttaaagtttagcagctgcatgaagagcatgtccacaaaattcttttcttagttaaaaaaaataaagttagattctaaaaactt

SEQ ID NO: 228409 - DNA, 424 bp, Homo sapiens
cagattgtgctgtcaagcttttgaacttttgccaagattatatatgagaaatagtatctcagtgtagctttaattctcatttatcttattatgaatgaaattgaacatcttttcatacactgaagggccattagctgttctgcttctgtgaactgtctgttcttttgtgctcctttttttattgggtttcaggatgtattttcaaattagagccaactgggttttctaacagattgaatgtgatgtttgagaaaatagataaatcgagtataatcaacgtctttgtattccgcaactggaaagattaagctacctttaagtgggatgaggaaaggtgtggttaaggcagctttcagattatcagatcaagggatcaagagttcaggtttggacattgttgagttaatgctgtctattaaatatc

SEQ ID NO: 228410 - DNA, 421 bp, Homo sapiens
agcctggcatggtggcaggtgcctgtaggaggctgaggcaagagaattgcttgagccccggaggcagaggttgcagtgagccgagaccacaccactgcactccagcctgggcaacagagcgagagtctgtctcaaaaaggaaacaaaaaaaaaagtacctccaaattatggtagggtgtccatattaagaaggtagaaaaaggtcgggggaagtggatgcctgtaatcccagaactttgggaggctgaggcgggtggatcacctgaggtcaggagttcaagaacagcctggccaaaagggtatggtgaaaccccatctctactagaactacaaaattagccgggcgtggtggtacatgcctgtaatcccagctacacaggagtctgaggcaggagaatcacaggaaaccggcaggcagagg

SEQ ID NO: 228411 - DNA, 490 bp, Homo sapiens
gcattgctttgcttcttatcaaaggaattttaaggaggatgaggcatgtatgaaatagcaactccaacagttgctatcaaaacaataagaaattattgttgtatcattattctggcttgtcatggaatttttaatgtttaagaattttgattttacaagcttatggcatggaaaccatggttaatatattaaaataaaggtggccgggagtggtggctcacgcctgtaatcaatcccagcactttgggaggtcgaggtgggtggatcacctgaggtcaggagttcgtaaccagcctggccaacatggtgaaacctcgtctctactaaaaatataaaaattagccggggatggtggcaggtgcctgtaatctcagctactcaggaggctgaggcgagagaatcgcttgaacccgggaggcagaggttgcagtgagctgagattgcgtcattgcactccagcctgagaaacaagagcaaaactccatattta

SEQ ID NO: 228412 - DNA, 440 bp, Homo sapiens
gacaagcaggcagctgcacacctgaccccaggccaccaggacctgcctttctcctccacatgctgccctgaaggggcctcaacagccacagcagtcctgcttctgtgccaggcaccacccaagtgctgttccatgtcacttccaacagccctaggagggaaactgaggcagagcactaggaggggagggtctgcacccaggcagacagctccaggtatgaaccacaggccccatgaagggtcacaccttgggtggggagaggacatgtggtcaggggtacaggggcccggcctcccctgatccctccttgccagcagttgcccctggaggttctctctcactctccaggttacgactcatccacgacggctgaggaacagccatgagccgggatgccctgagatggcagaggggagaactccaccatttctgactcaggg

SEQ ID NO: 228413 - DNA, 417 bp, Homo sapiens
aatcattttgttttcaaaaattttattttggaaaaaagttctcctacataactaatatcacatagctttattaattttgaatttaacccagattgttgtccaatatacttttttttcacagttgttactaagtttctgttttatcacagccagtcttaagtaaggaaattagatttatttaataattaaacctctatgacaatggcccagggccaactgaattcagcacagcaacttagaataagattctactggactttctatacttttcagccacaactgagcacaccgttgttctatgatagcattattgtcattaatgaaatgtataaatggaatgcaactaaatagtgcctggttaaatagttcctggggcttggtaacaaaacaaataaatacacaaccatactctgaaga

SEQ ID NO: 228414 - DNA, 478 bp, Homo sapiens
ttaattaggagacagtgttttatggggagattgtgacatgagatttctttaaatactattgctttcagagcatttatatgttgtgtatctcagaattcttatttttctaacttcaggaacaaatctattgggtaaagcagtggttcccaagctagattatcaccagaatcaactgagaatattttcccccaactattagaaaaattttaatcatactgagaatttgaaagagtaacaaattgaacacccaaatacccaccaactaaattaaacaattgttaacattttgtcttatttctcatgtttgtgtgtatgtgtatatatacatatatatatatacacatacatacatatgcatatatacatatatgctggaccatttgaaagttgcaaatgttataacacttcacctgaaactctcatttcagcatgtgtattctaagaataaagacatttgatacaacataaaattgtatct

SEQ ID NO: 228415 - DNA, 477 bp, Homo sapiens
gaacagggccctccttggttagaaactctctgatggtcgccccaggaggattttagatagacacacaaagaaaaggctgagaaatgctccctggggaaggtagggaggagaaggtgcaagaaaaggattttatatgctcttggctcctgactttggggaagcccaaattattacaaatcaatgtggtctcaattccagaggttaaaaaaatttttaagtccggctgggcatggtggcttatgtctgtaatcccagcactttgggaggccgaggcaggcggatcacttgaggtcgggggttcaagaccagcctggtcaacatggtgaaaccccgtctctactaaaaatacaaaaattagccaggtgcagttgtgcatgcctgtaatcccagctactcgagaggctgagtcaggagaattgcctgaacccaggaggtggaggctgcagtgagccgagatcatgccattgcactccagcc

SEQ ID NO: 228416 - DNA, 314 bp, Homo sapiens
gaagtacagcctggtgaaatgcccagttaatgctggtggggctggtggcctgttcacttactctaactttgttcctgctagataccagtgtgatgagcaatcattcagggtcagtttgtttaggaagggcctacaaaattctggctttttccatggttccttttgtttgtttcaaggtctattgtgataccatggctgttagcagtttcttgtgataaaacatgggcttgagacctcttcaactgtccttgtaactttcaactaatcatatccatggtgcagcatgcagtgacgaataaaagcaaatgacaaat

SEQ ID NO: 228417 - DNA, 654 bp, Homo sapiens
caagttctacatgcctactctggcacacactcctgacagataatagacagccggcagcactgtgctcaagtgcctggcccatcagccagcaggtgtgccaaggccggcagggtggctgcagcaggcggatgagtactttgcatgtgacacttgcaggggagggaaccttgggtagtgccctgtgtcagaacagggtctcacccttaaaaggcggagcaaagcctgtcttatcacacagtcctccatgtagtcacaatacataccagccagagtgatgtgtgtaatggaacgttacctgcaagaaacagggcacaaaatttcctgtgtgcacgtggttgacgcgtgaagatagcatctaggaaggcgcagagaacagaaaacaggccatgcggcacctccctttcctaaagaccgtttacaaaggtgctggcattgcgagttcctgcgttcatcattcatgtaataccaattagtgcctcccacactacagttcacaaaaggctgccaagcccggtgcttgctaccatgcagacctgcagccagtggtcccggccatggccctgacaggcttccagaactctgcagccgactcccggcctggaaatcttaccctaggaactgccacaaagtgaaaatttcgtggaactgaataga

SEQ ID NO: 228418 - DNA, 837 bp, Homo sapiens
atcaacacacagcaaaacaaggcatatgcagtgacatacataaatacaagccttgacatcacacacaaactgcacaatactggcgtattaacagatcaagtgcaataagttcaaagttcaggaaaagaaagaatgtgccatctcttgtttgaaacataatcaaacactggctatcaaatatttatagctatctaattcaggatgtcaagcagacagacgttagcaagaacatgttaaagtaggcggacagtcgtggctcatgcctgtaatctcagcattctgggaggccaaggcaagtggatcacccgaggtcaggagttccagaccatcctgacgtcaagcattccactggccttggtctcccaaagtgctgggattacaggcctaagtcactgtacctagacagactaaacttttaaaatcaactagacactttattatttgttctaaatggtccaaataccaaacatcatcaatgtggtagtctgacatgtgtgctacacatacgtttttatttgttatagtttaggtctctgtttcttatctacactgcaagacccaatatccagatatcctcctcatccctacctgccaaagtgtcctccattctaatttattcatttttttagagacagggtcttgctctgtagcccaagctggagtgcactggcacagtcatagctcatcacagccttaagcccctgggctcaaatgatacttctgcctcaacctcctgggtagctgggaccacaggtgagagccactgcatccagaccctcctccactctagtggcttaatcctagcattcaagaaaattggtagcaaagaagagcata

SEQ ID NO: 228419 - DNA, 706 bp, Homo sapiens
gaaaatctaccataaaattgggggcagggcggagggggggcacacaataaagactccaagagcatctgacccagtctttgtatttagaaatgacaaacttcatttcctggggctggacctgctggccaaaaggctttaaatgtcccagtgttggcccttgcttatctcctctagaatcactggcttgaaaacattcagcctccctttccaggagaaaagcaaaaacacacttaacccaattttccatagtcaacaaggcaatggaaggccagagagtgctacttctctctgggttcttagaagcagattatgaaaactataactaggtggaccatttagaattaaatgaaagaaactggataatttcctttggaaaatgtttgaattacaaattaaaaactgatttgaaaattatgttaactaaattattacaattgggaaatttccctatacatgtgtttattcattgtatcttggggtggggggaacattagagtggcaactcctgggaagacttttgatacttctaaatagaaatgctgggaataacagagctgggactcaagccctttgagactgagttcattaattgtagaaatcagattgctagatgtcagtagacctgatgtcataaaatcaaaccaacatttttgtcattcagaatagtcttctgagaatttagtgcattgatcaagaacctgtgtag

SEQ ID NO: 228420 - DNA, 424 bp, Homo sapiens
ataagctgagtctgaactgtggccagaaagatgtgaaactaagcagcaaggcagcccaaatatgaaatattgattgcaacccatgtggttagtgtatttatcgataccacagaagcagcagccaaaaggagagcggacatatattctctctctaaagaataaagttgacttaaaaacttttctctcagaactttactgaaatagcactggaacaagcagcgatagttaaccagggagtctggaactgccatagtattcactgaaagaaaagggaaactgaaattaatgaagcagacaaacctctccccaggtcatggtaccagaaatgttgatggctgatgtaataccttggttcttatcttcttagtttaaaagaatttaaacaagagacacacagcaaaagaagtacagcataatttattgc

SEQ ID NO: 228421 - DNA, 478 bp, Homo sapiens
gagaaaggacggcagaaggggtgtgaagagaaagtgaggggctcaggtgccaaggccttggaggtggtggggctgggggcaggcgctgcagttctcagcatgagacggggggcagcaaggaccccacctgcgctggcaggccctgctgcccctctagccaggaggagaatgctttttcatagggggaggaaggagaaaaatgacttcgggctcctggcaacttcagcaatcagctccttgtcaagcaaataaaatgcttttgaatgtccagattaatgattgatcagcacaacgcgagcctgttggaagcttccagttggcccacgtgggggtccccgctgcaggcgctggtaaagtgacaccccgttagtcacttctctgcgtgtgcttgggagaagcccacacacacatgctggtgcctgacgtggggttatttctgtgctgaggaggcaggaaacggcagaggaggcagcttcca

SEQ ID NO: 228422 - DNA, 258 bp, Homo sapiens
tgttggttggcgagtggtttccatcaagtcatcatgggaaaataatcaagttccatattcacaggttaggataggatgtaataattctcagaagaacccttctagtatgatatttgcttatcaaaatgtctcagaaacaaaatatttgaaaatactgtcacatttattgtatttctctctgttcttatgccgtgcatgtagaatgtacccaatgtttatgaattaatagataaataaggtctattgtcttttgaaaat

SEQ ID NO: 228423 - DNA, 589 bp, Homo sapiens
ataaattacttaatctttttgagtctattcactttaaaatgaaaataatgcaacttatttagtagagttaataaatagcacctggatcaaggttttgtccatatgtgacagatggcacactctctagaagatctctccatgcctctctgacaggaacagtgctgcagagaatttttattgttcattaacatcaagcagtaaatatggctgtatttgaagtgtggtgtagataaaatttgtatacatatatgtggaaattccacacacaagatttcactactatggaaatcccttcacagctcaacaaatcattcatagaagcaagttgctaaccactgggaaaaaaaatcctcataggatatgctgccaatttggcctagggtataaaatagtttttaattgcctagtagctatacccctttctaataagtatacatatatatttcagtagcctccttcttaaaatatacgtgtgtgtgtctgtgtatgtgtgtgtgcgcaagtatgtgtgtctgtgcatgtgtgcctataaatgtgtgtgtatgtatttctaaaaagaaataaatattactttgatacttccagttgg

SEQ ID NO: 228424 - DNA, 379 bp, Homo sapiens
aaacacctggcatgtccaaacgtgccagggattgccttgctttttcactctttatccttgtgggaacatgcaatcataatacgcttcacatttttgtagtgctgtgcccctttttcccaaacgtatctgggtaggtaggggagatgttattatccatgttttactgaggcccagatagatggaaagctgtgcttcagaccatcttggcacagtgctgggagtgtaattagtgttctgatgcccatctcagccatttgtcatggagtcatggctctaccatgtttgcattgctattcatattaatgccacaccatccctttgctaaccctctcaccaacatctgcaaaaattgcagcctacatttcagaattatatttac

SEQ ID NO: 228425 - DNA, 401 bp, Homo sapiens
agtgagcccagatcgcaccactgcactccagggagaccttatctcaaaaatacgtacatgaatttaaatataaaaatcaaatgtaaatacatgtatatgtcgcactgtaacaacttattgcttcttttcaagcagtaccaaaaagatactggtaaaagtgggattcacaaagtagtgagaccctttaaaaagcaggagagcggcagcggactggtttaggtgaacactggttaaattttcttgttttttaacgagaggtaagagctgcttatccagttaacactagaccaattgactccacctgtgcctcactttctcccacgtggccaggggagagtggagggtaagtcagtggccgctgactgcctgctaagcttcaagaaggcagtttagactgagca

SEQ ID NO: 228426 - DNA, 231 bp, Homo sapiens
caatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaa

SEQ ID NO: 228427 - DNA, 583 bp, Homo sapiens
aagaaaaaagcaaactttggagagataaaacagctcttcattctctagggatctgaatgtgcaggagctataccatgcttactgactgtcttatgagtgggcttttttgtgctgaccatttctttgaagcatgtgtaacaggatgtaaaaatgggatccttcaccgctcagttttggctgagcaacaagtgccagttactcctatatcataaagtaaggttcaagaccaccaaagcaggtcttgcaaagcaactgtctagaaaccagtgtatgactttcagtctacgaaaaaggttgagaggccagagagaattctagtaggatatgtggccacaattatcaatgtggtgtgggtctcaacccatctcaggtctaaggaaagttactttacctgggtccctgagagagcttggtatgcatccctctagatttaggacccagacaggcttctgtccaatccgttctgagaaatacaagggcttgtggctggatatctgctctaatagctgagcaaagacaaactgatgctttggggaggtctttcacacccacagtttttcaaaataaaaactgtccatttccc

SEQ ID NO: 228428 - DNA, 557 bp, Homo sapiens
cgggaggctgaggcaggagaatcacttgagcctgggaggcagaggttgctgtgagctgagattgcaccactgcactccagcctgggcaacagagtgagactctgtctcaaaaaaaaaaaagtcttcatttatggttacccatttcatcaatgctgccagctctagaacaaatagcagaaatgagaatgttgattcagagggtcagaaaatacttaaggcttctgtcacattttcttcacaattagacttgatctcctaaagattttaagaaatgccagctgggtgccgtggctcacgcctgtaatcccagcactttgggaggccgaggcgggcggattatgaggtcagaagattgagaccatcctggctaacacggtgaaaccccatctttactaaaaatacaaaaaattagctgggcgtggtggcgggcacctgtagtctcagctatccgggaggctgaggcaggagaatggcgtgaacctggaaggcagagcttgcagtgagtggagcttgcgccactgcactccagcctgggagacagagcaagactccatctc

SEQ ID NO: 228429 - DNA, 487 bp, Homo sapiens
tgctggtttttgctggtttcattgcagcatttcagctctcctgcaacaccactgacatttctctattgtttttctcctccacactgagacctattggctcagaagtccaccagcataaaacccagattttcatacttctaaattgttttcaacatagctcaaccaggaagattgttaggcattggaggccttcctggctttcataccctggtaaacctcaccccacatgtgctaaccatagataagatggagccttgtggttagaagacccccaagacactgtctagctgctgagaaacatcacttagactcataagctccttctccaatttccatctcccccagcagttctcttgccttcctccccatttgatggtgatcccacacccataaactctagacagtcttttactctgaggatgtccccgcttctgctaccctatccaagcaccacccaataaagttgtttgtgtggtactgccaatgg

SEQ ID NO: 228430 - DNA, 608 bp, Homo sapiens
tatattaaaagtcagtactacttggcctactatgttacatccttcattttttaattctttattttcctttcagtactttcataagcatactcttcatcctagtcataccttttgttattttctaaagatatcatttcacttccttattttagtagtattatttcctcttcttagaagccacactcacccaccattacattcacatagaaatctgttatactttctacaagatactgcttaaatatcacctattctgtgaagtggtcagcatcaagccccttgtctccaagcagtttacaattagttgttgcatttctcgttttcccatagcattttggagtttatggcttcattagcatttatctttggtattataattacgtgtttactcctttctgctctttgacctcatgagccacctcattcctcattttcccatagtattttggagtttatggcttcattagtgtttatctttggtattataattacatgtttactcctttctgctctttaacctcatgagctacctgaaggaagagactatatttacaccaagcatgtccaatatgctgcccatgggccacatacaacccagattgactttg

SEQ ID NO: 228431 - DNA, 131 bp, Homo sapiens
catggcagctatctgagatggtgataacagtgagctaaagtactggtcaacaagaactgaccaaaaacattaaaaggaaaagctggagaatgaggcatctataaagggctgtgaaaaggtctgacacattc

SEQ ID NO: 228432 - DNA, 603 bp, Homo sapiens
gcacgagattaaaagagagaagtctttttgtagatttgctgatttatttatgaaacacctctgaaatatttataaatgctttcctgatatttatctgaaaatacattttagggcttctttggtagaagagagggggagaataaaggatgatgagggtggaagaacaaggtgaattcagcaccatttctttcagtagcaaggaaagggatatcctagggtataggaacatgtcactagggggtgccccaagaaccaggccggctctaacctgctcagcacaggtgaccctacttgcttggatctcttaaacagaagcaatggcaatcacaagtgctctgtttaattttcctgacagaaccggggcagatacagacgctcttgagggctttatcacttccttcacttttagagctatttattaattgaaataatagttatgctaccccttgcctcagacctactttcatctgtttagcaactgctttctatgaaacacaaaagagctcagcaatgacactcgtgtcttaattaaccattgaataccttatagagcagctgtcacaactcttgtcacttgaaaggaagcacagtggtccctgttta

SEQ ID NO: 228433 - DNA, 481 bp, Homo sapiens
tatgactgactagaatagaatagctcttatgaaaggatgagaggttgaccaatcaggaccttgtttatatttacctttctgtggttaaaaataatcacttgttagtttaattaaaatatgatatgtgtcctggaagtattgtcagagactctgtagataagtgtaaaatatatacattatgagtccacttgagtaatgtagactttcaacttcatactttaggcaaaaaagaagtcaaaaactatcttccagaggcaaagattatattttacaatagaaatgcaaatgaacaataaaaatggttattttctatgttattagctgttgtagggagtcagctgtggaaagtgtaataaagagggcttatgattattattattattattgagtctcgctctgtcacccaggtaggagtgcagtgagccaagattgtgccactgcacgcactccagcctgggcaacagagagagacttcatctca

SEQ ID NO: 228434 - DNA, 585 bp, Homo sapiens
ctttggcccatgcggcgggtccaggcagctcctgcagctgtgctcatggctgctggcccagaacttctcatttttgccatgtggaagcagatttgctagtagaggaattttccaagtcaagggaagtgttgccaaacctcttgcctcgacctgtggggggccttctgctcttgttttctcattctctttggagtgggcacagaggggacaagtcggcccccagtgaggctcagggagtgcaggagaccagggagggaagcccagatgatggggaaacagagccaccttgagggggtgtcatggggtcagtgtcagggtgatctgacgggtcagttcatacttaagcaacattattctgttcgtttcttttgggtaaggaattcctcatgggaggtgtggtcatctggtcgtagaggtggacagaaacaccccctcgtcttcctgagccatttggaagccctttcctctagccctaggtactggtgacacaggcccctcggtctcaggatgtggacagggctgggaggtgcaggcttcttgtcccatccccactcagtatcatcgggtatctggtagtcaggggat

SEQ ID NO: 228435 - DNA, 359 bp, Homo sapiens
cccatctgttggaaagccaccacagtcgtggaacccaaggcaacctacataacctcctcaggcctccatttccttgtgggtaaaacctcatggagctgctgtgaggattcaaccagttaatgtccccaaagccctgagaactgggaatattcagcacctgttcccctactgttctattaatgattattaccatcttttcatctcagcccttgctatgaagtaaagtggccttcatccacccttagacaaatgagaagtttctgctccttggagaagattttaaggaagccatttctagaatgttccttattccctcctcccactgccttgtaagctcataactcctgggaacctctggc

SEQ ID NO: 228436 - DNA, 593 bp, Homo sapiens
gaaacagaagcattcgccttgttttcctagctccaacttgtaaacatgaagaaagtaagaagggaaaccctttggggattacaaagaatgatagagctaaaataaataaataaagcctaaatttatttttttaaaaacgatagaggcttgaggagatttacatgtcattttttggtgaactctgtggcagctgctgccgtgtgaactgccaacaggaggcacatgaggtctggttgtctcgctgtttgtcattgttggcctcctttgatgatcatttcccagacctactcattatgtcattccttctccatttttatctgaaatacctctctaaagagaaatttcttctcattagctatttggctatcctgaagtgtggatcatataagaaaggtaaaatacgtgcttgaaactttctctttattttctagttttcaaaataatgtggcagttccccagtatccacgaaaactgaccaatgagtcggtttctctttatttcatatatagatgaggaacatgcagcatgactacaatcaagaaaatccagactgtgggaagttctatgaaacaaataacctaatttcttcattt

SEQ ID NO: 228437 - DNA, 329 bp, Homo sapiens
ttgtttttaggaaattattcaaaagtttaagtgggttgtattatcaatgcatatatctgctttttaaattagttacttaaagtagagaaatttgtatttcataaactttaaggaactgctgtctcatttactatgctgggacatctgctgcccgttgatagtaatatacagtgactacccatttgttgtgtaaagtccaatagatctggattcaaggctctgctcatcttaggcaaatcacctgaacctctctgagtctcagcttttccaaatgtaaaatgggggtatggattgttgtgtgaattaaatgaaacaatacatttaaaaca

SEQ ID NO: 228438 - DNA, 372 bp, Homo sapiens
tgtttgttttttgcttgagttaatttaagttagtttctattacttgcaactaagaagttttaatgaattcacttgaaatactattgttaggaaggaaacaacttgcttgagaggtcaagcttaggctgaaagtcaacattggccaaggcacttagagagcaattaatcctcgtggcaaggcagggatggggtggaggggatagatgattcctaaggtcctttctaagaggataagagtgcttcccctggtcagtggttctggctagtctcctccctcccttcaaaatgcgaagcaaaaggcagggagaaggtctccttgcagatcttcagctctctcagggaaagagacccacgtcactcccagcagagtcc

SEQ ID NO: 228439 - DNA, 532 bp, Homo sapiens
  misc_feature (60)..(60): n is a, c, g, or t
ttccgacggagactctcgctgtccactggacgggggcccttccctgtttgccagccaagncggacagcgagaggagacagcttatgtcattatttctgtatttcagagacctttagtgcttccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccagaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaat

SEQ ID NO: 228440 - DNA, 898 bp, Homo sapiens
  misc_feature (60)..(60): n is a, c, g, or t
ttccgacggagactctcgctgtccactggacgggggcccttccctgtttgccagccaagncggacagcgagaggagacagcttatgtcattatttctgtatttcagagacctttagtgcttccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaaggtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccgagatcacgccactgcactccagcctgggcaacacagtgagactccatctcaaaaaaagaaataaggaaatgctgtcagaagcctaccccacggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatga

SEQ ID NO: 228441 - DNA, 422 bp, Homo sapiens
tcttctagattggaaagtttaagcacatctacacattattttataacttgtgttattacataaaatagccgttatcatgaatgtagtaaccataaggatgcaattgttaagaggtgatatatttaacttgaataaaacttagattatcttagctgaaaatgtaaccattctcaaaaaatagccattatcttttgtttacttctgagtgtgtaacaaaagtgtttggtcttgcatttaaggacgattgcttttcacttatagttgtcaccttatagactcaaatttgctcaccattagaaaaaaatctgataaaactgtgtaacttaattatgtattattattctatttgacatttaaactaatttggagacatatccaccttttatattgttaacataaataaagtaaatatgtagcaattt

SEQ ID NO: 228442 - DNA, 833 bp, Homo sapiens
  misc_feature (68)..(68): n is a, c, g, or t
  misc_feature (174)..(174): n is a, c, g, or t
  misc_feature (280)..(280): n is a, c, g, or t
aaaagtccaatgttcaaatgtccaaagtgaggaaaaaggagggggggtcctgccccaatttttttttnttatttatatttcttaaaaacaggcttggggtttgggtccagggtggaagtcaaggcacatcttaggtttcaggcagccttttaatctggggcacacactcccccnccttcccaaaaagggctaagggatataggcgtaagccacagggccagggctggaagtatattcttgtaaatgaggcaccctgggcacagaggtagcatacagacanaatactgttccccacacaggtcctgcagttttactgaaaaagcctttgtgactgttgcaatagaacattggtctccaattcaatgaaagattaagcagtaaattaaactaccagttgataacaataccaatttaacttgaggttcaactgcggagagtgaccatcagagtcaacccagcctctgatgacgctgatctgaagtggcgactcctaagctacaccctgcctcttatcagttgttgcggacccatctttacaaagcattaagttgttcatgagaagcagggtgtgcttgcccacacctgtaatcccagcactctgggaggtcgaggcaggtggatcgcttgagttagagatcagtatgctcaacaaacatggtgaaaccctgtctctactaaaaatacaaaaattagctgcgtaacgcctgttaaccccagctagttgggaggctgaggcaggagaatcgcttgaacttgggaggcggaagttgcagtgagccaagattgcaccactgcactccagcctggtgacagagcgagactccaaaaaaaaa

SEQ ID NO: 228443 - DNA, 553 bp, Homo sapiens
tacatattggagtagaatgtggtgctaggttagtgaaatattggcttggaaaaagcataaattaagcacctgtacagcacacacccagcacattgccttcaacgggttctctgtaagttttagttgaattaaagagtaggctccagtagccgggcatcatcatatcagtaagccaaactatttaaagacttcatttagtactatagattttgacgtttaaacttagaatgtcacagttcagaatttaagattttgaaaaactaacatgtttacatgttaagagaaaaaagatgtttttaatcatatgtttaaggaactgtgagggatgtgacttttgtatgataattttctgttgaaattacatgaattattcagtaggcttccacaattattattgactactttcaaaggcatatgagcactctgacgtcttatatcctttttaacatagtagcagtaaaatagctagatgtatctccagtggctgatcctgcctagctttctcctagggggagtgctttatttaattgcaaaattaatacaggcagatgga

SEQ ID NO: 228444 - DNA, 449 bp, Homo sapiens
tcttcattggaaggtgagaaaaattgcctaaacaaagaatctgattaatttttaagtaaaaagtggaagacaaaaatagagtacagccaatgtctaaggggacttgaagctgggcagaagaccttactcaacacagcagatagacaacggagtgcttcagagcaggctgctgacgcagtgaggccaaaatataagaaaaaacagctggatgctggtgttgaagggacgtctggagacaatgaagagctctggcagcagagtgagtgtttcagaagacagttaaaggccttggtgacgaacaactgcggagaaggaaggtgttttcaaagtttgaacccaactgtgggggacggaagggagtgaattctgacaatttctgaaactgaattcacagcaagacatcaatggctaattttaattacgtaataaagaaaatttctggatataca

SEQ ID NO: 228445 - DNA, 539 bp, Homo sapiens
cagtactcttatcatttccaccatctctactactttctttcaatggggtggggtagagaaaacatgagctaatatgagaaaaatataggtgtatacaattaaatgccaaaccacatggttcagcctgggtatctaggaacctcttctagtgccttgcaatataggaaggactcagtgcaaatgtgttgaaggtgaaggggagaatagtcttagcctaggcactgcagcacgcgaacagacagccgtgcagaggcacagggctgctaaacgtgttctgcctcctcagaggctccaagggaattcagcacttagttacggatttcactgttacagtgctttgagaattgtttatcattacagcctgtcactgctgctaaggaataaatgtttaatttcctaattcagaggcactagaaatagtaatattagagtcattcatctaaacataaagatggcagcccttagtaataatagcaggagacactcagtttgtaatcagccactgctttgtaacaataaagatttccaaacaaaatgct

SEQ ID NO: 228446 - DNA, 397 bp, Homo sapiens
ctaaatgattaggctttagagttttcaggacccgagcttgaatctctaatccatcagagattaactgtgtgactctgggaaagttacttacgctctctgtttcctcatttgtcagttagtacctagcttcctagggtttttatgaggatgaattgtgatcatatatctaaataactctgcatgggaccaggcatatggcaaggctcaataaatgttacttcttgttaaattttacaaaacataagagcttgtaaacgtccctctctctgactcaagtattccccacagcaccttggggtccaggacagtaatacacctcctgctctgctgttttctacaaatctgccaataggaatccctttttacttaatcaaaaggctattctttcctaggcccg

SEQ ID NO: 228447 - DNA, 525 bp, Homo sapiens
cagagcctggaacatatgccctgggatcccaaagtaagaccagtagtgactggatgagcatccatagaccccattcatactagtcactgtgtgaagctggagaatgatcccaggaattcactacaagattcagtggcttctctagaaattcagaaatggaactactaaagcccattgatgctcagactcctgctgttgattgttgctgactcttggatccttatcaaacctatcactgcagttgataaactagtgtagtgaagatatgaaagttgtttggtatattcatttatgataatgagtagaatgaaagtggaacaagaaagatatacatctgaaatttactcattcatcaatgatgtgagaaaattgaataacagaataatactggaagaatacgtttttcggttttgcgtgttactgagagacatgacacacttttaagtttattctgcattattaatatcttctccatcagtttctcactctacacaatcaataaaataaaacaatcaaactctgagt

SEQ ID NO: 228448 - DNA, 496 bp, Homo sapiens
cagtaagtagccctcgaaattcattactgagctgttggcagctctaggaaaagtttaatggaggagactaaaatacagccacaatgaggtttgggatgggagagaacacgaaatcaaaaaattttagaaattatttatcttgctcccttactgcatagatgagaaaacagagcagtgattcaccacgatatagcagagccagggacagaacccaaggctcccgactcagtggacagtacacttgccactggaaatcatggtggcatggaaagaatgtgccctttggagtcaagcagctctggattcataactagcattgccacctattagctgtgtgatcttagaaaagttactttgggccaggcatggtggctcacacctataatttcagaactttgggaggctgaggcaggaggatcacttgagctcaggagtttgagaccagcctgggcaacatagtgagacccgtaacatagcaagaccccatctctacaaa

SEQ ID NO: 228449 - DNA, 276 bp, Homo sapiens
ttcatagtgggaagagctaaggaagcccacctaatcatccagtttgtgtgtaaaaacaagtgttccaaggctagaatatatgtggactcatgagttatggggagtgggtaggctggctaagtaggaatttggatataacaagactggggctgggtgcaatggctcatgcctgtaatcccagcactttgggaggccgaggtgggaggatcgcttgagatcaggagttcgagaccagcctggacaccatggtgaaaccccgtccctactaaaaataca

SEQ ID NO: 228450 - DNA, 445 bp, Homo sapiens
cagttactatgtcacatgcagtcatcagtttctctgcaaccctacaaccacaggggattccattgcttgctttgacttggacttctcataaaatgactttcgttggatttagtgtacaatttttaagttaattactgattttgtatatatgtggtattgtatctttgaaagctcatatgagtttattagggattttcagaattatcaactaaatctggctagaaaaaaaattatctgatgaaaaacctttctggtaacttaataaaaatggggtgatagcaagtgtaaatgccagttaaatcctgggtgctggtgtgtgtgaatacatgaatacatgtgtatggttgaaggaaataatttgtaaatcatagctttcctagtattacgtgtcccttcataaaatagctcagagttttctcatgaaaaataaattgacatttgagac

SEQ ID NO: 228451 - DNA, 478 bp, Homo sapiens
cagatggaactcctactattagcccaactcttgggttgaaacagtgtgtccaggaaaccctatgttaaaatgcaatgtgttggggatattgttcctctatttgcttgagttaattttcaaattagtgtactcttgcttagctgtgctctgagggaatgaacaaaagattggtaaactctgatggagaacactggtcaggcagggcacatagaatccctggggatggtggttcctgacaaatgggggaggaggacctgagccaggcttgggctgggctggaggaacatgaagatgggatctactcacaacccccagaactgaggggtcctgataacacattatttcaccctcagccatgcaaattcattatttttatggataaaatagctttaaaaaactaatttacattgaaatgttaaaatatttatatagagattattgggaatcccctcctaaagcccaaacataaaaactacca

SEQ ID NO: 228452 - DNA, 580 bp, Homo sapiens
tccatggaatacaaatgatgactttgatgcctcctgcctgtgaagtatcaaaagatacaggattttaaccccctttggaatcacttgggggaaataatgcatcttcttatttgagaaactctctaaaaataaggaaaaaaacccactcaatttcaaaacagcacattttcaaaatgtctgaagcatgacatgtctataaaggaattctacatataaaatagaaaatcttaagaaaaggagaaaatttatagtttttgatattttatacttaccaaaaattctgtcttttagcacaagtaaacctaggtagcagggaccaagactgaaaataataataaaccaacaagtaatggaaataagcaagtaaacaaaaatgaaaacattctgctaggtaataaacagattccacaaacacattatactgaaaagtaagtgtatcaaagagttagggagcaaagttaagttcctaataaaaggattgtgttgtcagctagaagctttaagcgttccatctccaggtttggtaggatgagaaggaaaataagatatatcatcgtgtgtccagcatagttccttgaac

SEQ ID NO: 228453 - DNA, 574 bp, Homo sapiens
tgagacggagtttcgctcgttgcccaggctggagtgcaatggcaccatctcggctcaccgcaacctctgcctcccgggttcaagcaattctcctgcctcagcctccctagtagctgggattacaggcatgtgccaccacgcctggctaattttgtatttttagtagagatggggtttctccatgttggtcaggctggtcttgaactgccgacctcaggtgatccgcctgcctcggcctcccaaagtgctgggattacaggcatgagccaccatgcccggcccaataagcacttttaactcttccttgaccaaatacgaatcggcacctctctaaacaccgtggacatctatgtggggcatggcagggccctgcctgcacaggcaggtgctgggggtggaggggacagcagagctgagcctgcagtgaggtggcctcaccagacaggagggggaggaggggatggagactgcagagccctcctggcagacagctgaggctgcgtgtggacctgggggtgatgtgctgggccacaccagaaccctcccagaggccggcccccgctacaagcaccgt

SEQ ID NO: 228454 - DNA, 304 bp, Homo sapiens
tcttagaaaacatgaactatacaagaaaaaaaaattggtaagttggacttcattaaaatttctcagctgggcatggtggctgacacctccaatcccatcaccttgggaggccaaaacagaaggattacttgaagccaggagttcaagaccaaccagggcaacatagcaagaccccatctctacaaaaaatttaaaaatcagccagcaacgcctgtagtcctagctacacaggaggctgagttgggaggattgcttgagcccaggactttgaggatgtaatgagctatgattgtgccactgcact

SEQ ID NO: 228455 - DNA, 355 bp, Homo sapiens
ctgcttatagtttctgctcccttttaacttctgtgtgcacatgacttggacttgttatggtactatgctctgtgctggaaacgtagcggtgagtaaggcagccctgacttctcagctctgcataggacccacagtagggtagggaataaacacacacacacacacacacacacacacacagttgtgatgtgctatgaaacaatttgtcagatacaatgaaagcttacattaagacagtgtaaactgtggatcatgatctatgagtgggtcatgaaatctatctagtggcttaagaccagtatttttaacaaactaaataataaaacatcctagtaaatcacagataataaggata

SEQ ID NO: 228456 - DNA, 1030 bp, Homo sapiens
gcattacttttatacatgctcatatagcaagtaaaaaaagacacaagcatgtatcaaatatgacccctattttatcaaataaaaaaatcatatacaaatgctcccccatcaagctatgattttttgaccttacagtggtttgaaagtgataagcattcagtagaaaccatacttcaaattagtaattgaaatgcattttcagcttacaatattttcaacttatgatgggtttatcgaggggcatctgcgaatacgtatgtgcaggaaaaaaactagaaggaaatataccaaaatgtattgcgttaatggttattatcagtgcttgataagattacaggctgctttcatgtatttttcattcttctctatattgttacagtttaaagaacatgtatatgtgaatcagggtttcttaattttggcaccactgacatttgcagccaagtaactctttgttgtgaggggccatcctgattatcgtcctgagtttccctgacctagatacacactagataacagaaacacctattcctccataggtgtgacaaccaaaaatgtctttggacattgcctaatgtctcttgggagggggaaaaatcagccctgtttgagaaccactgatataaattaaacaagtgtttctttagtaagaaactttcaagccatatagaaataaaactaaggcttaaataactacaaataaggtaagcaacaacatggctcccctacactactctcttctctttccattctcagaagaatgaaagtgtgggataatggcctggttgaagtttacagagttgtcaggcgatgaatgattttgataagcccccaattccctccccataaaataaatagactacataaaacaatatgggcatagagatttcttatatgtttaggcacacaattagcacttaatgtatgtttaataataagcaatgaaccccttaccaaattagtagtagaacttatggtccttctctactctaaactctcctccagatgctgggaagtgaaaaaaaaaaaa

SEQ ID NO: 228457 - DNA, 777 bp, Homo sapiens
agacggagtctcgctctgttgcccaggctgtagttcagtggtgcaatctcagctcactgcaagctctgcctcccgggttcatgccattcttctgcctcagcctcccgagtagctgggactacaagcgcctgctaccacgcctggctaattttttgtattttttagtagagacggagtttcaccatgttagccaggatggtctcgatctcctgaccttgtgatccacccatctcggcctcccaaagtgctaggattacaggcatgagccaccacgcccagccaacttataacttttatatcattagacacatggaatatgggcctccgtttgtactcttgcccttggccccacaaacgttagggagaggcctggctcctgcaatgtactatttacctgttgtaaagaatagcccttcaaaagtattattctaagtctgtttgacataataggtccaaattgtattacaacatggtaaaaaaacaacaatccattaacaatcctctttggatttctaaaaaagttttggtagcctaaactctttccccaatttttgatatcacttcatgtcattttagagagtaagttttcctgttttattaatgtttatatttaagctgaattttctaaaagaattgtgagtgtttttattctattgtgacattcaaggtacgcagctgacccttgagtataagtcccatcaactaagtaaacatcaaacatatcttcagtacatccccatgtgctacatcctccatgtgctgaggatcctctagagc

SEQ ID NO: 228458 - DNA, 789 bp, Homo sapiens
ggcggcaggtgcgtaccatggaatactgtatagccatgagagacagacctagaactatgaacagcaagcgggtggctcttaaaaatagtgttgaatactgaaagcaaggcatgagaattgccattatgttaatgtagggcatacggcactgtatgtcctatgaggatgtgcatattttgattcaaatacattaaaatggacgttatggggacacagattatttatgaaaggaggagaaaagataaaactgatttccttgttttagggtgacctcacatcccagtgagcccctcaattcagggccagggaggttgattggttaccccaccccaagccaacccaggctgttttcagcacagcggcctgataagctgtgattcagaccttgaagttgttaggcaaaagctctccactcggctctgtatttgactcaggaagaactgaagtctttataatggcctagaccagccttgcaccgtggcctcccactccacacctctctgaccgcagtcctcatttctccgagaatccgctccagccaccctggcctcagggccctctcaggactttccatccccctcaccctgcttcactttcccccatgatgcttatgaccttagatctagtacactctgttttcattacgttctatgtacgactctccctattaccctactagaacatgagccagggggcagggggcttttgtctgtgtgttttcatgttgtatccccaggcacaggatctgataggcggtagacattcaataaatatctgtggaatgaatga

SEQ ID NO: 228459 - DNA, 289 bp, Homo sapiens
gagactgatgaagagagggtactatagaatgaggagtattattaattcaacctcctgcatctttagtctaaaagaacaagaatagccagaatgtctggattaaaagtgcgaatcctctacccactaggtttttgtaagttagctaatctctctttccctcagctcatttaaaacagaggtaatattagtacctacctcatggaattgttgtgaaaacgaaatgagtcggaatgtgtaaagtgcttagaagagcacctgacactcaaccagtaactaccagtaataaaca

SEQ ID NO: 228460 - DNA, 424 bp, Homo sapiens
ccccagattgggtcaggtctgctgttttaaggttgggaagtcacaggtgttccttttcttcacagcacttcttacagttgttattctacctctgtctgtgacactggcttttccacaccgtgttgcactggtttgtaagctccagaagggtagggccatatctctttgcttagtatatatttcaagtgcccagcacacagcaggtcctcagtacatagacggctgaatgaaggcatggccctttcttctgttgttttctttttgtgtcccatagcaatccagtcgcacacgttgggaccaggagggtcacttcttttaatgctgacagcattgaattccagatcttggtctgaaaagtgcaaatttctttctttctttcttttttttttttgagacagagtctcgctctgtcacccaggctgga

SEQ ID NO: 228461 - DNA, 449 bp, Homo sapiens
gcgctcttgggcctcctctttttgtttgtcgtgttggtgtttatatcaaggctcttcggggactcagctttgggctgagcttggtgcaggtggcctgtacacccccagcctgcagcccagctcctttgaatccatgggagccccaggttgccattttcatctgccaggtgcagagcagtgagcctgggaatcccagcactttgggaggccgaagcaggtggatcacctaaggtcaggagttcgagaccagcctggccgacatggtgaaaccccgtctccactaaaaatacaaaattagctgggtgtggtggtgcgtgcctgtaatcccagttactcgggaggctgaggcaggagaatcacttgaacctgggaggcagaggttgttgcagtgagccgagattgcaccactgcactccagcctgggtgacagagtgagactccatctcaaa

SEQ ID NO: 228462 - DNA, 522 bp, Homo sapiens
agttgaacagtgagaacacatggacatggggggatgtgggggaggtgggcatcacgcagcggggcctcttgaggagggctagcattaggagaagtacctaatgtagatggcagattgatgggtgcagcaaaccaccatggcacgtgtatacctatgtaacaaaccggcacgttctgcacatgtaccccagagcttaaagtataataaagaaagagacaagagttaagtgtctgtagcatacagtacattatttcacttaagtcagtttccaagaacctattgagaacattgaggacatattgtagttctacatgctgcacaaactttacatattcttatgtattcaggaattacaactaggcaactgaattcatcctgaacactctttattcccaacagcatattcaagcaaagacacagagcaaaataaaggctgctcacataacacttaactaaatggaaacatgaatgaaaagccactgaaatatcggtctagcatgtcttcaccaagagggcatacta

SEQ ID NO: 228463 - DNA, 710 bp, Homo sapiens
  misc_feature (385)..(385): n is a, c, g, or t
  misc_feature (431)..(431): n is a, c, g, or t
ttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaccctgaagagatgagataggaggaaagacctcacagccagatctgctgggttttgaggagtgattttctttcttccccttgaaggggaaaaagctattttcattgntacatttaaagtcccccaactatggggaggtaccaattctggacangtgccactacaacaacactaaacctgaacttttcaactccgttgggtggtggaaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcccaattaaacatgagctggtttcccacaaaaaaaaaaa

SEQ ID NO: 228464 - DNA, 428 bp, Homo sapiens
gctcctctcctattttattgggtaatcctgatcttgaagggtagccggagtttaaagaaacagctctaagacacctgaagtcaaggacaacgaacacgcaaaaaacaacatttgcagtcaaggaaagagaagcagagaagctgagccactttagagcagactgaagctcatgactgcctttccttcttgttgctatatgggaaccgtatctatctgtctatttatctatctacctaccttattgtttatgtatcatctatttacagatagagacatctaatgttttggagtagggccctaaacccaagccaccagcatttcaattcctggtctctctgatcaactgtgtgatcagggacaaatgtgaacctgtcaacctcaatcctctgtgtataaaataggaataataaatggtaactaaatcggta

SEQ ID NO: 228465 - DNA, 1558 bp, Homo sapiens
  misc_feature (432)..(432): n is a, c, g, or t
  misc_feature (1399)..(1399): n is a, c, g, or t
  misc_feature (1460)..(1460): n is a, c, g, or t
aggcattttactaaccaatactcattaagcatagcgtggattcatatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatngaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgttcgaagtatggcaaaatggaactttaaaacagtatcttgtcaacaaccaagaggacctgtttcacataaagcccacgcattcatctgcctgtccatcattctgtctgtccacacgggcatcattcgttagtggaactgagtgcccgctgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgcccnggaacactcatctatacctgtctgacaaggtcaagctccaaggaagggactctctacatanctacattgtttgcagattttacaataatcatttattcttgcatggctgatcattgttaaccaatacaaataaaataataaagaaatgacccacatttt

SEQ ID NO: 228466 - DNA, 504 bp, Homo sapiens
cagtttttattttcccctgagccactaacataataaatgaggaagtcaacagctttcatgatttgggagtagattcatggttgcattttgctggctgccgcttctcattcacaaggtggttgaaagccacttttccaatatcacatgcctggtttcaagtgttcaggtctagatttaaatctggagggattctgttgtcatagaccctcccagggagtgtgctatttgagaaatgtattgagaaaggtggggttgagagaatgaacagccctctccccagcttgtttttataatattgctaaaaataaatagacaaatcaattttcctctaacagctcaacactggacaagtaaaattctttgactaagatgcagaaaatattgctgtaaacccaacagcacaagctgagaggtaaacaggcctgctgtgctctccgtgtagatgctgcctttcccaaccaattgaaaccactgtttctctggttgtaacaccagacaaaaaaa

SEQ ID NO: 228467 - DNA, 929 bp, Homo sapiens
tcttgaactcctgacctcaagtgatccacctgcctcagcctctcaaagtgctaggattacaggcgtgagccaccacacccagcaagaacatgattttaaaaaacaaaacaaacactcaaactttcttaagttaccataagaggcctcacatacagcttccttaaaactgcctgcaatttggagagaagcagttaggtactggaactgcctgtgggtaattattgttttcaaacagtgacagatgcaaattctcttcttttgggggaaattgcctgtagctaaacaccggcgccatcactttaaacaaatctcctgatacatatggtatgccaggcgctgagcccaggaacgagggagagtcagcccccgccccccatccccgatggagctgatcccccatcgggaggcagcagggattgtacctaaacaacatgtgaataaagatgaggaagcacagcccatgaaggaggaggcttaacccaaacttggagagtcaggaaggattttcagaaagagtgcagtctgagctgaaatggggagcggggagggcaggtgcagccgccaccgccaaaggtcttcctggtggaggcaactgcctgtgcaaaggcctcaaggtgtaaaagagcttcgttaacacaggccaatactgagtgtagaaacgctgcactcagggcagatgctgaaggcagaggtggaaaaagtattttatatagtttcttcttaaaagtcattttgggattacaggcgtgagctactgcgcctggccaacctgatagtattcttaacacagattgttttcctgccatcatgaaaactagacttgctttaaagtctttagagtctcagttcatattccaggcattgttttacataaatatcatctgtttattttttctttaagcaaatttcacaaactccatctaaaaaaa

SEQ ID NO: 228468 - DNA, 333 bp, Homo sapiens
agtgtcccctaaatattaagtctaaacatttatattaataaaatacaacttttaggccaggtgcagtggcttgcacctgtaatcccagtactttgggaggccgaggtgagcagatcacctcttgacaagagtttgggaccaccctggccaacatggtgaaaccccgcctctactagaaatacaaaaattagccaggcgtggttgtgcatgcctgtaatcccagctactcgggaggctgaggcaggagaatcacttgaacacaggaggcggaggctgcaatgggcccagatcatgcactccagcttgggcgacagagcaagattccatcttcat

SEQ ID NO: 228469 - DNA, 698 bp, Homo sapiens
tgacagagtgagactccacctcgaaaaaaaaataaataaataaaagccagtgccagcttagaccatgactgagagctcttggtttatcttatccttgccgagctgggtgttacaacattgaagccttctgcagtgtcctccctccctttttctctctttctctctctctcctccctttcttccttttacttctcttaggataggctcgtctgtacttttttgatagaggtaaccatttgccacaccattttctgaagtgcctgctctcttccccattcatttgtgatggcacatttatcctaccctaagctttgataacgtgtcaggatctttctgtcctgtcctctcaaagaggttaaatatttttttataataacttataattgactgaagttataacagttttctcatgtcaagtataaaaacaggccaggcgaggtggctcacacctgtaatcccagcactttggtaggccaaggtgggtggaatgcttgagtccaggagtttaagaccagcctggacaacatgggacaaccccatttctacaaaaaaaaatacaaaaattatccaggcaaggtggtgcacgcgtgtagtcccagttactcgggaggctgaggtgggaggatggcttgaatctgggaggtgaagattgcagtgagctgagatcacaccactgcattcagtctggataatagaac

SEQ ID NO: 228470 - DNA, 210 bp, Homo sapiens
cctggtggccctgccatgtttctggtggtcactgactgagcatgtgctcaggacaaagcatctagtccctgctctgtgtgatagcaggatcaaattcacacataacaataataaccttaaatgtaaatgggttaaatgccccaattaaaagacacagactggcaaattggataaagagtcaagacccatcagtgtgctgtattcaggaga

SEQ ID NO: 228471 - DNA, 2678 bp, Homo sapiens
  misc_feature (1989)..(1989): n is a, c, g, or t
aacatttaagaaataattctttcaatccatgaacacaggataactttccatttatttgtgtcttcagtttctttcatcagtgttttatagttttcatcctagagatttttcaccatggttaagtttatttctagatatatatatatatatttttttttaattgtattgtaaatgggattttcttgatttctttttcatatagttcaccattaatgtatagaaatgatactggtttatggctgtaatcccagcactttgggaggccaaggcaggtgagttgcttgagctcgcgagtttgccaccagcctgagcaacatggcaaaaccctttctctacaaaaaatacaaaagttagccaggtgtggtggtcccaactacttgggaggctgaggtgggaggattggttgagcccagggagttgaggctgcagtgagctgtgattgcaacactgcacttcagcgtgggcaacagagtgagatcttgtctcaaaaaaaagaaataatactagtttttgtttgtagattttgtatcctgaaactttactgaatgttttttagttcgaacagtttttttggtggagtctttaggattttctctacttatgatcgtgtcatctgtaaacagagacagttaacttcctcctttccaatttagatgccttttctttctcttgcctaattgcctaattacagcatgttcctattctgtaaatgttcaatgaactagagaatgattcttgggtagttaatattgtcaatgttgatgaactcttttccttcgctgaaagcagctactttgttggaggtttcaattctgcgtggcaatttgcagcatttctagtggtactgctccacattttacagctttatgaagaaggtgtttactttttttgaaattaccttgagacatttcaaactgtgcagaagatatatgcacaaaagcaaatgtcttgcagtttgctatagccacttatacatcatctggctcttgaatagctttaattcagctgttgaatctcacttgaatttgagcaaaaccttcatctttatatgtatctggacaaattacttcaattgcttgacagtaatgaccaatcaatttatttaaaatagtatcatttagtaggacagtgtttttctctggtttgagcaacgaattcaaccagtcctctgggttgatcatcatcatcatcatcatttggttatcagttcctgagttatttttaccagggagttttatacctttagacagctattttgaattatctcaggaatgtcatatatctctgcctctttagagtcagtcactggcactttgtctgtttggtgacatcatgtttccctgactgttcttcatctttgtagttatacattgatatatgtgcattgaatatgtaggtatttataaacagtctttgcaatctggctttgtctgtgattgtccttgtatagtaggtctgtccagaaattgtaagcatactgtcttttttggtctttaagcccgtgaacgctacagcccgtgtagtgccaaatggtgccctaagcccaggttccctgcagtccactctgtgatttgtttgttgactgctgtgagccccacccccattctttgtttctaatttacacctagcaggctaaccctgctggcacctgcagtgcttccagggggaaaggaccatagtgtgcccctgtgaagagtctcagaatggtgcggaaggtgaatgcccacctcccgctctcttttcccactgtagaaactgattccagagaaattctccaagtgcggtgctatgtgggcttgcgggagaggtgttatgatcaaacagaaccattctctttaccctctgttcatggtttttcttggctctgtggtccagtgagttgtcacagcttcactcccaatttctgggatattcagggcaataatcttgccactgggtatttgctagttgaaattatgtggtagggagagaagccagtaagtttcactnctccgtttggctgatgtcactctcgaattctgtactttcatacggattgtaatagggagggtctaaaaggaagcttcagttttggatttttagagcttcttctaagtacaattgttgaatcaagaggtaaaaatggtatgttataactggaaatacgctgagattaaaaaggagataaattagccccattgggacagtgctattgggaatgtgaattgataccactttcctggagtctagtttagtatttattttatatgtaatgcctgaaaagatgtgtgtctcctttgactcaatacttataggaatttacacaaaggttataatcaaagattatagaactgttatactggaaaaacacgaaatattctaattatgaattaattggggattggttaaataaactatggtttgatatgctctaaaaataatgttacagaaaaaagtgtactgatatggcaaaatgtatgacttatagttaaaaaagcaggttagatgttgatagatacagtatgatagaaaaagatcaggaaggtatatgctgacatttaaatctggatatttatgagtgttttttttatttcaatctttgtacatgcatgtattttctagaaattgtattactatctttgtaataaagtaaattatttttaagggactaaataataaatatttgttacttgagtgcc

SEQ ID NO: 228472 - DNA, 544 bp, Homo sapiens
ataagaatagagaaaattctgcaaagttcacattggttgaagtccagtggtaaataatgtatctactctagactgatcattctaaggaggattttgtgctgctcttgttttgctgctgggcctatcctgtttccattcccaaatcaagtattcctggaatttaaggtatcactttaccagcctgaccacaagttccccattgtttcctctgctctgctcatgacctggaataatgcctctccctggatactaaatttactgaccctgcctaggaccgagaagattgatgagtcctcaacccgtgcatgtcttcaaaaagccaccaactgatagctacaaaactgcacttcctagagacatgttgagagaggttcaaggctcaacagaacttacccttttgctgtcagagctccaccaccagataagcacaactgagcgaatgacaccaaccagtgccaagagaagcaggactacccaactacactttgcctaaattcctgattcacagaattataagcaaataaaatgattgtttaaagcaaaa

SEQ ID NO: 228473 - DNA, 464 bp, Homo sapiens
tgtctgcgtgggtcctggagagaggaggatgcagagcacagcacttagccaacctgcaatggacacgtagaaaacctcaagaaaggctctggcctagacttgccccttgttcctgtcttctggctcttgactgacactggtgctttccccctgtggtcctgcatggtgtgtggtgactacctcattgggccctaaaacttctaaaatcatcaggagatatcactgaaaaggtttcaaaacaaagccataatctctagaaatgtgtccttgatgggttggtcttcatttgcctgaagaaattgaggctaagtgagccaaggaaaaagtcatccatcaagaacaaagcaagatttctcaaccatggcaggacgttaggatcatctgtagaactttaaaatattgtttaatttttttcatttggtttcctttatagttgattttgtttaactttgccagtgaaattt

SEQ ID NO: 228474 - DNA, 446 bp, Homo sapiens
tgtctgcgtgggtcctggagagaggaggatgcagagcacagcacttagccaacctgcaatggacacgtagaaaaacttctaaaatcatcaggagatatcactgaaaaggtttcaaaacaaagccataatctctagaaatgtgtccttgatgggttggtcttcatttgcctgaaggaccgagaagattgatgagtcctcaacccgtgcatgtcttcaaaaagccaccaactgatagctacaaaactgcacttcctagagacatgttgagagaggttcaaggctcaacagaacttacccttttgctgtcagagctccaccaccagataagcacaactgagcgaatgacaccaaccagtgccaagagaagcaggactacccaactacactttgcctaaattcctgattcacagaattataagcaaataaaatgattgtttaaagcaaaa

SEQ ID NO: 228475 - DNA, 378 bp, Homo sapiens
agatttaggaagagatagtagtaggaagaagagaggatgatttacaaaaggggtggggtaaatcacagaaaattgctagagaagaatagaacaatcaaggtcatagtacctaagaatgcctgtttcctaggtgaagagtttttaacacagagctattgccccatatgtactattgacttaatacgaaattaagaaatgttttactttcagaaattgaggctaagtgagccaaggaaaaagtcatccatcaagaacaaagcaagatttctcaaccatggcaggacgttaggatcatctgtagaactttaaaatattgtttaatttttttcatttggtttcctttatagttgattttgtttaactttgccagtgaaattt

SEQ ID NO: 228476 - DNA, 353 bp, Homo sapiens
gagaagtatcagcccatcggcctggcgctttaaggtgcagctgagtaggaaaagccaacccacatcatattcccagagccttgctgcgctttctgggttgtcttgttcaaaactagtgaaagggatgggaaacctgcccaacctcactttagccacgaaaataatgctcttggccagtggccttggacaaacagcctctggtgcaacaaaacaatcaataggaagaagaacttcattcccctcaccatcctccttccccaagttcctttgaccagcatacctcattcggcttaaaggagaaagaaaactatgtgtgacattccctcccagcctacctgcagccagcctcctca

SEQ ID NO: 228477 - DNA, 441 bp, Homo sapiens
cttcagagtactggtaggggacaggagtgcaggttgagaaactacctattggctactatgcttactacctgggtgttggaatccattcttcaaacctcagcatcacacaatatacccatgtgacaaacctacatatataccacctgtatctaaaataaaagatgaaatttacataagcaaataagtaaataaataaacaaaacacttgcacacagaaattctgaaaattggatgccacaccaaggaccttcctatgcacatatttaatttcaaattgttttcctaaagaattcttttcatccaggagtgtttccagctaagaagaacttaaaccactgggcagagtcacatctgcgtatgtatagtaaaagtgattgggagagtcagattctgtggctgaattagttgtgttttaataaagtaagagtggttcatatcatc

SEQ ID NO: 228478 - DNA, 391 bp, Homo sapiens
ttggatattacacataaattccaatatctgaattgacagaagtactctctccagggtagatatgctatcagagcttagatgtaaggatgttttaaaaatttcattcagagatcaggcacagtggctcatgcctataatcccagcactttgggagaccaaggcagtggatcacctgaggtcaggaattcgagaccagcctggccaacatggcaaaaccccatctctactaaaaatacaaaaattagcagggcatggtggcatgcacctgtaatcccagctgcttgggaggctgaggcaggagaatcgctcgaacctgggaggcagaggttgccatgagcccagatctcgccactgcactccagcctgggcaacagagcaagactccatctca

SEQ ID NO: 228479 - DNA, 829 bp, Homo sapiens
aatgtaggcggaggttcatgaacgttaattcttgactttggtgcatctgcaggcttaacaccacctagaacctgaaaggcttggaacttgcaccctctgaagccatggcctgaggtgtaccttggccccttttacctatggcaggagcagctgggatgcagggccccaagttcctaggctgcacacagcagggggttctggacccacaaaaccatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctgtagggaactctagaaagaaattcttattttccctctttcccgcctatcttatgcccgtttctaatacaggtgcacaatgcctgcagtgtctttgcatagtaagagtgactttactccatttcccaacaaattcctcatctccctctgagaccacctccgcctggaccttgttgtccatatcactattaacattttggtcaaagccattcaacaagtctctaggaagttccaaactttcccacattttcctatcctcttctgagccttccaaactgttccagcctctccctgttacccatttccaaagttgcttccaca

SEQ ID NO: 228480 - DNA, 377 bp, Homo sapiens
catttactatttcaatatttctcagttttactttcatcacaatgttactgtgggtggtcccgtcccacagttcttctcacaattagaatttcctattctgccaccagcacagatgcaaataaagtcacttagtctcataattaagtctacttggcccggtgaactctcacataaatacaccagtcctagagaaaatttttgatgccactgcacaaaagtcaaatttttatgcatatcatattcctcagatttaaaattctactcagaatacattttcagtgccatttttcagtatgagagcgtttcagaaacattatttgtttgaaatgccagttctatgaattctccattaagtcaagaaagcccaaataacaggt

SEQ ID NO: 228481 - DNA, 404 bp, Homo sapiens
aatatccgattgtggttcataataataatatagtagtcatcccctagaggattcactcaagataaatagatactgcctctgctcttccttctgaagcttataaaatttacggtcaaggattggaaacagcaattccatgaatgacagggagagcacatgcagcataagaaagtgaaaagagaaaaatccccactacaaagagtctttgctcattctcttctctcacctgtggatggtaggttcatatgtcaatggggaagggaagttctcagggttgaaggccctccagtattgtaatctcataatgtccctttgagcagaaagtttgagtaggccttaccaccactccagaaggtgaggataaggtcagttatcctcaattatagattaagttatactgtgtc

SEQ ID NO: 228482 - DNA, 372 bp, Homo sapiens
caacgtgaagaccagtgatgaatgatatagtcacaagatgaatatgcctgcagcccacataagctgcaagaggcaaggaatggtttctctcctagatccttcggagggaaggagcacttgccaacatcttgatctcaacccagttatgattatttcaagcttctgtgaggaaattacttcgttgttttaagccatctaatttgtgataattaattacaacagccacagaaaactaatacaatttctcttccccttttcctcctaacacagacctggtcaccaagacctatctcaaatccatcccttcctttctccactgccactgcctctgcctctgccttggactactgaaacagcatcctgattgatctc

SEQ ID NO: 228483 - DNA, 318 bp, Homo sapiens
agcagccactggaagtcggtccccgaggacgcgaaaggagcctggcatctctgaggactccaccggggccccaccaagaccaggctccatttagcttgtccacccctcattctccaggctgggtcctgacggggtggacaagaggatccccaaagcctccaagaaccacagtctcaccgggcgcggtggctcacgcctgtcatctcagcactctggagggctgaggcagaaagaccacttgaggtcgggattttgacaccagcctggccaacatggtgaaaccccatctctactaaaaatacaaaaattaaccgggca

SEQ ID NO: 228484 - DNA, 401 bp, Homo sapiens
ccatgctgccttgattatgatagcttcataatatgtttcaaaatcaggaagtgtgaagcctccagttttgttcttctttctcaggattgttttggctctttagagtccttcaagattccaaggccaggcaccgtggctcacacctgtaatcccagcactttgggaggccgaggcagtctgatcacctgaggtcaggagttcaagaccagcctggccaacatggtgaagccctgtctctactaaaaatacaaaaattagccaggcatggtggcgggcccctgtaatcccagctactcaggaggccgaggcagaattgcttgaacccgggaggcagaagttgcagtgagccgagattgcaccactgcactctagcctgggcgacagagtgagactctatctca

SEQ ID NO: 228485 - DNA, 395 bp, Homo sapiens
actagcatctctgaagctcctttccctgtggctcccttactgccctctaagaagtaactactatccactcagttcattattcccttgtctttctagttttgccactaaacaaattcttgtttagtctgaacagcttttgacttttttttttttaacataacaggaattaatctgtatgtattctttcagttttctttatttgctcattatagtcatgaggttcatttgctgctgctatggctgtataatattccactatatgactagattacagttacttatccactctactgtccatggacatgccagctgtttccagttttactattatgaacagtgttgcaataaacatctctgtacaaataagcagaaatggctctaaggagcagtactgc

SEQ ID NO: 228486 - DNA, 294 bp, Homo sapiens
caggctggctcagtcctcgacccggggtgacggccaagccagccaagggcagcgggaaagtgacgctgggctggagaggtgtggtggcgagtgcggcccccggggagctaagagcagccgcagcaactgggtctcaggctgggcgaggcaagggctcgtaggctgggctcggaagactgaaaggggtgcccacctgactccaggacgcacggagggcgtggggcaggagctggacctgggccgcctcgggccgccccggggcttgcagtccagcccctctccgccctagggagg

SEQ ID NO: 228487 - DNA, 431 bp, Homo sapiens
gacaaagccagaacatgaacttctgttaactttaagacttttaatttcaaccccaactactctcttctaactactgcagtagtggaaatctgtactcagttgccagttgtgtaaaataagaagttcccccactgttctgaattggtaattagactgcatggaccaagagctcaatcaaagagataacacttgttgccatttgggagtaagagaagaagctgccaaaaagaggttcaggtggtttttactcccattgcagtagggcaggaagtctgaatttcagactgtaaaagtcggattcaaaaatcaccttgtgatgtcagtgaagattcctccaccccaattttttttagtatagtatctgctatatgggaaaagactataacccaaagggctgtgaatggagaataaaattatatatgtgtttcttt

SEQ ID NO: 228488 - DNA, 427 bp, Homo sapiens
aaaagtccaaggactttccatgctagaagactcccatatgccatcaaagaagctcaaattaacaatcagacaattccaaagagcaggccattctacaggtaaggggactgttctaaattaaaggagaccaacgtttcttggcttgaaatttctcaaaatcaaaagtttgtggggaaagaaaccgccaaaatttaaaatacactttgctgccaaagatgacttagcctcgaaaaaagaacaagcaacttctgagtcccagctccactaatctttcctagcagcagcaatttttttttttttttttttaagacaaagtctcactctgtagcccaggctggagtgcaatggtgtgatctcgactcactgcaacctccacctcccaggagaatggcatgaacctgggaagtggagcttgccgtgagccaag

SEQ ID NO: 228489 - DNA, 1271 bp, Homo sapiens
aggggttgggtagcatgagagatggaatattcattcagacaaatcagaaagggcacttgaaaataaattttgattctgagccaggagaaaaacttgaaatgttgacttaagtgagggggaaataaaacccagagagagagagagagcgagagagagagacatgttactatgaaagacttgtattttttattgtctctgaactttaatcctgtgaaaatgctcaaagttttggcgagagtgatataaaaaaactgactgtggctgaaagaattgcatttaaaaatatttatgtgcaccttgttactttctactctgcaatgatgtattaacaattcatggtatttatttgttattcttcaatgacccttccacatcaacagtatttatcatgtgttaaagtcatgggtcttatgtgcagatttttttaatgcctctaaaattgttttatagattacttatgctgtgtgccaagtgtttaaaggtttatttgccaacaagtatgaagagaaatattgatgtatctgagctgcttaggtttatgaaaggtcacctggatattttcagttgcatcatccctgtatttaaattgagctttaataaattgcttcagtccaaaaattacaggaaaggtgtattcttaattgatgaatgaattgatctcttttttgaaaggggactcctttacattccaaaagggaaaaacatcacagcaatagttgctatacgtaagaacatgctaagcaaatatttttccaggctgtgctgtgcatttttaaaaggtctaatttaattgcttttaatatatatgtacatatatgttattttaactgtggagaattatttaagttaaaagactggtttgatttgcctatggtgtgaaatcctttgttatttttctaaaaaaataaaatttaaaaagaaagaaaactaaggaagaacaagaagctatttacccaaagtgagctttcagttttagttttgcatggctgtttgactgcctttccgccctatgaaaatcaagaaaatcttttttaaaaatggagtcctgctattttccactccttgcagataatacaaattcagtttgtcaggttggatggtgagttgggagctgtgatggatctgttggcgggttttggatgtgtaaagaatgatatatatattaaataggtcaatcagactatgacagctatgtacgaccatttgtatgtgtatctatgtcagaaagaatctttattaaaatattttgatcaaacattttattatgctgt

SEQ ID NO: 228490 - DNA, 100 bp, Homo sapiens
atgtggaggtcagagtggaagcaggtgtgagagggtccagcagaagaaaacatggctgccaaagtgtttgtgtccattggcaagtttggcctggccttag

SEQ ID NO: 228491 - DNA, 476 bp, Homo sapiens
agaagatacggctacatactacaatatagtcaaacctcaaaaatattatgctaaatgctgaatgaaagatgatacatgcaaaaggccatgtgttctatgattctacttatataacatatatagaagtgacaaatctattgagacacgattaagttagcagttggctgtgaagtagccaatagacactgacctgaaaatcgggtgtgaacaatcttttgggggtgaaggagatattccaacattagattgtagtgatgtatacacaaattttagaatttactgaaaatttctgaactgtatacttaaaacaaatatttatgttatataaattatacctcaagtgtttagtcaaagccaggcatgatggctcacacctgtaatctcagcctctttgggaaggctgaggtgggagaattgattgagcccgagagttcgagaccaacctgtacaacataatgagaccccatttttacaaa

SEQ ID NO: 228492 - DNA, 2608 bp, Homo sapiens
  misc_feature (1229)..(1229): n is a, c, g, or t
  misc_feature (1470)..(1470): n is a, c, g, or t
  misc_feature (1613)..(1613): n is a, c, g, or t
ctaaaaatgctagattgtttaaaattttcaaagcactgaaaagctgagaatataagtcagcaatctaaggaaaagccagaacctagagcagtaaggtgagcatttaagcagcttttgcactgtaggataataccaagtcttcaagtgtactaacatccttatataaaaaagagcagagtgaatcaatccaacttcaattttagaaaattaagtatgcatattatagatttactaaaacaataaacaaagtacataaactccaaacagtgggaaaagaatagaaaaataaaaataattgctctaaaacacccaagaatatattaaaaataagtagagatgggtcaaaggaatcacaaaatgaaatgttatacttaaatacaaataaggtatatctgtaattacattaaatgaactaaaatgcttccactgaaagagtgaagtcagactacacttttttaaaaatgcaaatatatgctgcttataagtgacatacctcaaattagagaaaatgtgaaaataaaaggacagagaaaattttccttgtaaatattaaaaaagaaaaatatagttacagtaatatcaaaaaataaattttcagacaaaaagcattactagagattaaaaaaagagacaatgacaaaagaatcaattcatctggaagctcttaatttgtcttgatgtacctaatgacataaccttaaaatgtaaaaagcaaacattgacagaactacaaggagaaatagaaaatacaaaattataataggaaagtttaacatgctttttgtttttttaccaattgacagaacaagcaaacaaaaagtaggatatagacattttaaataaattgctgtacttgaccaaataatgccatgtgtgaaagtagtgagtacacacatgccctcacacagagtacctatcaatagcagaatacatattcttgtaagtgttcatgcaatatttattttaaaatgacgatctatggagccaagaggatttcaaaaggattgtaatcatagatagtgtgtccttagaccacaatgcaattatgttaggaatcaataataaaaactaatatctccctctccctctccgtctccccacggtctccctctccctctctttccacggtctccctctgatgccgagccgaagctggactgcaatgacgtgatctcggctagctacaacctccacctcccagccgcctgccttggcctcccaaagtgccnagattgcagcctctgcccggctgccaccccgtctgggaagtgaggagcgtctctgcctggccgcccatcatctgggatgtgagaagcccctctgcccagctgcccagtctgggaagtgagaagcgcctcttcccggccgccatcccgtctaggaagtgaggagcgtctctgcccggatgcccatcgtctgagatgtggggagcgcctctgccccaccgccccgtctgggatgtgaggagcncctctgcccggccgcgaccccatctgggaggtgaggagcgtctctgcccagccgccccgtctgagaagtgaggagcccctctgcccggcagccgccccgtctgagaagtgaggaccccctccgcccggcagccgccccgtccnggagggaggtggggggcagccccgcccggccagctgccccgtccgggagggaggtgggggccagcctctgcccggccgccgccccgtccgggaggtggggggcgcctctgcccggccgccctttctgggaagtgaggagcccctctgcccagccgccaccccgtctgggaggtgtacccaacagctcattgagaacgggccatgatgacgatggcagttttgtcgaatacaaaagggggaaatgtggggaaaagatagagaaatcagattgttgctgtgtctgtgtagaaagaagtagacataggagactccattttgttctgtactaagaaaaattcttctgccttgggatgctgttgatctgtgaccttacccccaacccggtgctctctgaaacatgtgctgtgtccactcggttaaatggattaagggtggtgcaagatgtgctttgttaaacagatgcttgaaggcagcatactcgttaagagtcatcaccactccctaatctcaagtacccaatgacacaaacactgcggaaggccgcagggtcctctgcctaggaaaaccagagacctttgttcacttgtttatctgctgaccttccctccactattgtcctatgaccctgccaaatccccctctgggagaaacacccaagaatgatcaataaaaacaaaaacaaaaacaaaaaaaactaatatatattttcccaaattttgaaattaagaaacattcttctaaataactcatgagtccaagaagaaataataatcaatgaagagttccttctcagtttctagcatatgatgattagaaaagagttcttaaaaaaatagtgaaaatgtcctagctttctttaaataataataatgaggggctgggcataatggctcacacctgtaatcccaacactttaagaggctgagatggaaggattccttcagcccaggagtttgaaaccagcctgggtaacatagggaaatcctatctctacc

SEQ ID NO: 228493 - DNA, 200 bp, Homo sapiens
tctggcttcctgtcgggttgggccatgagagggggagacaccgtcaggagatgagagctcagaggagaggtcatgtaaggacaaagcaactatctgcaagcctggaagagaaagctccccagaggctgagccctgctggaccttgattttggacttccagcctccggaaatgtgaacaaataaatttctgttgttgaagt

SEQ ID NO: 228494 - DNA, 372 bp, Homo sapiens
ttctggaggctagaagtcccagattagggcacagcatatttgactttggcgaagggctgtcttccagattgcagactactgacttccaaattctcacggggcatgaagagcatgagagagctctctgggatctattttataaaagcactactcccattcataagggcttcatcctcatgatctgattacttcccagtggcccggcctccaagtctccttacattggttattagcatttcaacacaaaaacttgggaaaacacaaacattcaatccattgaatatgccatcaaatggtaagttacatttgtaatttttttaagaaatttcaaaaattgagtatttttaaagacagtatgtacatagccatgct

SEQ ID NO: 228495 - DNA, 92 bp, Homo sapiens
tacaatgtagattttttttaatggaggcttttcataacagcacaaagtaagatttattgaaacacattaaataatcactgtaagacatggta

SEQ ID NO: 228496 - DNA, 371 bp, Homo sapiens
aatattttatttttatggctcctcatgttctcaactctcaaatgggagcaactctgctacctgccccggaagctgtgaggattgaaaaagttgctgtgagaaggagcgacaaagggcatggtgtgctcgtgtctacctgagagtggctcagcactcaggcaggctccatgcctgggcagggccaggcagagctgggctggcaccccagttctgtattagcagctctgaatttaagtctcttcaaaaacggatgaggacacctactaacacctacaacacagggcgatagtaaggattaaattaataccatgcatgtacagtggcccttcatgtccatggcttctgcattcatggattcatccaactgaaaa

SEQ ID NO: 228497 - DNA, 461 bp, Homo sapiens
cagctgcatcatttcacattcttagcagcagtgcacgagggttctagtttctccacattcttgtcaacacattatgtgtcattttgattggactaggttatcttttatgtaccttttaatccaggaagtatgattttgtgaaaaaaaatttgttttcgatatgtgatagaaatctgcaaaggaattaattaatatgtatgaaacagaaatgacaaatggctgttttaagtttattttcttcccactgtgttcttgggtcgttcatttttatgaagtaacaacaaactcctgttctgagcatacttgtgtattttttctgaaaacagatggtagccagaacacaactgggattccattaagaaaatcttatcagtttgtttatttgtaggcatttctctccccctctccccacaaaaatgattcttatcaagaggaggaaaggacaataaactgggaaatgg

SEQ ID NO: 228498 - DNA, 544 bp, Homo sapiens
aatcactgtcaatggtattgagaaattgttgtttgccatttagaacactttcttcatcttgccttctacctcacgggccactgcatctcaatgtcaatctctgaatgtcactcattttcctgactgtgtgtaaatgttgcagattcaactttttatcttttttttccccatcacttctcattcactaggtgacccatgtactctcaaggctttaaatcacatttattctctagaaactctacattttttttctgtagtgcagacctctccagaattggactccagaatcctaggcagagactttctcataatctccaggtggatatatgtactaggcatctaaatcttaatatgtccaaaacaaactcctgatttttaacttctaaaatctgtgattcttttcacagactccaaactttagtaaaaggctactccattcttcctgcttttcagtacaaaataattcttcactattcttttccttgtataccccacatacaatatcattagcaagtcctgaggctctactttcaaaatacccaaa

SEQ ID NO: 228499 - DNA, 413 bp, Homo sapiens
gcagcctttggctggagtattgccatgagtccatcagcaagagtccagtttcggctctcaggagtgtgttcacctgtttctttctgggctgtgtcgagtctggagacacagcaccaggccaggctcattcaggtacacgggaggccctctgagctctaatgtggagagttgtcggagcctgcagctggagtgcatatttctgaggataccatgcattaggactagtgcctgtgacctcctcttcactctgcaatctagggccttgcaggacgaactctgcagaggcctaaaggttttgaaattgagaaggaaaatcttctaccaataatttttttttatagaatgaaaacaaaacatgaatgattgctaaaatgattaaagagaggcgagaacagagccgatgaaagggaaag

SEQ ID NO: 228500 - DNA, 626 bp, Homo sapiens
cacagatcgatgaagtaatttcctaagtttatacagcttataagcgacagagccaggattcgaaccctggcaatctggctccagaacccctgcccttcattgctaccctctactggctagaacacaggtgctcacaacaccagcatgttaggaattcagttgtcggggatatgtaacatcatgtttgttcttgactagcagggatatttcctggacaattccatagagtcatgccaattcccctccatttttgagtagatagatgtggggcgagtgacttcaatcagcaaatacttatggagcatcttcagtgtagaaaacattgaggatgcagcagggaacaagaaacaaaatccctagtttcagagcacttacatttcagtgtgtgcaaaaacaggtatgtgtatgtcttacagtatagagatagcaaatggttttcaactcaaaaactgattttggttgatttgaatcgactgtatggactgttatgttttggttctattttgttttaacaagcatttagatagccaggcactgttctaagcattttaaatgttaactaattcattttcaaaacaagtccataaggtgagtaatattcctaacaccatccccattttatggat

SEQ ID NO: 228501 - DNA, 405 bp, Homo sapiens
ggaaagaagtggagggaagtcttcctccgagaagataagggaataaggctgatgggtgtgaaatttcagagaaactagttttgaggcgtttttatgatgtttaaagatgaaaaacgcagccaggcacggtggctcaggcctgtaatcccagcactttgggaggcagaggcgggtggatcacttgaggttaggagttcaagaacagcctggccaacatggtgaaaccctgtctctactaaaaatacaaaaattaactgggcatggtgccgggcgcctgtaatcccagctactccggaggctgaggcaggagaatcgcttgaacccgggaggcagatgttgcggtgagccgagatcgcgccattgcaccccagcctgggcaataagagcgaaactccgtctcaaaaa

SEQ ID NO: 228502 - DNA, 236 bp, Homo sapiens
atgttttagtttcttttttccatgaacttcctaaagtccccttatatacaatgatgaacctaagatgggttaagatgaaaatctaaatggtaaaatattaaatgtagtataaagtaaatactctgtgacagcaggataaagaggtattttaaaaaaaaactcaaaagtttaaacttatatggctaaaattgatggatgtgattacatggaaactaaatatttctgtttcattgaac

SEQ ID NO: 228503 - DNA, 412 bp, Homo sapiens
ggagacagagtctcgctctgtcgcccaggctggagtgcagtggtgcgatctcggctcactacaagctccgcctcccgggttcacgccattctcccgcctcagcctcctgagtagctgggactgcaggagcccaccaccacacccggctaattttttttttgtatttttcgtagagacggggtttcaccatgttagccaggatggtctcgatctgatggtctcgatctcctgacctcgtgatccacccgccttggcctcccaacgtgctgggattacaggcgtgagccaccgcgcccggctactattatttcttttaaggtggtagtttggtttcagggtcccccagcactgcaatggcagcctatcccttctgtcgtcttagttcatgctctgctcattgcacaggttagga

SEQ ID NO: 228504 - DNA, 1563 bp, Homo sapiens
  misc_feature (146)..(146): n is a, c, g, or t
  misc_feature (677)..(677): n is a, c, g, or t
  misc_feature (1113)..(1113): n is a, c, g, or t
gtgcttgggagacagtgagtacgtgaatctgcctgcagaagttgggagtggggggaatattattaggattattaggaagggcaaagttcagcatcatcctctctgctgaaataaccaacatggtgctcattaattggtcatgtgancactaaggataaccaccctcccctcctcaatcaggatcacaaatgctagctttcatatggatttcaagctgggtgaaatgactttttttgcttgtaaagaagaaatgatgatggaggtctcatcaggaagtgatgcagaagactgggacagacgggggtttcaccatgttggccaggatggtctcaaactcctaacctcgcgatccacccacctcggcctcccaaagtgctaggattacaggcgtgaggcactgcacccagcccatcataagtattttcatgtatcatcatgtattttagaaaatggtattattgactatatatcagttcattgtgtgcacacattttatttaattaatttgctcttttcagttatttagttttctttttttgttattataaatttcatagtaatatatgtccttatacataaatctgagtatgaatctaggattatttacttaaaatgaatttccagacacaaattgtggggttaaagtgggaggagcatttttaaagcttttgatatanaccgctaaattgtcttataggaatgtataaattatgaaacaaccagctgtccatgtgagaccatgcatttccttatccaaatgaagttaaagaaattatttgtcagcttttttggtggtatgtggtaactccttttcctgatttgaatgtttttctagtactagtgactttttacaggtttttcttatgtttgttggttgagtttttttttttaatgtctatgcctatcttagtatctatgcctattttaattttttaatgtctatgtactttcttttggagcatgttgtatgatattttataaataaaaggtgttaactctgtcattatagtgtaaatatatttcccaatatgtttttaaattttcatttatgatatatagaaattttaacttttatatattaaaaatatctatatttaaatgactttgtccagntgtagtgactcatgcctgtaatcacagaattttgagaggctatgtcaagaggattgcttgaggccaggagttcctggccagcctggacgacacagtgagacccctatctctaaaaaagttttttttcaaacaatcctgccacctcagcttcctaaagtgctgggattacaggcatgaaccattgagcccaggttctttgtaatatcttcctccacgtttttacgtatcaatcctgcattcaaacatttactcattctgaaacaaattttagtatatgttataaggtattgatccaaatttttacgtttataaatagttaacatctccaaaccatttattgatattaatttcaccttcatcatattgtaaattatagttttgattttcctttttgacaatgaattatctaagaggatactttagaattttcaaacttaataaaaaactttt

SEQ ID NO: 228505 - DNA, 473 bp, Homo sapiens
acagagtcttgctctgtcacccaggctggagtgcagtggcgcgatctcggctcactgcaacctccacctcccgggttcaagcgattctcctgcctcagtcttccgagtagctgggactacaggtgcctgccaccactcccggctaattttttttatgctttttttagtagagacggggtttcattgtgttagccaggatggtctcgatctcctgacctcgtgatccgcctgcctcggcctcccaaagtgctgggattacaggcgttagctaccgtgtctggcctacgtttttcttaaaggatcacaaatgctagctttcatatggatttcaagctgggtgaaatgactttttttgcttgtaaagaagaaatgatgatggaggtctcatcaggaagtgatgcagaagactgggacagcatatctcaaaaatcaagatgaatccttaagctttctacccagatgttgtgggaact

SEQ ID NO: 228506 - DNA, 466 bp, Homo sapiens
agattcctccaattcatgttaaaattaaaaaaccctagggaaatgtaaagagaaagcaacaccctattcctttaaaagccagggtaaatttaaaacctataattgaaggtcttctccatgatgagcttcttgaaccctgtatgtctccctataacactccaatactgcctgtaaagaagccagacaggtcataccagttagtgtaagaccttagagctattaatcagatagtccaaaccacccaccctgttgttactagtaactgtccccatcctagctttaccttcccctagaactgccttttcatctctttgtcaatgtaaacaaaacagtagccttaggagtactcactcaaaaacacgggggccaccggcagcccatagcctttttgtcaaaaattcttgaccctgtaatctgagggtggcctaaatgtattcaatctgtagcagcaacagccctattaaca

SEQ ID NO: 228507 - DNA, 499 bp, Homo sapiens
agtaaaagtctacaaaaatgctctttttttcttaatgacgaaaggacaaaaggcattgcatcttcacaattaaaggaaagcatgaacatcggcggttttccaaaattagcattcttagacaatatgaagacccgtatttttagatgattccttaatattagaaaatatatactgaaagggatcagagtatgccaccccaaaatatagcactttggcataaggattattttgagccgaaggcaactgagaaacagtaaacattgaaaagacttctaccctcctgtatttggctaaaatcaggtcataaatttcccttcgtgaaggtgccccaccttctcccttctcttgtgccaggaaagggagaatggtttgtaatcaccagagatgatctccaggggtgtccaatcttttggcttccctgggccacagtggaagaagaagaattgtcttgggccacacataaaatacactaacattaacactaacaatagctgatgag

SEQ ID NO: 228508 - DNA, 457 bp, Homo sapiens
aaaatgggttggaaggcattagggttaaaagatgagtctgggctgggtgtggtggctcacgtctgtaatctcagcactttgggaggccgaggctggtggatcacgaggtcagaagtttgagaccagcctgaccaacatggtgaaaccccatctctgctaaaaatacaaaaattcgctgggtgtggtggcatgtgcctgtaatatcagctactcaggaggctgaggcaggggaattgcttgaacctaggaggcggaggttgcagtgagccgagatcgtgccattgcactccagctctgggtgacagagcaagaatccgtctcggggagaaaaaaaaaaatgatgagtctgagaatggagtgggggagagaataggagtaggtagagtcatatggctcctctctactaaacatcccaaactgtaactgagcctccttcatcacctgccacatgaaaatg

SEQ ID NO: 228509 - DNA, 188 bp, Homo sapiens
cagattcaacaggatgaggaggaaattagcctacaacttctgatgcgagagtgtcacattaggaaggcatgtggaactggggatgctattgtggtcatctttggaaaatattatcttccatgccctccaagttgcctccagaaaccaaggttacctagagtgtgaacttgttccagatcctgcttccc

SEQ ID NO: 228510 - DNA, 500 bp, Homo sapiens
tccttctgccttggacacccaaaatgcagagattacaggtgtgagctaccacaccccaccaagggtctcttaagaagagctggccgggtgcggtggctcacgcctgtaatcctagcactttggtaggccgaggcgggcggatcacgaggtcaggagattgagaccatcctggctaacacggtgaaaacccatctctactaaaaatacaaaaaattagccgggtgtggtggcgggcgcctgtagtcccagctactcaggaggctgaggcaggagaatggcatgaacccgggaggcggaggttgcagtgagcagagatcgcaccactgcactccagcctgggcaacagagtgggactccgtctcaaaaaaaaaaaaaaaaaaaagagctatactgtgttgaaagagtcctgtataaaggaggatgtcttaaatttgccattttgactctgttttgaacaggtcaccaggaaaatgagacttggtagcctggcgaggtggctc

SEQ ID NO: 228511 - DNA, 342 bp, Homo sapiens
caggagatggcaatggaagcgacagctccccatcttccccggctgcatacgtgagggattctgctgcattcactgagtcaccaaaggacactggaaggccatcaggatttttgggtgaccaagacatggctcccctcttactgcctgtggggagacaggcatgtgaacacccaagtctaacccaagctgagttgactgagggccatttaaagattccacagaggctgagagcagtggctcatgcctgtaatcccagcactttgggaggccaaggcaggtggatcacttgaggtcaggagctcgagaccagcctggccaacatggtgaaaccccgtctctact

SEQ ID NO: 228512 - DNA, 458 bp, Homo sapiens
ggggcccccgctcccctcccgcagtgcgtctggggggccgaggccaaggattagaggggtgaccctcccggggcgcggggagagggagtgccgggcacggtgccctcaaggtcaccacgcgccgtggcgggggcgaccggtggcgggatgggctgtggcgcggccgaggcggcttcgtgaagccgaagacctgcgggtgtagaccagaagccccaacaagccccatccctcgggcccggagcagcgactcccagactgacccggcgctgaggtgcacggcgagaagcccgctcaccttcacaatctcccggcaagaggcaacctgcgaggggccccgaccgcccccgtcagcttctcccgaatccggcgcaacccgctgcgcacccagctatcaggatccccgccgcgacgcccgacctccgtgctccgcctggcctcccccgcaggtgacctgcccc

SEQ ID NO: 228513 - DNA, 601 bp, Homo sapiens
gtggtaaaatatacgtaacataacataaaattaaccattttaattatacaattaagtggcattaagtatattcagggtattatgcagttattaccaccatccatctccagaactttttcatcttctcctactgtgcctattaccaactccccattcccctttcccctggcccctggtgacctctaaatttctttctctgtgaatttgactactccagatacctcataaaagtgaaatcgtacagtgtttacccttttgcgactggcttatctcaattagtgtaatgtcctcaagattcatccacgctgcagcgtgtcagaatttccttccttctaaagtctgaataatattccattgtgtatgtaccccattttgctcacccttcatctgttgatggagattgggttgtttccaccttgtcctatttgacttttatcttcccactccccttggaagcaggtggagtcagattttcttgatgtcctgacctcctccattctgcttttctttcttgctcagttttgcctgactttccctgggtctctccggagcaccacttacccaaagtctccagctccggtgctggggcacatattgccag

SEQ ID NO: 228514 - DNA, 477 bp, Homo sapiens
acccaacacatacacacactctcaaaactgaaaaagaaatttcatgaaacagtacttaggtcttactacatagaatgcattctaatactttctattttatttcttaatgctttttatgaactactaaaatcagcatgcaatttgagagacactacaaggttacatgaatttataaacttagttagagtgagaatataccatacaaactttcatttttctatttaaaaaatattttttgtagagacggggtctcactatattgcccaggctggcctcaaactcctgggctcaagcgatcctcctgcctcagcatcccagaatgctgggattacaggcttgagccaccttgcccagctccaaactgttttataagtgagaaaactaaagctcagtgtagagatgagatgggagggactctggccataaattctggatttaaaccttggttgtgtgttgttgggcagggtgtttaatgcc

SEQ ID NO: 228515 - DNA, 402 bp, Homo sapiens
tctgtcgcttgtacttttttgtgagctccttgagagcaaagcacatcatgtttacttcttcgttttttgtttgtttgtttgttttggtagtccctggcacatggtggtacagtgggtatgcagtaagttctggagcagggacttaccttcctaccttcctttgccttccccacgctcttacctgctgagtgtagtcagcccgtcctgttttcccttccggcactctggccaccctcttctaatatcccacactgcccctgcagctcacagagacctgcacatactgttcctctcactggagttctcccctttctacatttggccaactcctactcacctttgagtttgatttaaatattatttatttaagataagtctttcatgatcccaactcaaatttaa

SEQ ID NO: 228516 - DNA, 410 bp, Homo sapiens
tccattttgtcacatagctttatgtactcagacattccaaaacccagttatataattcacctaaggtgttgcccatttgggacagttactgcccctctccccaatatactcagttgtttagccagtgattccgacatttaaaaaaaatttaaataatatttatgtgcagagtgctgggaatagaataatgaaagctattacccctgacctcaaggaagccactatcaagttggccttgttattgactgctgcataataaaccaccacaaaatttaaggtctcactacaagagaaaccagggtgacagtcttaattagttcaagctattaaataccagagactgagaggcttatacaacagacatttatttctcacagttctgaggctgagaagttcatggtgtcagcaga

SEQ ID NO: 228517 - DNA, 529 bp, Homo sapiens
gggtgaacagcctttctcagtcactcagtgccaatccattgaccgcctctacccttgtccacctcgacctctcagggaacgtccttcgtggagatgacctctcacacatgtataattttttggcccagccaaatgccattgttcatctggatttatccaatacagaatgttccctggacatggtctgtggagctcttctccgtggatgccttcaatatttagctgtgctcaacctctccagaactgtcttctctcaccggaaaggaaaagaagtacctccatctttcaagcaattttttagtagttctctggctttgatgcacatcaacctttcaggcacaaaactgtctcctgagcccttaaagtgagtggttaattcactttctccagagcttttaaagttcaacttatttttacgaatgtgcttgagggaagggagaaagatatataatccaaagacaaaaaccacagatgagaatgcctttttactctggggcagaaaaataaattaaaattttaaaaagtacat

SEQ ID NO: 228518 - DNA, 497 bp, Homo sapiens
aatacagaatatgaggtcccattccagccaatggaaactggacacagcagtagggtggatgcatcaggttataaatgaccctgtctcctttgtttggtgtactctcatggcagaactaatggcgagtgtaccctttctgcagaaagcataaaaatggccttgctgagaaaattaaatttacgttcaagtgctatttctttatggcaccaggaaacaagcatttcaaacattcccctgcctttctgattgtgggtcttaagaccctcccttgagaaggtcctgcctcatacgctgggggaaggaatgcttcaataagaacccaagaggattggctttggtgagctttcagatagctgaacacatgggggttcctggaggatggtatgcatggggagggcatggtagctctgtgctccttcccccataccatctcttcatctgtgtcctttgtaatgccctttataataaagtataatagtaaatgtaaaaaaaagctt

SEQ ID NO: 228519 - DNA, 434 bp, Homo sapiens
ccacaatagtgatgttaattaccattaacatagtaattaacataggaggagctggggaagttggagatcttgggacctctggaataatggctggtaattgtttaactgcacctacattttagtagaattcaggcccctctgattttcctaacctggtagcctttcattagttttacaagggtggtttcatttttgggaagagctattgtctcccaaagttagtctgacttatgcccaggaatgcttcaataagaacccaagaggattggctttggtgagctttcagatagctgaacacatgggggttcctggaggatggtatgcatggggagggcatggtagctctgtgctccttcccccataccatctcttcatctgtgtcctttgtaatgccctttataataaagtataatagtaaatgtaaaaaaaagctt

SEQ ID NO: 228520 - DNA, 505 bp, Homo sapiens
acacacacacacacagacaccctattagttctgcttttctagagaaccctaatacaaacatattgttcactgccaccacgcctggctgaccctcttcttaacaggactctttcagtagtctaagaaatgatcaaacatgaaagccataaaaatatatattataatttttaattttgtttatatcatgagatgtaaaaagagcactggaaaatagaatcaggccaggagcagtggctcatgcctataatcccagcactgcagaggcaggaggatcttgaggccaggagttagagaccagcctagtcagcacagcaagacccctctctcactgtaaacataaaaaattaactgggcatagtggtgtatgcctgtagtcctagcttcttgggaggctgaggcaggaaaatcattggagcccaggagttctaggttacattgtactatgactgcagcactgcactctagcctgggtgacagagtgagtgctgtctttaaaaaaaacaaa

SEQ ID NO: 228521 - DNA, 412 bp, Homo sapiens
ctgaggctggaagtccagaagtcggggtgctggcaggacgtgctcttctgaagcctccagggcagggccagccgcatgcccgtctcctcgcttgggcacctgccagcggtccccggcggtccccggctcattgctgcatggctccaacgtccgcctctcccaccatgtggcctcctcctggtgtctctgtgtccaaatctcccgctctgtctaaggataacagtcactggtcatgggacccatcctaatccagggtgacctcgtattaacctcatcacatctgcaaagactatttccaagtcaagccacactcccagctgctgggggcgggacttgaacatattttttgtggggacacaattcccctctcaggttttaagatttgtctttatcattaaagttttcaaaacta

SEQ ID NO: 228522 - DNA, 418 bp, Homo sapiens
gcaggctgcacaggtatctgcttggcttctggtgaggctgcagggagggagcaagagacgggaggaggcaccaggctctttaatgcaggagtccctgacctcaagacgggtccatggcctgttagaagtgggtcacacagcaggaggtgggtggcaggcgagtgagcgttaccgcctaagctccgcctcctgtcagatcagcggtggcattagattctcactggaccacgaaccccaccgtgaactgcatgcgagggatctaggttgcacgctccttatgagaatcaaatgcctgatgatctgaggtgggacagtttcatactcaaaccatccacaccactccctgtccacggaaaaaactggtcccaggtgccaagaaggttggggaccactgctttaaacaacaagctctccaaac

SEQ ID NO: 228523 - DNA, 449 bp, Homo sapiens
ggctggagtgggagcggttagaggtggagaagaggccagtgttgggggttggggggaggctcggattttgacctaacttctgtttatactgtggccacctgcccgtcacccccacctccaaccttctgaaggagcagagttcactccccgccaccctcattacagaatcttcctgtgatctcagaggatgatggaaattctctcctctgaatccttgggggcttagagcctcacaggtccagagaaaccccccacccccactgcagtctgccttcgttggcaagcggtgccacgtgcctggtgggcatgtggaccaggcccagaaggaacagcaggaatgggagtgggctgtgctgtgggggtggcagaggagcgttttactttcttctgtcaaaaatgtctatatatattttgttgaaaattaactttgcaattaaaaacttaaaaac

SEQ ID NO: 228524 - DNA, 210 bp, Homo sapiens
aaaccctgaggctcctctgcaatgacagttgtccagtgggctgctgctttttttcccctttaatgcataagtttgtgcttaaatattaaacactcctaggaggttaaggaaaggagtattagaagaaaaaaaatccttattcctttcatccttgacacgggccaagagtacatctttatacttcagaagcatgggaaattaccccaaatt

SEQ ID NO: 228525 - DNA, 722 bp, Homo sapiens
cgatggttctgggctcgtgtgggtcctgcgctgtgcggaaggagcggagagcccaattcaagtgttgaaaggggagaagagaggagggagtgggggaggaagggccatatcattcccgttaatggcggcgaccctcagacgtctgcatggttaggattggggatccagcatcctcatgggaagctcagtagagaagttgactcgctttgggccccttctctcggaaaggctctgcgattgatccctcctgcacacttgtgcacctagggcagggtaccattgcccttgcctgcaacaggaccaagagagaactcaacttggaatgaaaagctacctcttttagagtttattcaacatatatttatgaagggcctactaaatgccagtcactgttgctagttgttgccatggggataatgaaacagaactagagaagcttggtgaaaggaagaaacatcaggcctcctgactccaagcttagtactttttcttcccacaaatcttggaatatacaggaatcgaggtactgtgagtgtaaaccctgaggattctttgggtctttcctaaaatgtttaaagtgaaaaataatctgccaggctcggtggctcacgcctgtaatcccagcactttgggaggccgaggtgggcgaatcacgaggttaggagttcgagaccagcctaacatggtgaaaccccgcctctattaaaaatacaaaaattagc

SEQ ID NO: 228526 - DNA, 541 bp, Homo sapiens
cgatggttctgggctcgtgtgggtcctgcgctgtgcggaaggagcggagagcccaattcaagtgttgaaaggggagaagagaggagggagtgggggaggaagggccatatcattcccgttaatggcggcgaccctcagacgtctgcatggttaggattggggatccagcatcctcatgggaagctcagtagagaagttgactcgctttgggccccttctctcggaaaggctctgcgattgatccctcctgcacacttgtgcacctagggcagggtaccattgcccttgcctgcaacaggaccaagagagaactcaacttggaatgaaaagctacctcttttagagtttattcaacatatatttatgaagggcctactaaatgccagtcactgttgctagttgttgccatggggataatgaaacagaactagagaagcttggtgaaaggaagaaacatcaggcctcctgactccaagcttagtactttttcttcccacaaatcttggaatatacaggaataaaaagggtgcaaaaagaaaga

SEQ ID NO: 228527 - DNA, 238 bp, Homo sapiens
tatatatgtaaaattaaaatttatgacaataagaacacaaagaagagtgtgaatatagctaaattgttccaaggccttgcttgtctgataagtaaaaatattaatttacattagaatataataaaccaaagatgtgcattataatctctagagtaatggctgaagtaataaaaaagaagtaaaagcaaatgtggtaaaaatgtaacaaaaatatttaaataatccaaaagaaggtaaa

SEQ ID NO: 228528 - DNA, 195 bp, Homo sapiens
tcaaaaggcccagaaggaataggccacacagctacacaaggagctataacagaattctctctcagactcgtcttattctctgtgttaagttagagaacccattcattctgcccctgccccatcattgcctccccaggcccctgcttagcccacatgccccaaaacccggagcccaagccaagcccggagcagaag

SEQ ID NO: 228529 - DNA, 566 bp, Homo sapiens
gatagcaagcagcaaattggagggtaatggtaggtgcagggttaagaattcagttgtttagcagataatcacacaaattattgagaataacactgaagatggcaataaaggaaaggtatagggccccctgagaacatataacgggggtacctggccaggcccgatgagtgatgaaatctaagcttttgatcattatagtttacaagatggaagacaggcatgttttacatttatgaagggcccaaagaccctcattttttagttttaaaagtgtctacgttttccaaaaataggtgaatgaagtacaatgagagcagctatcagcttctttgggcagagaaatgtatgattaacctttttttttttgagaaaggtatttgtggagagaagtcacaaagggtgaggattccatttcagatttcaatcctagattgaagaggaatggggcttagggggagacagagaaagtactgtttatcttcttgccagagggaagaaccagacatgtgggaactaaatgcaatctagcttgagcagagtgtgaagagacttggggaatgaaaaaa

SEQ ID NO: 228530 - DNA, 468 bp, Homo sapiens
cagtggtaggtttgacatctcttgagcatctgctgtgtacaaggcacagtgctaggcacctaacttttcacctgtgatcctcacagtcatctcattaggtagagtaagtattaagttcattttacagatgaagaaaccaagactcagctggggtttgacgtgcccagatttcagccagggcatcttcctttaagtctagctctttccagtattctgcactgtattttagatgtatcagctcttacacgtgtgtgttaaatgagatactgtttgtggatatgccttgctgagtacacatatacacacatcttccccccgccccccacttctccccttcctattagaattgacctttgctgcaaaggaaacagatccttacattggtgaccagagattcttctagcttagcactagcaggcactttctgcacttagtgtgcttgtttcccatgagggttctggggccagt

SEQ ID NO: 228531 - DNA, 534 bp, Homo sapiens
gctctggaaggacagttatttcctcttcaattctgatgaaagctattcccccccacccccggttgtttctgccaagaaaagatttcctaccatggtggctggaagcagtaattagactcctccctcaggatgctgccctcttactcagctgccctctcttactcagcagcgaagtcaagtcccaaattaactgacaggaggagccagtggtctcttctggggtttgtcacaatgaaccaaccttagatccccattgtaaggatctcactcattagaaaatgtttgaactggtttctaacagctgataatgatttatagagtatgttctgatgactttaaaatatggctggatctaatgttgtatttttcaatacagatgaagtttaagcagttggtcattttaaaaagaccagatttgaggagttggatgtgcaaattaattgaattatacaatgtgtgcaatattattttgaatggaaagttggatgttataaaactgaaaataaagaaaaaatacaatctttttgtagcgga

SEQ ID NO: 228532 - DNA, 355 bp, Homo sapiens
aactgaccactgtcttcagtcaccataaaccccatttaaacaatagatcaaagacttcagcagaactgacagcaaccacagcaaagacgctgcattctcctttgactgattcggccagaaggaaaaggagaacctgcatcctctctctctgattgttcactttaacacagcggcacattcagaactcagtattagagtccagggtcacccctgtggtctgcagccaaaggaaaacacaaaggagcatggcttccttgcaagtgtcaggcccaagtgtcttaaagaacgaggagacacaacagactggaaaggagacccaggacgataaattctcaataaaatatattcttttaaa

SEQ ID NO: 228533 - DNA, 495 bp, Homo sapiens
ctccctaagcaacccagctaaggctaaaagaacaaatttcagctgccacccaagagacagagttggcagctggagtccaactgcttgtttgctaaagcaaacaaacaaaatcaacagtcatcagaagaatataacagaatccagagtctccacaccatcacagtcacaatgtccaggatacaattcaaaattaccacaaaaatgtcataaaaaatgttacccattttaaagaaaaatggcaatcaatgaagaccaatcccaagttacacagggtgctagaattaacaaacaagaatttccagataactattataactaaattcaatatctgtccaacctacctcacagagttgttaaaggtaaaatatgcaagcaaaaagtgctttggaaagtttcacatacactacctctaaaaaataaaaatagaagtggtctccactttttatatctgttcccaaaaaccacagaataaagcaaaccattttaatatgcatc

SEQ ID NO: 228534 - DNA, 90 bp, Homo sapiens
gatcttcgtggtttaaatacctttcaatttgggacgatttaaccattgcagcagttcaaaaaacaaaccctgagcattatctgtaaaacc

SEQ ID NO: 228535 - DNA, 164 bp, Homo sapiens
ccattctcactccatgggcaacaactatttctcattctcgacagaatcaccccactattatctctcccatcaaaacaaaacaaaatgaaaaatcctttcttaacctcaactcctattcctgctactatccaatttctctttttcctttagggcaaaatttctca

SEQ ID NO: 228536 - DNA, 471 bp, Homo sapiens
cttctgttgttgaaacagaggattttggcagcctggttcattttctcttgtatatcaggttctttgggttcactattttctttttaataagatcatgatatttcagtgtttacctatagctcacccaccatttaggttttatttccagtgctctcatgcttccctaaatcctgtacgaaagatgctatgtcaggaggcgcggtgactcaggcctgttgtcctggcacataagaaggcgaggtcaggtgtttgagactagactgagcaacataggaagctctcatctattaaaaaaacaacaaaaaaaccaaaaacaaaaaaacatgctatgtccttggctattcgagccacagctttgtgcattgacacacatccagcatcagcaagctttttctaaatgagaacaagcgtcattcctttgtccatttgtcagacttgtcacatatgtctctatgggattatagtttttta

SEQ ID NO: 228537 - DNA, 561 bp, Homo sapiens
gaaatgccattaccatgcttatattctagaacagaagttctctgccatgactgtacatgagaatcactgctctagaatatggcacaatacacattcatgcgcattattccttgtccagcaaatgcaagagtttctctagaggaggggcttatctcaatcctaggctcctgttagaatctcttcaggggttctttcacaaaagtaatacctaaacatccccctccaaatctgattaagttggcctggatggagtctgactgaggaagcctggatgcccattaagttcttccagggaactattgaaaatcttgacacccacgttgcaatccaatatctctggatttgagccccaagctttgtgtaaacaaattacaaccttgtgtgtaatagcaaaaatctggaagccacttagatgttcattgagaggagaatgcataaatacattgtagaatatacctataataaaatatatcctgctcttaaaatgaaacaaattttgccctcatctatcagcatgactgaaacttaaacatgacattttgtgcaaaaaaaggcaagcta

SEQ ID NO: 228538 - DNA, 491 bp, Homo sapiens
ctcaagataaaggtcagttccttcaaggagcttccagtctaggattggaggggacctaacatgagattgccatcaagtgtgagaaaagaaaagcagggtccttggaaacctcccctggcacagctgtgccacacagaaggtgttcagggggcacattcttcatggaaaatacaatattaatatgagattggaattttgtgtggagcgatattaacgtggtgaagaggattgagaagggtagtttggagaagatggagaaacaggtacgaacattaaaaggcttaaagcagcacactctggagaattacaagtcagttggcatgacttgaatgtgagtgttgaggaagagaggagtaatgaccagagatgagatgaagaagctcacgcaggacactatgccaaccaggaagtgggcatttatattgtaaagaaataggtcagatttaaagcagacactgacatgactagaattaggttttaggaaaaaaaaa

SEQ ID NO: 228539 - DNA, 497 bp, Homo sapiens
gaagctcgattacaatactgtatattgggaagtaaggggagggtaaggcagtgaaggagagacagcataggcaataagtgtggctgggaaagaatggccagatagggcagtagtggatgaggtcaaagagaagggaatttcaacatgggagaactgagcatgtttaaatacttaggcagaaaccagtaagatgggtgggtctaaagacataggtagaaaaatggctctctaaagataggattcagggctcaggtttggggctaactcttctctagaaatagaagggaagagagtgaagaagagtattttgcttgggcagtttgtgtgggttttgtggaagctgagggaatttcctgctgagggccgaaaccatcaaaatgactgatgacctaagtcagaggctaaagggaattcccttctcactccagtcaggccagtagaagcaaccagacaggttaatggcaacaagattgctaccaaaatcaacagatacattt

SEQ ID NO: 228540 - DNA, 400 bp, Homo sapiens
ttgttatttaaatgatgttttaggtattctcacttcttcgcctactttaccataagtccctcatctttgcccccaaaacactaatagcacttagagcaattacagcccttaaaacagtggcagactgcagtacatgcccattgaatgaatgcaggctgcggtatatatgctggtagaatgaagtgatgtctatctgctactagacttcatgtcctggaagaaaggcacattctgttattagcaaggtgtttgacacacattaataatgaatacgtgttaggcttgatgcagaatatatataaacacttgattcaactcaatgacagttttaaaatgcagatattaatatctaattagcatatataaatctttaaattttaaaattcagctaggaactgaa

SEQ ID NO: 228541 - DNA, 345 bp, Homo sapiens
caatatattagttacaaaaaccagttacagaaaaatgtgagtagaaaaattcttttttaaaaaacaaagctatacacagactttttatggtatgtgtatgtgtaaatacgtctaaatgtgcataggaaagatccagaaggattcatactgaacaactgccagtggttactcgtgaggaatgggagaggagcaatggaatgggagaatagagggaaagaaagggaagcttgattttatattttatgtattttgatattatttgaattgttattgcctttatattactgctgtagttttattttttaattatttttgtaattgtaaaaataaataaataaataatga

SEQ ID NO: 228542 - DNA, 835 bp, Homo sapiens
gaaaaactttaaattattagtggacaccattatggagaagcctatataacattctgatattacaaaattaatgcaaagaaattgttcacaataaaattactttaaatttgctttaattttttttcacgctaccttggccaatattttattatagtcaatttaattcattcattcattctataaatatttctgtactaattttaggtaatgttctgctcaatcatcatttaatttgctgtgctattggtttctgttaatatattcctcaatcttggagaacattttaaataattgcctattcagcatttctatggacattgttcagcccagttccattttgttaatgcacaaagcaattcaatttctgtaagtgcaggctaggagcagccaaagctgtccttgtagtaccttcagaggcagttaataagggctggctgacatttatgacttatcttttctgtgtgtttaaccattactatttttccgccagtaaattttcaagctaatgcggcaaaaccaatattgattctgacatttatgctttatattttgaaatttattttgaccattacttattattttattgctgttactttgaaaatattatacattttcattgtataaaatgtcattagaccgtgcaaaaagtttatttcttgtaaataattactttaggagtttgagtgcatctacggttccttctgttattctttctaatcaagagtctgattacataaaacaatcaaaacgtgacttaaagatgttcaaaataattttgatgaacatgttcaaaatttaaaaagtcatctgcattaaaaaattttattaataaagc

SEQ ID NO: 228543 - DNA, 783 bp, Homo sapiens
aaatggttttattgtattatagtaaatgaaatgatatagtaattataggatgcaataggaaaatagcttcgggcagaagtaaagaactcttcctggaattgtctcctgtgctaaattttagtagatgagaagttaggaaagtgtactgtatggcaagcactttccagacaacagaaatagaagaagtaaaaacactgtgaagcaccaaacattatagagagagtgtatttggtaagtatcaagaagctcatgaatagtactagtagtagctttaaattctgattagcatttactatttatcagctaacttttctaagtgctttattattttaaccttcatagagatcccataaagtagataccataattacctaaattcattagttcagggaactgaggcacaaagaggttaagcaacttgccaacaatgtatagcaaatccaaggtttaaaactctggaagtctgaaatcaaagattctgttacaccatacaagctctcaggatgaccagaatataaagaataaagcaaagagtggtgaatgataaggaatgtcagcaggagtttttgttagagctggaaccttaaccagtggtggaggggctcccttgatggggttaaacagaagagtgtcatggtcaagtcacatgtcactgtggttgtcattgtggttgtggttatgtggagggagtgggaagtgataaaaagagaaacacgctaaaaggtaattcagagacaggggcacttatccaagtaaaatatgacaaaaatatagcagagttag

SEQ ID NO: 228544 - DNA, 580 bp, Homo sapiens
tgtgccttcactgtctcttgattcttaatttttctgcggatgatatcgatggttttagatgtctgcacttggctcttacattgtcttaaagcacactttagctattcattcaacatttactgggtatcagttttgtggtgctaggaagaacttactccctccttcaggaaattcccctggcctcagctggcattactgctaaagattataaaatcaatctcttcctcacttgcgtttatttcttcagaagtccagactcatgtacttaacttcctattgatagttggttctggttgtctcatgagtgcctcaagtgactacttagtactgaacttatctccactcctatataaaagcaaaaaaccttccacctattactcttcacatgatcatacatctactgcttcttaattataatatcccccccttatccttaggggatatgttccaggatcctcagtggatccctgaaactcagatagtactgaaccctgtgtatactctgttttaccagtccgacaactgagagggctactaagtgactaacaggtgggtagtatataaagattgaatatgggac

SEQ ID NO: 228545 - DNA, 338 bp, Homo sapiens
actaaggagaattcgtagtttaatctgtttaacaccttctgatttatcagttcttaaagcatcgtgtatatttcttacatgtacatttctaaaaagtaaatacagtctctgtgcatagtcaagctttgtgtatagagtgtcttgagttgttgtccagctacgtatttatataatatttgactgtggaatcacatcagaatatatcacatgctaatattgatattcttgagtagacactaaaatgctttaaagcttcatttttcatctgagaatgaacaaagtaccctgaattctgtttgatgccatgtcaccaaataggtgttattctgatccccata

SEQ ID NO: 228546 - DNA, 343 bp, Homo sapiens
atgagaataccggtttttttaggtggggcatgatggctctgcaatcccagcactttgggaggctgagaggggtggatcacttgaagccaggagtttgagagcagcctggccaacgtagcgaaaccttatctctactaaaaatataaaaatgagccaggtgtggtggcatatgcctgtgatccccatgacttgggaggctgaggcacaagaattgcttgaacccaggaggcggaggttgcaatgagccgagagcgcgccattgcactccagtctgggtgacaggagtgagaccctcaaaaagaaacccgtttttgtgatgtgttgtcattcttcctgagaattc

SEQ ID NO: 228547 - DNA, 528 bp, Homo sapiens
gtctgtggtttcaatccccgtttattctgacttgattataacgtgatctgaaatatttccataatgctgtgataccattttgtagtaatttcattccacgtagaaggatgagcacttaaactctgggactttgttatgatttacataattgtattataaaatgtggctctgtcatgtacctaggccagcaaatttcccaaagagcttgatttataatactattttacctaataacatagcttcattgcacagaatcaagataggagttagactaagatacaatagaacctctacagaattttttcaacttctccttcaatggaaatttctctttaatgacaatatacgtttttgttaatgatttttttaaaactagaattaattttaaatgagccccagattttttctgctatatacatatatccattttcttgatatcgattatggtaatatgcccccattattctttacatagccattttgatgcagcattacctcttttgaacctgccccaggagttattgaatt

SEQ ID NO: 228548 - DNA, 389 bp, Homo sapiens
actccaagttgagacctttcctgtgtgccacaatgccggaacaaactccctccccgagtacgagattccagaagcagaaccgtggacaatttttaaactcagaaagcctcctgtggagttgggactcacagctcacagccacgaaatcactgtccattaactgtttggtttcctgagagcagagattagggatcctcagtcttgcctgtatatcaataccacctgggaccactcagaccaggtgaatcaatgtccctgcaggttgggcccaggtaatggtttattacgtgttctatgtaagtttagggtataaccaagtggttagaattactaactaaatcaaacctctttactgaccaattacattagaatgtaaattctctccaata

SEQ ID NO: 228549 - DNA, 510 bp, Homo sapiens
gccttctcttatccagacttggagcattaaccttcactctcaagatataatcactccccctaccccatttagaggagctctttccactgattctggaaatgttggaatttggaaggcactcagttaatagaatggtagttgaggtgagctatcaacttgggttcaaatcacagcttggccacttaggtagccatgtgaccttaggcaaattacttaaatctctttcgagctcacagttttctcatctgttaaaagaggatgataggctagtgcggcacccgtaatcccagctactcgggaggctgaggcaggggaatagcttgaacccgggaggtggaggttgcagtgagccgagatcacgccactgcactccagcctgggcaacaagagcgaaactcagtctcaaaaaaaaaaaaaagatgatagtggcaataatacaaatttcatgtgaggataaagtatcataaggcatgaaaagtacttggcattgaggctgaaacctactcaata

SEQ ID NO: 228550 - DNA, 445 bp, Homo sapiens
ctgaacattgcaagttatttcacatcctggccacttaacccactaaatgccagcgaccctccccattccaatatgcaccctccccatttccaaacaccctcaggacaccctctctccctttgagaactgttggaattcaattggttagagatcctaatgccaacttttgctgaggacgatcatctggatgaactatgcctctcactaagggaagaggcaagctattgagagagggacacccaatggcaaagttcccatctggaagaatggattgttactggtagctaaaatgtattgggtgcttaccatgtaccaggcagtgttataagctgactctatgagttacttcggttgttgtattcattttacaggtgaggaaaaacgtttaagaaggttataatttgcccaaagtcctaattaataagagagaaaactgatatttaca

SEQ ID NO: 228551 - DNA, 247 bp, Homo sapiens
ttataaatggtgaaaattgtgattcatggcatcttgtgatcttgtgcttttgtcttagctcacacaacaggctggaagcagaactaggactcaaatacacgccctttcattctagatccatagttcttctcattttctcatgtctttttactgtcctgaatagcatatgtagttatcaacctaattaagtcaaagttagatgttacaaatgtagattgtcttttgattaaagctcatgtgacgtgca

SEQ ID NO: 228552 - DNA, 458 bp, Homo sapiens
acagcgaggtccccgtggggcctgaggacagctggactctgctcctggctgcagagtgatgggagctgcgggactccaggagactgtctgcactcttaaaagagccaaattactgcctaagctcatgtcacacctacccggacatcagtctcccagcctcagttgagagcaagattcctgcaagaggagggctggctggccctgtggaaggtgtgcatgagggcatgcatgtataaatgacacagccccatgaaagaaaagctttcccaggcagaaagacactgcactgaggcccatacagcactctgcaagtatagtgctccacctctcttcactcacccggtggaggtgggtccacctttctaacatctagacacacctcctaatagtctctaagttagaaacgtgcttgggaaacaagcatttttttaaaaatcaataaagaaattcacatatta

SEQ ID NO: 228553 - DNA, 390 bp, Homo sapiens
ctttcatggtcactatgtggaattatccttgcctacaagttcatcctactgtcattgattcttctttggatcactctaaataattcccgttctccttagagaattctcaactaggtttttcaagtcatgcaacaacatgccaagggaaatctttgcctgactaatagacttggagtaatgatggttataacctgttgagatttttaaaaagctattgaagagtctagccaacctattggctaaaaactgggtcgtgtggctctgaatggggagagggaactgacagctgccctactctggctatagaatgtccgccattaaggacagatcttatttaacattttacaattgaaaactgtccctggttttcagataatgcttaaaacaaac

SEQ ID NO: 228554 - DNA, 274 bp, Homo sapiens
ataggggatgattttataggtctggatgctttatagcagtggctctcacctgggggtgactttgttccccagaggccatttgacaatgtctggagacatttttggttgtcacaagtgggaggtgggaggtgctcctagcatctagtggggagagaccagggatgctgttagactgcccacagtccacgggacagcctcatcacaagggtttgtccaacccaatgtgtctgtcgtgcccaggttgagaaacctgctttaacagtagtggtagttt

SEQ ID NO: 228555 - DNA, 547 bp, Homo sapiens
ctgtatcttaaagatacattttagctctctgttggattttccaccatgctcacctgccagattctctcactgcttgtaattctgatctttgttatctccaaccttacttgactgcggttgatttgttccaacacctatcttttagtctacgtcacattgctgtctaaacttctttgcgttcttccctttttgctacttaagataaaatctcaacattttttattgcataccggagtcctgttaccttttccatcttcctctgccataaatgcctgtaaaccagtcactttacactttatttaaaaaatacatatatatcaatggagacaaaagaagtaattagtgtgtggcattagagaatgtatcagaagagagaacgtttttaaaagacttaagtgaacagaagaatttatttgaataaagagaaaaatcactgaatttgatagattttgaccatacagaagaaaattttagtagaataatggagatggaatcaatgacctaaaatttgactttgaatgggaataggtaggcagctcaaaggatg

SEQ ID NO: 228556 - DNA, 572 bp, Homo sapiens
gactgcagtgctctctctggagttgagccattagacttctcatcacagagcttcctagctcatctgactttatgcagcctcttgcttgcccctccacccgaagctcattttagtgtaaaggacagagcagcctgctcaatgggaaagcaagcttcaggacttgaaagagggaagggaggtgtctgtaatccaaggagggtctgatcattggatgtcaagttttgtcacacatgcatttctgagaagagagactagttgtgtttatcagattcttaaaaggatgtaaggcctgaaatttaaggagcattgacatagggaaagagaaagtatatccagtaaagcatcagtcacttcccaatgtcctgcatatggtggagcccctgcccggccttaccataccatttcgttctcaaagtactgcagaacagcagctacaaagttgtctcaaagccgatcttgatagattactgtatacatgaatgtgaatttaaataactaactacagtcagtcctctgtacccacgggttctgcatctgcagattcaaccaaccaaggatcaaaagtatccagg

SEQ ID NO: 228557 - DNA, 420 bp, Homo sapiens
ctactatgcatcagatattcttctggctcctgaggatatactggggttttgagacaaacaagatccacagttggggctaatgggagcttccacgtctgtggcacctgaattaggcaatccgttttcttttaattacatctaaatgtattacaaactaaaaaatgtaacaaaaaggaatgaggggtaaaagatgcacagagagaagcgtcctcctgtttgcaagaccccaccctgcatgtgggagagagctgcagctgccaccaagtgacatcactcacctgtgaaggatggcagagtggatagaagagagctgctagtagctgacaatatcatcaagcctcagatttatccaattttgcaaccctatctgtccccaagcttttctttatgtaagataataaacccttattgttaatgttc

SEQ ID NO: 228558 - DNA, 769 bp, Homo sapiens
tgtctcaaaggatgagttgagcttggataggcagtggggagaacacaaggcagtccaggcaggtggaacataagcgaaagggcagtgtgcccaccaggccaaagcaaagggcacatactgtcctgaaataggccacagagatgaggggaaataaaaagccgtctcaaggagatcttgaaagccagggtgagaagcctggagtttgcccctccaggatcctggctctcaatctggataagagtgaggggaagggaagtggaggtggggaggagggcagtgggggtggggagggccaggaactgctgactgggaagattattttctttgtgtattgcttaggtttcgttttacttatttgttttcttgcagctttaacaaacatcagcgctgcatgtggaaacttggaaaagaaaaaaaaagctttaacaaacaaaaacacacatacctgagatgcacacggcaacctactagctcatggcaaacaggcctatatgttgataacctctgcattgcttaggaaataaaacactgcagattcttgagccaggggaagtgcttctatctttgttcttcctttttctcctagtacatataacatctttactctggtctcagaatgtttcttccaaaccttaatggctctccccttctttttccttaatttcttcattccacccctggaataacgttctagtccagactagaaatacaacgtaaataaagactcaatcaatgccaacagtaggaggaggattaccacccagctgtt

SEQ ID NO: 228559 - DNA, 716 bp, Homo sapiens
tgtctcaaaggatgagttgagcttggataggcagtggggagaacacaaggcagtccaggcaggtggaacataagcgaaagggcagtgtgcccaccaggccaaagcaaagggcacatactgtcctgaaataggccacagagatgaggggaaataaaaagccgtctcaaggagatcttgaaagccagggtgagaagcctggagtttgcccctccaggatcctggctctcaatctggataagagtgaggggaagggaagtggaggtggggaggagggcagtgggggtggggagggccaggaactgctgactgggaagattattttctttgtgtattgcttaggtttcgttttacttatttgttttcttgcagctttaacaaacatcagcgctgcatgtggaaacttggaaaagaaaaaaaaagctttaacaaacaaaaacacacatacctgagatgcacacggcaacctactagctcatggcaaacaggcctatatgttgataacctctgcattgcttaggaaatttttctcctagtacatataacatctttactctggtctcagaatgtttcttccaaaccttaatggctctccccttctttttccttaatttcttcattccacccctggaataacgttctagtccagactagaaatacaacgtaaataaagactcaatcaatgccaacagtaggaggaggattaccacccagctgtt

SEQ ID NO: 228560 - DNA, 558 bp, Homo sapiens
gaatttaaatataatgattggttttgaaaaatttatacctctgttatatatatatatatcttattttggtattgcttgaatcattgtgttgtaggcagatagattcttttttgagatttgtcttacttaacatttttaaataaaaagaattttaaaggtgtaagagacctaagacgtcatttacttgctgttctgattaaaacaaaaatgtttatgtataaaaagggttgcccttgccgggcaactaccgtttcttactcttttaaaattttatttgtttatttatttattatagttttagagttagggtcttgccgtgttacccaggctgatcttgaattcctggcttcaagcagtcctcctgcccagcctcccaggtggctgagattacaggtgcacgccactgtgctcagcttattctctacttgtaatataagaaaaattatccttttctgctgcttccactgaagctgaaattgatcagttttttgggggagtgggtttttttttgtttttgtttagttttttaatcactcagttcaagtgcctgtgacagtg

SEQ ID NO: 228561 - DNA, 621 bp, Homo sapiens
aggctgaataatggccccccaggatgtccacattctaatccctggaacctgtccatgttttattatatggcaaaagagactttgtagatgtgattaaattaaggctcttgagattgggagattatcctggattatcagagtaggcttgatgtaatcacaagagtccttctaagagaaaagcaggatgcagccccctgatgacagaagcagagaggaaagcagagttggagacagaagacgctatgctattggcttcctaaagacagaggaaagggccacaaaccaaagaatacacttgtattcttcagtaaatagcagctgccttggagtgttgcttgattcaatacatgtaatagtaatcgttcaataaatgcttgctattatacccttggatgtcttagagctgcactgtccaatatggtagccacaagccacatgtgaccattcgacacaggtgtggattttccgaattgaggtatgctgtatgtgtaaaataacacaccaaaattcagatactgagtacaaaacaaagaatgtaaaatagctcagtaatcttaatattaattatttgttgaaataacatttttaacacatccaattaaataaaatatattaaaatta

SEQ ID NO: 228562 - DNA, 308 bp, Homo sapiens
gctacaaaattgattcatattgtgaagaaatgggctctaccatgtttccttcatgagcagtgtgtattctatatgaatctactcccagtgcaaggaacactagtcaatttttggcatgagatgagaacctcagaattgctgcagccatcttgctaccaaggcagaacaaatgagaaagtcagtatgctaaggaaggcagctgaggaaggaagaaaaatcttgggttcctgttgacattgctctgtccctgaaatcttctacctctgaatttcttgttatgaggcaataaacactccaattctttatct

SEQ ID NO: 228563 - DNA, 349 bp, Homo sapiens
gctttctctccagcctggaatatgaagttcaatttagcacatgattgtggatactccatttcagaattaaatgaagatgacaggaggaaagtagaagagatcaaggcagagttatttggtcatggaagaacaactgacttgtccaaggtataaaagaaatctggaaatgaagaaagtaaatatgaaagaatgggtgatggaattaggatctcttacttgggcatcagttgagttgctgataatatttggctaaagccttttttggttttgtttttgagacagtcttgctctgttgcccaggctgaagtgcagcagtgcaatcacaggtcactgcagccctgaactctta

SEQ ID NO: 228564 - DNA, 2033 bp, Homo sapiens
gatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcggtgagtctcattgtgataacaagcaagctggatggactttgtaataaagggtttcaaatacttaagtaga

SEQ ID NO: 228565 - DNA, 241 bp, Homo sapiens
gacacacatccaggacttggaagactagaagactgaactggggtctacctgatgccaccacctttgctcttacaaaattaactgtaagtatgtaggacttcagcagggaggaggttatccgagtgagagcctggcgttagcattagtcatctgtagaaatcactatatccaggagggtgggataactggaattgttggtccatcaaatacaatttttgataaacaatcagtatcaaaacat

SEQ ID NO: 228566 - DNA, 865 bp, Homo sapiens
  misc_feature (801)..(801): n is a, c, g, or t
  misc_feature (804)..(805): n is a, c, g, or t
ggaccaccggctcgcggcgcgtggaggctgctcccagccgcgcgcgagtcagactcgggtgggggtcccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcacccttgtttggggaaggattccgtgcctttgtgaccgactgggacaaagtgacagccacggtggctgggtgacgctgctggtgtgggggtctactcngcnngaatgcacgcttgtccctggacgctcctcgaggctggctgggcaagccgcctactgcagg

SEQ ID NO: 228567 - DNA, 978 bp, Homo sapiens
  misc_feature (143)..(143): n is a, c, g, or t
ggaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaagncgcggggcctgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcacccttgtttggggaaggattccgtgcctttgtgaccgactgggacaaagtgacagccacggtaaacatattcataaaacagggctggcaggtggctgaaaggcagcattttcggaggcggaggtgggcggatcacgaggtccggagatcgagatcatcctggtaagagtgaaaccctgtttctacta

SEQ ID NO: 228568 - DNA, 371 bp, Homo sapiens
tagtctaaaaattgttctcttaagattggaagtatgtaggctgggagggtaaataccaaatcttggtatatcagaactgagcatgtcccttgaaggttaagaaatagttaatgggcaaatagagcatggcaatattttgtagagcagcaagtagtaggccttgaatagatgtcgctcaaaaagtaatatgtaagctgaacacaaaaatgtaacaaatgaatttagatacatatttgaatattaaattcaggttgtttgggagatgcacctagtctttgatggttaaacctttccctccatagaagagacagagacagaatggcttgctggactaatgtcccaattcaatagagtcttatctatgaaggtta

SEQ ID NO: 228569 - DNA, 502 bp, Homo sapiens
ttagttgattccttatcagttgacctggtcgcacctttaatttaattgatattattattacgtttgccttgcaagttctcagatatctccaaccttttgtgttgtcattcatcgactacgggaatattctcaatgaaatgtccttgatggtctctctggttcttattctagtcatgaaaaggaaaagacaaaaagatagcaaatcttaaaactagtcatcggccgggtgtggtggctcacgcctgtaatcccagcactttgggaggccgaggcgggtggatcacgaggtcaggagatcgagaccatcctggctaacacagtgaaaccccgtctctactaaaaatacaaaaaattagccgggcgtggtggcgggcgcctgtagtcccagctacttgagaggctgaggcaggagaatggcgtgaacccgggaggcggagcttgcagtgagccgagatcgcgccactgcactccagcctgggcgacagagccagaggctgtctca

SEQ ID NO: 228570 - DNA, 266 bp, Homo sapiens
ttcaaaatcaggcaaaattaatctatagcggtaaagttgggattctgtttatgcttttacccgtggtgggggcgggatgctggaagggaacacaaggggagaatttctggggggctggtaattctgcttcatggtgccttttgaatggacatgttcactgtgaaaattaacaagcagtacacttacgatttgtacactgacttttctatatatgtgtcatacttcagtaagaacttctttcaaaaataaaagtattactcccccta

SEQ ID NO: 228571 - DNA, 512 bp, Homo sapiens
  misc_feature (73)..(73): n is a, c, g, or t
gcggagccaatcttgtgtgctttacgatacagacaccgcggcttcaattaatcttccgccgaatgtcgcgtcnattgtcacggctaccattttcacaaaggacagcaatccctgattccccaagatcactacgacccatttaaggaaagctggacgccctcagaacctggtcagaattccagggtagaccactatcaactattaaattcgcggcccgcgtcgacgaattgacttggcttagttgggtaattgccacttgagtacactcatgaatttatatagttaaatgcaagctgctggggctggagtcatctgaaagttcaaatgggttggacattcgaggtaacttcctcacttacatgtttggacccagctggaagaactgggacattgaggttggccaagcatctcttttcctccatgtggcttttccatgtggccacatgaggtttcctcacagcatggcagtcttgtgttaatcttcatattgttgctgtcttccccgtcgacgc

SEQ ID NO: 228572 - DNA, 603 bp, Homo sapiens
ggaaacgtctggtcctcccagcaaccatgtgcggtagaaagggcaagctcactgtccctagttggtaggtgaggacacagatgctccttgacttaggatgaggttggatccccataaacccattggaagctgaaaataggatatcctaagttgagaatgcatttaatatacctaacctgccgaacctaaccggacctcatgtaggtggaatcatacggtatttatggtcattttgtgactggcttatttcacttagcataaagtcctcaaggttcactcctgttgtatgtagcatgggtcatagcttagctgagcctcccttaaacgtgctgagaacacattagcctacagttgggtaaagctgtctaacacaaagcctataatgaagtattgaatatctcatgtagtttattgaataccgaaaatgaaaaagagaatggttgtatgggtacttgaggcacagtttctcccaagtgcatattgcttttgcatcatcataaagttgaaaaatcttgaatcaaaccactggactttggggactgtctgtactgaggctcaggaaggtaaagtgacttgtccaggtggcccagccaggaagtggca

SEQ ID NO: 228573 - DNA, 490 bp, Homo sapiens
atggtggtaagtatttttaagtgaaaacagaaatggtacagtaaaaacatagtggtatgatcttatgggactactgttgtatatgcagtccctcattgaccaaaatatcattatcattactatgtgttagcagtaagttaatgacagagttaggatttgagcccatgtttacctgatatcatgatgtgtatttctcacattcagacttgccccttctgtaaggaggcatatcctttctttacattatttttgctcctgacagtattcaagcatcattccctttcagtaaatacatgttcaacagatattataaataaaaaccccagagtcagtgcctccatggccagtaaagaagaaaccacgcattatcagtgcttagaacactgccttttctagctactgaaccatgaagccatttaaacttcctattaaaatcaattattttcttttgtaacagaagtaattgttgatctagctgagtctaggaatg

SEQ ID NO: 228574 - DNA, 482 bp, Homo sapiens
ggggaggacgggattaacccgttataatagctaatatttatataacactgtggggcaggtggtattgtgagtgctttcacatattcattcagtctttatcacaaccccaggaagcgggtactattattactgtcactttacagatgaggcaactaaggcagagagaggttaagtaacttgccgaggtcacacagctaagaagtgacagtgaggatttgcacccagtccatcaactctaggccctgtgcttttcaacagtcagggaacgcggcaggagggcactgagtcctctaaacggccttagtcatgggaagcagagatgagtttgctctgtagataattcggtatgctctggacacctcagattatggggagaatgacagttgggagtaggttacatatttttgagaatttgtgagattatgtctaagtcatagcagaagaagatatagtatttcttcactcttaatgttgaaggcaaa

SEQ ID NO: 228575 - DNA, 344 bp, Homo sapiens
tggatctttaggacacaacgcagtgagtgccagacaagcccttctcagatgggtgtgcacgttgttaagtgagcaggactggagccacccagcggcggccaccagtcacctgcagctaggcaatgcgcatttaaatcgattacaatcccatcctgttaaggatcaggcactcgggtgtcatggcggctggtggctccatttggacagtgcgggcatgggtcacttcccgttcatcacagaaagttccagcagacggtgctgcacaagggtctcaactgcactgtcccttcaggaagccatgtgtcgcttacatttaagttaaaattaaagttcagaattcagat

SEQ ID NO: 228576 - DNA, 460 bp, Homo sapiens
gctgctttggctgcagtttgggaggattcaggtctcttccatgagattccacagttttctgggattagcagtaacctggcaaatgttctcatggcatattatgggagcacaaaagccaagtgcatttaaggcccttgctgaagttagatgtgctgaaattccattaagtaaatcatatggtcaaactcatcaatggagcagggaaatatactccccctccagtgggagggagaggagtggatatttgctgaatgactgcccattcacaaaaggttaatttttccgtcaccctagcactatccacagagtgttctgctccttatagtcataaagcagcccccaggccaggaacaatggttcatgcctgtcatccgagcactttgggaggctgaagcaggaggaacgcttgagcccaggagtttgagaccagcctggcaacatggtggaaaccccatctcta

SEQ ID NO: 228577 - DNA, 474 bp, Homo sapiens
tcctggccaccaagatatgctgtgtggatatgaagtttcatttcatatcagaagaacatggctggcaataaacatttaaaaatatgtttcatctcaacaatacccaggacatgcaaattgaaacctaaatgaagtaccttttcactttcattgggtgggcaaaattcttctaatttgacaatattgagtgtcacaagaatgtggaacagtagaaattctgtgccactggaggtcgtgtgaaccaatatgatatctctgtaaataatttggcattatccagtaaagctgaagataagcaactagcagttgcactcctacccatgtatcctagaaaagctcttgagcatgtacaccaagagatgtgaatgagaatccccacagctgtgccacttgaactagcagaagtctacaaatagcccagctgtctatccacggtggaatgggtaaataaactgatatgttcgtgggacagaa

SEQ ID NO: 228578 - DNA, 526 bp, Homo sapiens
aggctgctgggtgggaggctgatcactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggcttcagtgagccatggttgcaccactacactgtagcctgggtgacaaagtgagaccctgtctc

SEQ ID NO: 228579 - DNA, 121 bp, Homo sapiens
ggtgcttttttcctgcgctctcacacacctctgtctcctgccaccatgtgagacagtccatgcttgcttccccttcacgatgattgtgagtttcctgaggcctcccctaccttgtggaact

SEQ ID NO: 228580 - DNA, 377 bp, Homo sapiens
aacctgtggtatgctgagaaagcctggtgaaattgtactcagccttcacacctcaggttagatgtcatttcctatgagaagcccgcctcgttcaggacgtccatgatctctcacagccttctgtgttccctcctcaacacggtgttttatagctttttaaaaaattctgtgatcatattatgctcagcaaacagagagagactattcttgttccctgtgcctaggatgtgcttgatgtatggatctgtctccagcgggaccagaaaaccatatgtggcaatacttataaactgcctctagctatatagattaatacagaatcatctttctgtatgagttttccaccaataaacatgtgtagatataagcaaagcttt

SEQ ID NO: 228581 - DNA, 4120 bp, Homo sapiens
  misc_feature (1936)..(1936): n is a, c, g, or t
  misc_feature (2557)..(2557): n is a, c, g, or t
  misc_feature (2643)..(2643): n is a, c, g, or t
  misc_feature (3098)..(3098): n is a, c, g, or t
  misc_feature (3307)..(3307): n is a, c, g, or t
  misc_feature (3572)..(3572): n is a, c, g, or t
  misc_feature (3704)..(3704): n is a, c, g, or t
aaacaactatgatgctaattaggaggaggaagaatgttttcaaagtctttcaccaggtatcgatattcatctcaaagagtttgaacaacagattcaattctgtgtagggaccatttcttcatttattctttattcctactaaatcagaaataccaaattcataagtcatttggaagggtaacaaatgttcgatggtttgtcaactagtcttgacaaacggattctacaatgtacagaaattatggagacagttttcactgatagatgttcagtgcctcaaaggaaactcattaagatgagggaatggcctctcaaatggaacaggattgctgaatatatcaacacaaaagatcactagcaaatggattcctaatgaattcctggttgaatttgcctccgataattatgtattcatattcagtttgagcattcagatgtgttaaatatggccaataatagcactgatttatttcctcctttaatttagaatatctttaagtagttagaaggaaacccttgttaactaatccattgacatcaaaatttaactttttaaggaacttttgctgtctctcactaaatattagaaatgatgatatgttgttcgtgaagtcataaagtcaggcttctccactctctgtttgatttttatgtgtatgtgctgctcataaaaatcatcacactggtagagattcttgttctcacaatgcagattcacagtgtattttctccctgaaaacttgttattttctttggaacctttatgccaaatgatatataatttgcagtactattttcatgtctttctacttttacatctccgatggattaatgttgcagcattaattcattttgtgtgagttggtactctaaaatacaataaggcagacagctttaaacccatgtgatgtttaatatcctacaaagaccaaagagtcatagtggatatttccctcaatctaaaaataagggaaaatactaataagcaaattatataaaaatgaatctgcttaaatagacagcaccctgtttgccagatgttacctgagacaaccaatccatatatcccatgtatgtgagatgtttaaaaatgtaagaattactaaggacatgataaatttttatgagaatcataattaatcatatagttcaaatttcatggtgcctgtctattgccaacccctagtttttcacaggtttcacattggaaagcaatgggttgtcctttggcttattttattttagtaattaactgtcctttaaaaacaataaaactttcagccttcagtgactttgataacctatgtgataaagtcagaactcattagcctgatattcaaggtcttcccagagaggctccatcttacctgctctgacttctgtcttatacctgctgatccacctggggtgtctgctgaaagcaggtcagcacaatgactcagattcttccctttctttccctctcccatgccccaggatttgtttgtacaactggcccaggaatcctgacttcatttattctctatgggttaacccaggttcttgcttgtgaatggaaacaggataatggagctaaacctaaatggcattttctaaccatgtcttcattattcattctctgaaccatcctctctaatcagtttttactgatttcttccccaaatatgcatttgctttctcatttcaacttatatttacactgttctattcatcagaaatgtccctgtcttgtctgcctcgtcaaattcttcaactcccaactcctgtcttacttcctatataaaatcttattaggttaccttagctgaactatcttcttctttctggaattcctattgcaattacttttgttgtaattatttaggcagtggtttctttgatatcatttactgtgttttctggcaattgcactgaaattgtatactgctcttcaatnaatgattatctatttccccaaactagattttaagcaccttgaggacaaatattgcctcatatgcctgtatttctgttccaggtctttggcatactgttaataatgaacaaatattatattacagtaaaactgtatcccaagattttctcagactcatctaaaatataggcaagaacttaataacactaatatgcctgttcaatgaagcattctattcaaaatgttttattaattctttacagcttcctcagcatctgattggaatcagtggcattttaatttatatgtctatttaacaaatactaatatagtgtgcactgtgtgttactcattttctatgcactttacaaataataattttatttaactttcaagacaaccatctgaaataggtgctattattatccctgttttatgtatgaggaaatggatttactgagaagtaactcagccaaggtgatggaattagttactaataggttcaggatttgaacctacatttttaaccactgtgctctaggaacttagttaacagctttaatgaatgaaatggttctgctaattgatgtaagaaactacttacatgttttgttggctaggtcacctgtcactctcagttcngaatctttcaggaaatgtcctttagtctctggtgggaggtgtactgcaactaaccgtcctttgaatttatgttgccatgtacagtncctgtaattttatttcctctttctatctttacttttgggatctaagcttccttgaatgtttagcctttttgtctttttagaaaatattgttccctttatgaatatgtctcttaattgctagagtttcctaatagccaaatgaaaattacattttggcttagaaaatgctttcatctgtatccactggctatatatctgcaaccaaagtaaagtgtggaattgggtatttgttgtttgcagcatttgagcagtgtacacatcaaatgtggttaattctattaccagtaatatttctagtttcttctaaaattaccataaaggtttaggtctagattagataattatttccaatcaatctcctttcaagttggaaatgaatgaagtcccatgttttctgtgtgctatttcatatattttggcatgataattattaatagcaatgtattactattgcncttttgcttacttaaaagtatattttgcagtggtttattttattctaggtgggagaataacacgttgatatcttcttgaaataaaaattatatgtcaatgaatgtgacaatgttctatgtaagtagcaatcgaggaatgactgaaaagggattattaaatatttcaatgcatgggaaaatatttcttctacctatttactgcctaaagnaaatgctaacccagaagatatttatgtcttggtttagaaatctgtagagtgacagagcaatctgagctctgtaatgtatgcaaaatttatcaggctcagagagacatgagtatgggactttggccacataccatacctgtgcccagggacaactgttaggaaacattttgttccagactagttgtgtcacctattatcttcatgttcctggaatttgtgatacaaagaacaatgtatagccaatcgatagcttatgtatttgaangtatattcttggtaaacaacttaggaactgcctcttgtttttttcctaaaaaaagccacttgtaatggctggtagttggagtgtataatcagagcaacttgaatctacgctcctgagtggccatcttcaacnatcaccctggaataaactctttttaaactagaaaacaaaaacaaaggaaacaacaaaaaagaagaaatctatagagtgaactatatttttccaccttgcaaatagaaggggcaaaaatcaaccttgcctatctgatgatttagtgtcatagggattccaaaatgttatttgtaacgtgtaccttgatatgctaatggtgaaatctcctgtttcttgatttggtcttctcatcttacatttcttacctcaaatccattctgcgacttcaccagcagattaatattctttcctggtctcttggaattttaataaaaacagcatggtcatggggtttcatgaagcttgcagccctctgggggatgcagataataatcaatcaatctcataattaaatgtaattttaaataagagcttac

SEQ ID NO: 228582 - DNA, 713 bp, Homo sapiens
  misc_feature (306)..(306): n is a, c, g, or t
  misc_feature (362)..(362): n is a, c, g, or t
ggatgctgatgatataacaggtatgcattttctctcagaagactctttggaacataacccataggactcttccttccttccttccttctttatcctcatcgtcactggaatcactgacctgcacagttatgtcagtgctagttacaggggtccagtcaaaataaactccaaagccaatgtcatagtcatcggtcgcaaactcccagcagacacgcttcccctctggatgagtaggtacccggatggtcaccacctcaccacgcttcaccaccagacggctgttcttctctttgcccagcttgcttntgaattccttcaccttggcaaaggtccagatgcatggaggagccatcagaggtggngagactttcctgtggtcccccagaagatctgcagattccaaatcagctgaaagaacatctatagctcctgtatgttcagactggatcataacgatgtccccagacctctgtggaacttgatacttagccatctcattgaggacctgggcctggtctgcaggcagcaaatcctgtttcaccaaggcctgagcctccaaaggaccagttgctttccgcagatcttccgtggcatccttactcactggagataccatctgtggcctgtggggtgaggagcagggttctggatcggtggcagaagccaataaagagtatccttgttttctagatcttcattctctgaggcggccg

SEQ ID NO: 228583 - DNA, 557 bp, Homo sapiens
ttattgtaattgtatttatagatatcatcaaattgctctactcagaggctttccagtttatagtcaccagcaacataagaaagtacccatttccccatctctctgatagtgtgatttttactaaaccaagagttgaaaatggtatttcagctgggcatggtggctcatgcctgcaatcctggcactttgggaggccaaggtgggtggatcgcttgagcacaggagtttgagaccagcctgggcaacatggcgaaaccccatctccacgaaaaaaaaatttaaaaaatggccaggcattgtggtgtgcacctgtagccccagctactccggagactgaggtaggaggatcacttgagcccaggaggccgaggctgcagagaatcaagattgtgccagtgcattccagcctgggcaacggagcaagatcctgtttctaaaatatatatatataaataaaaattagcatgtgatatgtctttctatatatttaaattatcttttgtatctcttagaatttgaaagtttaattcataaatatgtttcaagtatctcattaa

SEQ ID NO: 228584 - DNA, 379 bp, Homo sapiens
cctggcacagagtagtagggggcaaaaagacttgagctggaccctgaggacgtcttcacagcatagaagcgtgagggtggctggctggagccgggagcctgagctgcacacagtcctcctccaaaagggcctggggagtctgggaggggttcatccacagaagcatccacgggccgggacctctggccagctgcctaggccctccctggggaggcatgctagcctccagctccagccccggatgcacggaggctttcccaaggtgctggaagtgccgcttccttcaatagagcctggcttccccttcccagcccccttggtctgatgtgaatggacacttcctgcgggggcaggtatcaataaacacatctgagatgcc

SEQ ID NO: 228585 - DNA, 568 bp, Homo sapiens
agctctttcagcctcccacaaaggtgcagggcaactgtcagggttgccagttccttccgcatggtggtgacgacctcgctggccagactctgcagtgtctgagtctccacatccaccccgcatccccaggagcaggcacagactcataaatttggcagaaaagaatattgtgaaatccttgcagctgggatttcaggaaaagtcagaagagtaagtgctgcattgtctggtgtcagccaccaagagggaatgggaatggtgatgaggaacgctgtgtgggtctaatgaactcctcactgtgggcgcttctgagaattttgacttcccagatctttgtgctgttgttacaaaagcagcagaccgtgcatcaacagagaaattccgcagctgtacagtcaactttatgatctttcaagtcaagaatcagaccagggtgaggggaagctgtatctgatcaactgctcactgacagaagaattgattgagactggaagtaaaaggaaaaaaaaaaatgcaactagagtagccccagcctgctagctgttaagaaagaaaatggggattaaaa

SEQ ID NO: 228586 - DNA, 215 bp, Homo sapiens
agcacccaaattgcaaaaccgagaccaacaagggctgctgtatctgaaaggatgactctgactaaaaaaagctttatcttttcaggataaatacaaattgcttattttttactttgaatctcccatttaaattgtcattctcaaatagtaatgattttaaatttttcaaaaataattttagatcactcataattaaaatgggatttacagatgga

SEQ ID NO: 228587 - DNA, 496 bp, Homo sapiens
ggtggatgctgccgtgtttgtgaccaggacagatttctgtgtacacaaggatgaaccgtgtgacactgttggaattgcttacttaggaggtgtgtgcagtgctaagaggaagtgtgtgcttgccgaagacaatggtctcaatttggcctttaccatcgcccatgagctgggccacaacactccgcaagaaacagatactgaagacttggagtggctgtagacttccctaaaactgaggaattgctctccacgtacacatgatttttgctacgcactgttagcagcaagttcctcctcgacacctggagggttgactgttagcctggggttttcatcttcaggagcttttagccatctttccatttcctgccctgtcccagccctgtgtctgcagcaccattagatgaattactctctaggctcagaagcagaaagcatattcttattctcaccaaatcgccctgtttccttcaacaaagttccatgataactgaca

SEQ ID NO: 228588 - DNA, 405 bp, Homo sapiens
ggtgggggaagcttcagaacctaatgctgtggtgtgacccaggccctgccacctactagaatgttaccttgaacatactattttgtctctttggtcctcagtttcctcatctataaactaataattggaggtaaatcatagagtagttttttgtagtttgaagaggtgatgtgaccctttcaatttctaacacaagttagaaactattgagatccaaagaagtcaggcagatagagataaaaatattaggcaggaagatgtgactttggtgtaggcaaaagtgggcttttaaaatccacccttgagaaccatggtgaggagacatactggacaaccacaagacttgtcctagagggcttatctctcctcacagcttggcacagaccagtacacatctgacactga

SEQ ID NO: 228589 - DNA, 351 bp, Homo sapiens
ggtgggggaagcttcagaacctaatgctgtggtgtgacccaggccctgccacctactagaatgttaccttgaacatactattttgtctctttggtcctcagtttcctcatctataaactaataattggaggtaaatcatagagtagttttttgtagtttgaagaggtgatgtgaccctttcaatttctaacacaagttagaaactattgagatccaaagaagtcaggcagatagagataaaaatattaggcaggaagatgtgactttggtgtaggcaaaagtgggctttttgtcctagagggcttatctctcctcacagcttggcacagaccagtacacatctgacactga

SEQ ID NO: 228590 - DNA, 325 bp, Homo sapiens
ctagcgcccttatgttctggtaggctcctggcaggagccaaaaagaagaaataacatgtgacaattagtccaaaccaatccttaagtatcctgcatcatgtgcgtcgttcagccctgaggactcagaatctccaaatatgtgtgtatatctttgccacaaagaggaatgcagaaggatctaagctcagatcatattaatgttcctgatcctaatgggaggctggaactatgcagggggatgcagaatgtccttgagtgactctgtcttcaagtaagaaaatccccaatgcatgagacctgagactcaaaatcagttctctggact

SEQ ID NO: 228591 - DNA, 169 bp, Homo sapiens
gtggcggtccggcagaagatatctgaagatcacctttcataactaaaagtctttatacacagaatctctatttcctcacttccaattcattccttcaaccaagacagttcagctttcactacaacacaccatggcaagtacttgtcatggtcaccaatgacttccatgt

SEQ ID NO: 228592 - DNA, 729 bp, Homo sapiens
gccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgctgaattgctgcaaggttatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgcttgctactttaaatgatgaaatggcaccaaattgagtggagacgaaggggtacagaaacttccttcagattcaagaaagattgaactgtactgcaggggcatcggtggagctgatgggcctgagccttatcatctag

SEQ ID NO: 228593 - DNA, 847 bp, Homo sapiens
tttttttaaaccagcaattggccaaatttggggaatattctttttgatatgtgccaaaaataaacagaaggggtaatttttcccccttgaggacttagattcaaatgatactgtttttagtcttgtttgttattgaatccttggataaaacagtatgattacctctagaatttaaagtcttcatttaatgaataggctgtttcaggtctttgaaagtatcgtctttttttaattcaaagtgcattttaatatagaaacagtttaaaagtagctggccaaaacctagcttatatacagcttccacatatattgtcatatattatcttacttaagacatgctatagctgagataaatagtaataacagcagctaggtgctgtgttcttagcagcactacctgagagctttagacctggtggtagagtgatagcaactggcagctgcctggtcccattgtgcctctagagatggctcctctggcagcagagagttccagttagcaagacaggatgcctgccagtgggcatacagctgggtaggaggaagcctgaggggcaagagaactgagcagcatccacagtgggtatggagagatggtagaagtgattcacaaatcagggatttcaagaaagaaaataagctggaaagggtttagaaaacatttcgaatgaactcactgagcagagataatagctttcatataaagataaactaagtaattacaattctttaacccagaaaaatgaagctaacaatatggtaaaagttaaaatcatgaatgaaaagaatacatatgatgaatctaatatgtaaattttttaaatggatcggtgtaatagaaaataaa

SEQ ID NO: 228594 - DNA, 643 bp, Homo sapiens
atgactttcattcacaaggatcacaatcaagagtttaaagacaaccggtctctgctccagccacacaggacttcttctagtacctttactacatcatgcctcccctgcctcaggcttctgctgggatggatcgagcacattcaccctaaaattctgattcagaagatctgagccttctgaaaaaaaagcattgagagcataaaccactcagaagatttatagcttaaagcagatcaccttaaggtactggaatcagtcagtgcttagatggaacattttttgaggcctacatcttcactgagtgcccttcttctctatttcctatacttccttgtttctttctgttcccactgcatcccttatggatttgtacaaataatgctgggttcttttcttcacccacatgcagcagttgctgctggatcataaccattccttctattggttttaaaatctgtttttctcagattccttacacttgaaggaaaaaaaaaaaggacatttagcctgtttttcttttaagcaataaaaattcttctctcactgtattgattattctcaatgtggggctaaattatgcaaattctgattcttttcctctttgcaaaaattaagaagcaataatatcaagttagtataccat

SEQ ID NO: 228595 - DNA, 588 bp, Homo sapiens
atgactttcattcacaaggatcacaatcaagagtttaaagacaaccggtctctgctccagccacacaggacttcttctagtacctttactacatcatgcctcccctgcctcaggcttctgctgggatggatcgagcacattcaccctaaaattctgattcagaagatctgagccttctgaaaaaaaagcattgagagcataaaccactcagaagatttatagcttaaagcagatcaccttaagagaatgactgcaataggaaacacagtgaaatcaaaagtaccctcatcaactcactctgtcacaaacttcctccaaatgtgttaatgattttctgagacacattttcaaaggattatttataagaacgagacaaaattaagccaaagtccatattacgtgaaacttcatctcctaggctttgtaaataaaagctaaaggatacaggacacatctgacccaggaatctaagcaagtaacatactacctggctaatccagttgaggtgaaggtcacaatactgaatttgaatatgctgtgttctctactgtaaataaagtattttgtttatcttttcatgccactcaa

SEQ ID NO: 228596 - DNA, 648 bp, Homo sapiens
agaatgactgcaataggaaacacagtgaaatcaaaagtaccctcatcaactcactctgtcacaaacttcctccaaatggtgggtgtggaaaaagtactgggtaactaattaaactgaggatggatggagaaagggaaagagagggaggaagaatctaatttaacatttaaacactatttaattatattttattacaagaaactatgtgaagatgtcagctacccacagggtgggaacactaagcctggtgaatgtggtaaaatctagacataagccttagcagagaaatctacagacatacagtattgctatccaaatcacctgaattcaagtagtgaggtatacctgtatttctttagtaattgaaaaggacaggctggaatttgctaaatattacccatttcccctctacatccaagggctttggaatacatatgtaaaattatttatagatggaaatctgtgttatatgcttttagctcaagggaaatatactcattaataacctgaaatgtgacaggcacggtggctcatgcctgtaatcctagcactttgggaggctgaggcgggcagatcacgaggtcaggagtttgagaccagcctgaccaacatgatgaaaccccatctctactaaaatacaaaaaaaag

SEQ ID NO: 228597 - DNA, 325 bp, Homo sapiens
aggacttcttctagtacctttactacatcatgcctcccctgcctcaggcttctgctgggatggatcgagcacattcaccctaaaattctgattcagaagatctgaggtatgatcagtcacctttatcttttttttaatcttaatatttgtggatacatagtaatttaatctatatatggggtacaagagatagtttgaaactggcatgtaatgtgtcataatcaaatcaggtaaaatggggtagcgatcccctcaagcattgatcctttgtgttacaaagaagccagttacactcctttttttttttttttttttttttgaggca

SEQ ID NO: 228598 - DNA, 402 bp, Homo sapiens
aaaatatttgagaaaaaataatataaaaaaatacaaattaaaaaccaatactatataacaactatttggatagcatttacattgtaggtattataaataatttagaggtgatttaaagtatttgggagaatctgtaggttatatgcaaataccatgccattttataaaagtgacatgaacatccaaggattttggtatccatgagggttcctggaaccaatcccccaaagataccaaaggaagactgtattttaaaataaagctacttctttacctttttgtcaactattgccttgggtttacttatttaggaatgcacttctgcagaaagtttaccaatgtgttattgatctcgagattgtattaaaataaaagatttatttattgttttcctttatttag

SEQ ID NO: 228599 - DNA, 463 bp, Homo sapiens
agtattcctgagttcaaacctcagttttgcctctttctgcagtataacctggagtaaatttctctacttctttgagactcgatattctcatatgtataaaaaggagatgatgatggtagcctcatagaagtattgtgaagtgcatagcatcatttctgatacaagaatatgtttagtcaattttagttcttaaatatatgaatatgcagagtaattttagatgtcagtatacttaaccccagacaaacacatgcaatagcccttaaacttttagattgggcacttgtcagtttcctataccccttccctgcaattgcctcatgattttttgattatgtggcaaatgcacaaaaggaaaccacatgtagctgccatttcacaccattaaatactcagaaagtcacctttgaggaaaaccagtacttctaagaaaaagcaaagccacgaagttcaaaaaaagaaa

SEQ ID NO: 228600 - DNA, 426 bp, Homo sapiens
aaacccaaaatgcacagccgtgggtggcattccaggcatatgggcaggtgagggatgagcaccagagccggacagacctgagtgttcctgacccacttcaccttcacatgagtggacaatgtaacttctctggccctcagtgtcctcatctgtaaaatgggaataacatcttgtgctccagtttaggagatgaagtcaaggccactggccctttggccatctctggctttgttgtgggcctcccttgctgggtatcctcagaaaacttgtcaagaaaagtaaccagctggctgggcgcggtggctcatgcctgtaatctcagcactttgcgaagccaaggagggtggatcacgaagtcaggagttcgggaccagcctgaccaacatggtgaaaccccgtctctactaaaaatacaaaaaaaaatta

SEQ ID NO: 228601 - DNA, 200 bp, Homo sapiens
catcttactctccacctcaatcagcttatcaaagtattccttctgaccacatacagcagttctccctatgagttctggaagatgttgtctccagctcatgagtgagtgggaggataaatgaatagatgaatggataaatgagtgaatgaataaatgaggttctgaacatttaacactggaaatcttagacattattgaga

SEQ ID NO: 228602 - DNA, 744 bp, Homo sapiens
gagtcgctctgtcactcaggctggagtgcagtggtgggatctctcacactgcaacctccgccttctgggttcaagcgatcctcccacctcagcctcctgagtaactggggttacaggggtgagccaccacgcccagctgttacatgatttttgtttggatcaccactgccagtgggctgagttctagaccttaattgatcaaacgttatttttacaggcttagggctacaattaataaatgtaaccttactatgtttagtgtgagttttttctttgcatagatgttgcagggaaagtatctcagtatacatttataaaagccttgagaaaaaaatcaagaatcttgaaaaatgcatgcgtataatcctgttgaagaaattgtctttgctgtactgtgtttctttaggttgaatgtcaaaatagaatcagtgccggttttcacaaaacatgacttttggattttcatttatttaatagcacttcagtataaaactggaaattaacaagtttgttaaaacagaaaaatctggttggatgtgggactattataaatcttaagttaacatggaaattaaaaatgtacttgtagactatttaataataattcacaataactatatgcaaaaattatgggatgaggccaaagctgcacacaaagaaaaagtaataattaactacttgtagtaaatagagtagaaataaatgatttaagcattcagcccaagtagctagaaaacaaatagc

SEQ ID NO: 228603 - DNA, 314 bp, Homo sapiens
ggaagaataactattggataatgggcttaatacctgggtgataggatgatctgtgtagcaaaccaccatggcacacatttacctatgtaacaaacctgcatatcctgcacatgtatccctgaacttaaaataaaagttggaaataaaaaaaaaagagtgattatgtcagggactaggtggtagctgtggagatgatgaaaagtggtcagagtctagatgcattttgagggtgggcttgattggctggtggattagatgtgaaggatgagagaagaaaaaggtactaggatgactctagagtttttgccttgaac

SEQ ID NO: 228604 - DNA, 633 bp, Homo sapiens
caaacgtgagtttgacagtattcaattcactcttcactgaggaaactgtagctcagaaatgacatgtaataatatttaacactagtcatttcacctacagtgtgaccacaggatcacgattaatctgaaattcttattctggtcatttaccttttcccactctacaaagtattccagcaagaaagcaccatttaagagagagtgatgcgttatgaaaggaagaaaaaaatcacttgctatgaccagaataagcaatgctgaaaagtttctcagctggaaaaaaaaaataatactgctgggctgtagctgctgcggtctaatgaagaatgcagcttctgtctcattgtcatgagagctaagatttgtcttcccacagtggtgatggtccctttgatgacccaggtggcagtcttattgatttttatgagtaaatgagtttctgcagcttatatgcataactagtcttaaatgcttccctgagtgaaattgacagttcattttatttggtttgcacagtcttctcgtcccttgcacatcttataagccacgtgagaagaagttgattacctcctatttacattagacaagcaatgtttactctccagggttgcagacaggctgtggtgaagaggt

SEQ ID NO: 228605 - DNA, 475 bp, Homo sapiens
cagaggggagagtggttgagattgttcagagtgccaagcttctctgaggcggggggcgggggggcatccccttgactctgaaaaccctccaatctgtctcggctgcggcagagagatggaacttatgacttctgaaatgctcggcctggcgttggagcctgggcaacagcgggtagttgcggatttaagttgccctacacttctgccccctggcgaccagaaagacccagcccccccgtccttggttcgcggtttctctagccgcctggcctcggtctcagctccgctgcctcctagcgcacataccggagcacaacccggctttcttaccttggttggtggcttctgctctgcactttaacaagcatcattcaacttccttggaggtggatgttatttatttctttttttaattacacaagatgcagtcttctcttttccccagaggtctaaataaagctaattaatatgcatt

SEQ ID NO: 228606 - DNA, 482 bp, Homo sapiens
agtgctgaatagaaatctgtcactggagaaatttgactgtcttttcagaaagaattcagagagaatggggtactgaagcagaaaaggatgcccttcaatttgatagaaaagcactacatgaatccctgtaagactccacaaattaaactaggagctgtgtcaacctgctctctgttttacatccatgtgggagggtctacgagcactcatgtggacagtgtctctgtgcatctgtttaagaaatttttgcctacactgaagtcacaagaatgctctccaatgtgttctttaaaaagtcttatagctttacttttaacatttagacccgtgataagtttggaattattttgtgtttacagtgttagatagggttatctaactaacacaatcattttttgaaaatatttctgtacatgactttactcttgcctttgtaataaatcagtggcctcgttggcctcagcggtggagctctgctgccg

SEQ ID NO: 228607 - DNA, 968 bp, Homo sapiens
aatttaggaagatagccagagtaggtgaggtgatgttctggagcaggggtatttaaaccagagggtttgtgggatgttaacttaatggataggcttcaaatgctatagagtagtccctcccttatcccatggttttgctttctgaagtttcagttaccccaagtcaactgaggtctgaaaatattaaatgggaaattcctgaaacaagcaattcataagttttaaattgtgtgctgttttgagtagcgtgaggaactctctggacgtcccacttgatcctgcccgtgacatgaatcatccctttgttcagcatatctatgctgtctacacctgcccgtttgtcacttagtagcctatttggttagcagtgactgtcatagtatcacagggcttgtgtccaaataatccttattttacttaataatggacccaaagtgcaagaataatggtgctggcatgtaatgatacttgttctattttattcattatttttgttaatttcttaattgtgcctaatttataaactaaactttattataggtatgttacgtataggaagaaaacaacatacagatggtccctgacttaacagtggtttgacttacaagttttttactttactggatgtaaacctgtcataataaacctgttataagttaaggaaggccgagtgcggtggctcacacctgtaatctcagaactttgggaggctgagtcaggaggatcgcttcagtccaggagtttgagaccagcctaggcaacatagtgaaaataacatttgtcattttctctacaaaaaataaacaaaattagctgggcattatggtgcatgcctgtagtctcagctacatgagctacgtgggaggctgagatgggaggatcacttgagcccgagaggttgagggtgcagtaagccaagatcatgccactgcactcgagcctgggtgatggagcaatactttgtctca

SEQ ID NO: 228608 - DNA, 338 bp, Homo sapiens
gtttgggaaggctactttgaggaagtgacatttaaggcctgaagagatattaggaattagctagataaaaagtgggagaagacagtttctgacctggagagcagcaatgacaagaatgagttttggggactagagaatggatggctcctgtggacggtgcatgagtggtatgacacctgtgtggtacgaaaccacaggcaaggccagatcaaacatgtcctgtgaacatcttaggatactcaggaagggagagataaatttcaggggagtgttaagaaatgggcctgggagttagacagggaccacttgttgaaggcttatatgccatgcattttagg

SEQ ID NO: 228609 - DNA, 338 bp, Homo sapiens
cattggcaccctctggtcttgtccccacaggacacccctctgtcatggtgatcaagacggctagggggcagggaaggcgagaagagggaggagacactggtgtgactcatagcaaagtaagagcttcttccctcctctctgcaccccaaatacgcacttttcctggaagggaacagctgggctgctggagtcacagaggaaatatttttctggctacgttgcacattccccttctctatgaaaattggtgccaccattgctaactgatggatggacaatgaggagactgagtcccaagatcacccagatacaataataattgtagtattaacatacaa

SEQ ID NO: 228610 - DNA, 501 bp, Homo sapiens
tatagtatcctgtagaattgctatccagtaggaaggctgtgcagtgttggtcagcatccaagcacctgaatggtggtttcttgtaggtctaacatggtataatgtggtagttgccacacacagcttcagtaacctcatttgtgggatcctgctgtagataaccttgacctccaccagtgattacactgaaggctgggtttgtagttgctaagaagatggttttcgggtccaacaaggatcccacctctgctctctgccatatgtatgatcttggactagtcacttaatcttgctgccccatttctgttttcattattgattgtagttgtgattgtcttgtgttatggtgcttcagcattggattcagcagccagcttcctagtacgaaggcaacgattacctccacagggtcccttccattgtcctcctgcatcattttcctccaacttgaataaatgttctacccacctttctcctttattttctctaccccctgtaccc

SEQ ID NO: 228611 - DNA, 407 bp, Homo sapiens
acacaatgtggacatctggcagagaaaattccattaggctgaactgtctccagcaaacagaaagctggctcctcagtggtgaacaacagatgaaaaatctaaaagaccacaagtctaatctcaggctttccactgccttgctctttgaccttgggcaggtctcttcctttctacatctcaatttcttcactgcaaaaggagaagtataacattgctattccttacagggaagtaacacacattactaaaagtgactataagatatacttcaaattgcaccagagaactaaactattaatacaaatatgacatcctcaaagggtagacatttcagctacctgtatcccttaaagaatatgtattaattaaaaagagttacactgaaaaaaatgtaccaattcttaaag

SEQ ID NO: 228612 - DNA, 578 bp, Homo sapiens
tagatagatagatagatagatagatagatagatagatagatatagatatatagatatctatagatctatagatatctatatatatatatatagatatatatatatatcaggaggaatagtagtaatattgtcatcacttctcaccctgtctttgataaattgccagttgaagtgtctgcttcatcactgagaaaagagtgtgttctttcctctctgaatccccaggaccagacatatagcaggtgtccaatgaacagctcagctgttgaatgaacaaatagattctgttaggccctacaaggcataaaagtaaattcagtctgggcacagtggctcatgcctgtaatcccagcactttgggaggccaaggcgggcagatcatctgaggtcaggagtttgagaccagcctggccaacatggtgaaaccccatctctactaaaaatacaaatattagccaggcatggtggcgggcacctgtagtcccagctacctgggaggctgaagcaggagactcacttgaacctgggaggcagagggtgtagtgagctgagaccacaccactgcactccagcctgag

SEQ ID NO: 228613 - DNA, 348 bp, Homo sapiens
tgtgcaataacaattcacccatggcctttactcaaacactgtcatatgctattattgtgtctgtggggtttgtcctcagtaagaagtgactgcaagatttggggatgtaagttccacctttgtgcaatacgttgcttatctgcctctctttcttggttctccacctctcagctagtggagaggtatctgccagctggctgtgcatgctgttggtggggggcaggcacagggctgatggctggtttgctctgccctttctgtgctgtgccttcttgctgttttctgtgtagttattgcacttgtgcttaaagggcatggcattttttgtgattaaaagtgtgatacaga

SEQ ID NO: 228614 - DNA, 405 bp, Homo sapiens
gagacggagtctcactctgtcgcccaggttggagtccagtggcacaatcttggctcactgcaagctccgcctcccaggttcacgccattctcctgtctcggccagcctccccagtagctggggctacaggtgcctgccaccatgcccggctaatgttttgtatttttagtagagacagggtttcaccacattagccaggatggtctcgagctcctgacctcgtgatccgcccgtcttggcctcccaaagtgctgggattacaggcatgagccaccgcgactgtcccagaagtaaatttctattgtttataagttacccaatctgtatatcttattacagtagtccaagtgaactaacacaagggcaaaatcccagtcttttaacaggcccttctgtctctgaata

SEQ ID NO: 228615 - DNA, 371 bp, Homo sapiens
gtgattgcttttttgcacagagaggcaaaaggttatccattcagcctaacttcagaagctgttaaagaatcagcaactagcagtggcttatgccttgtaatcctagtgacttggaaagcaggaggatcacttgacaccaggagtttgagatcagcttgggcaacacagcgagatgtggttttaaaaataaaaaaaaaaaaccaaagacttagtttggcctggtggcatgtgtgcctgtagtcacggatactcaggagctgaggtgggagacttgcttgagcccagcagttcgaggctgcagtgagttgtgattgtgccactgcacttcagcctaggtgacagagcaagacctcatctcttaaaaaaaaaac

SEQ ID NO: 228616 - DNA, 219 bp, Homo sapiens
gtagtataaaagaaagaaacagtgggaacgaaaagcagagaaagaaatgccaattccagtccaaagttttatttgccaagttttcttagaatgaattttaccagtttatgaattattgtaaacagaatgtgtaatggaaatactgaaagatttttccctagagtggccttattgactgctggtgtgatgccactgtaatgtaataaattattaagttgt

SEQ ID NO: 228617 - DNA, 491 bp, Homo sapiens
gagatagagtctcactctgtcgcccaggctgtagtgcagtggcacagtcttggctcactgcaacctccacctcccaagttcaagcgattctcctgcctctcagcctcccaagtagctgggattacagttgcccaccaacacacccggctaattttttgtatttttggtagagacagggttttgccatgttggccaggttggtctcgaactcctgacctcaggtgatctgccctctttgtcctcccgaagtgctgagattataggcatgagccaccacacccagctcaaatgatttctcttctaagagacttccctgaccaccctaactcaagtctccctgtcctcgttcttagttctttcaacttttttggatctcttcctgatacttctgatacttttttttttttttttgtgagatagggtcttgctttgttgcccaggctggagggcagaggcatgatcacagctcactgtggtctccacctcctggg

SEQ ID NO: 228618 - DNA, 536 bp, Homo sapiens
gcagggctgtgtttctgtctgtcacactttcctcttgttcaaaacacatgtatctcaagcagctatatacaaaactcataaaaattaaagatggtcagccagtgccaggaaatgtggaggaggagttggtcatagaatttccatggtgggacaagagaattacccatttggccttcaacgagaggttcccagagttgcatcctttcccttccctaacagctggttcatgtaggccttgtggtgctcattctgggagagggaagatgcgcccagaggctaggcggtgtgccctgggagccatgagaacccagccaagccaggtgaacgcagcttctgctactgcacgtgcccttattatcatctgagcaagttttttaagtaccctgcaggtgggaccaacattttatagccatgtttcaaccattaatgacttttaaaccttctacaatcttgaagatctttataatccatctttctcgtgaagtacccacaggcctttgcagctgacactctcagagcatgggcagaatcactgg

SEQ ID NO: 228619 - DNA, 401 bp, Homo sapiens
gggagtcaagtcaggccctgttttcaaggagacaacagagcactgaagactaacaagtgggtcccatccaaccagttgaaagcttgactagaacaaaagactgacccactccggagtaagagagacttccttctgcctgactgctttgagacccggacattggcttttctcagccttcagactcagaagtaaacactggctccatctgggtcttagactcggcctttggactggaactacaccattggttctcaggcctttgaacttggactggaactatatcatcagttctcctgggtctccagcttgccaacttaccctgaagatcttggggatcttgggatttattagcttccataatcaaaaagccaattttttataataaaactatctatcaaaat

SEQ ID NO: 228620 - DNA, 542 bp, Homo sapiens
atgtaattgccatgtttccctcgtaccctttcatctagaacattctctcagtcttgtctggtcttaagactacagtcccttttttcataacaaatgtccctccttttggcatctgtctaatgtttcctcctgaatgcattcgggtaatacattcttgactggaatactacataagggatagtgtgcccttctgagtacatctcaactggaggcatgcagggtgcagttgcatctcaccagggatgttaagtttgaacttaaggtcaaggtgttgtctgattttacctttgtttagttactaattcttcccttgcaactaataagcaatgtgtagggaaacactttaaaacaatgctctcccccatcaaattttaccccctaaatttagcacactttttgattcttgtgtgaagcactctacctccaatggttataaaatgactttccaaatctggcacccccttccttcttgtgaacttactctactgacagcggttggcattccactatacatagagccctctcttttccctgtttgtgta

SEQ ID NO: 228621 - DNA, 516 bp, Homo sapiens
agcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagtatttgtgtaagtgtcctctgccctggacaccggtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaa

SEQ ID NO: 228622 - DNA, 2047 bp, Homo sapiens
aggcatatcacttctctttttaaatctcttagactctcctgcacacaggaaggaatctaaggtttccctatgggcaccagactccatgtaatctagtctttggccacctctgatctcatctgctaaaatcatttcaatctctccttactcagtccatcccaagccatccctggaaggtttcatcccaactggttctcacatccagtctttgcacttcagctgtctgtcccttgaatgcttccacaaaacatagcaggggaactattatttaggcctctgttcaagtatcacctccttcaagtggtctttcctgactgtccactctaaggagcctcccttctgtcaccatttagctgtatttccctttacttacagcaaaattgtaactagataatgcattacatgtttttctgttgcatgtatattctgtttctttctcataaatgtaaaccctcctatggcccaaatcttcatttgccttttcaactcctttatctccagcatgtggagcacacttggtacacattaggagctgaaatgctccatagctgctgaatcagtagcaccaacatgtgtacccaccaccttctcaagtgtggctttataagatgttcatcatggttgagtgaggataagggaaagaatagtctgtttcttttatgatatggtttggctgtgtccccatgcaaatctcatcttgaattcctatgtgttgtgggaaggaccctgtgggaggtcattgaatcacgggggcaggcctttcccatgctgttctggtgatagtgaataagtctcacaagatctgatagttttaaaaggaggagttcccctgtacaagctctctctctttgcctgctgccatccatgtaagacgttacttgctcctccttgccttccaccatgcttgtgagatcttcccagccaagtggaattgtaagtccattacacctctttttcttcccagtcttgagtatgtctttatcagcagcctgaaaatggactaacacattttatgattggtgcaaattggctactgataaaaatcctgatgataggaaaatttcaaatttccttatagtaaaaatactacttaatttaatttttagagacaaggaaaaacattttgcagagtttggctccactattgaaaaagggatgctttaggttgaaccattgtagcctcagattctatcttttcctaaataaacacattaaagcctcatgtgtgaaattattttttaaaaatatttatctggatttaaagaataacagatcaacagatacctctcaatgtgtttgctaattaataaaaatcagtttcttacaactaatgtttgtaagaaaatgttcattttaagtgctaaatagtgaagaaaatttatcacctaaaatacacccatcaatataaggcaagaaaaaatcttaacatgcagccattcgcttttgccatgccctgtcctgtttacttcttaagaggtttatttttgtacttttgcagaataaactttagtaatctagaactggaaggtactatatatgtatgtgtgtgtatatatatatataaaagaaaaacatatatatatttcaattacttgaaatgtaaaaacttaccgaatacaaatggaaaaagtgatgtgtattatatcatattgctttttgtccatctttgtgatttatttactcacttcatgtttttcatttacaaaattgtcaagctagccaaaataattcttgttttcttaattgggagagaagagacctgacagattatctatactcttcatatgttaaaagaccatttcctgtaaaactgacctagtgcacaaactgaatttgaaatagactgtgaagtaaactataacttgtccttttaattttgtttaacatggttactgacttacatgatgtattgaatatcaagataaagaaaaatgtgtctaaaagctaattagaattctctgggtcaccaagtcaaggtgctattgatctgggttaatctgagtaacttattgtctagcctataaataagttccaaaatatcgaattc

SEQ ID NO: 228623 - DNA, 1330 bp, Homo sapiens
ttttttttttcctgtgtcagcaagatcagtcttcatgaaatcctgctaaattccctgtgaaatataataagcttaagacattttagagaaccaaatgctgtttatgatacagtttagtagagttgtaatatatttcagcacagaattttagaatactatgggggctgattttcaattttgtaagagaaattatgagcatagtttatatagtcttttatttgtaattgtttacgtgatttcagaagtaatatgcttaagttattctaatgtttttaaagctagagagtctgaaaagagggaagaagaaagaaaagtgtttaaattgatctcttttgaatttaaaatgcatattaagtataactagaacataaaatgaagaatttaaattctcatcttattcctagaattatacctataatatgtatcattacttataacaattcatattttaattttgcatggcacataatctcttctgtgagttggatttttaggtggtgggaatttaagcataaattctcataactttcttggggtcaatttaatattaataagtgtagtaagtaataatacccagcttgagacctcatgtacttgttgcatttggatttaaagctcatttcctatagaagagctgtagaaatcagtcatgtagtttcataaactccttcatgcttgttaataattttcaagaatcttaaaataaattacaggaatattgttatgaagtagtagaagcagtatggtataggggagaaagtgattgtagttgggatctgaggatagtctttactttgctattaactagctgtgtgaccttgggcaagttgcttatctctgcttcagttccataaactaagaattacagagctgaaccggatcttggaagcaatctagtacaaacctctcattttacagatgaggaagcagataatttgcacaggctttcactgtaagacagttgggcccaaaattcagttttctgactctcaggttggttttttttttccattatactttacagcctcttttcatctgtaaaatgagagcattggattagaggctctcaaaggtctcttccagctcaaaaatattgtcattcctgtgacattagtcgtaatataatttattaggggaaagtttgtagcttttatttattggtgaaagaaatgtttcttgaagaggcagtataacctttgcaaggttatattttgtttttttaagagaatatcatcaggcgaggtgctatgtctcaggcctgtaatcccagctttgggagaccaaggcaagaggattgcttgagtccaggagtttgagactagcctgatcc

SEQ ID NO: 228624 - DNA, 166 bp, Homo sapiens
ccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagtt

SEQ ID NO: 228625 - DNA, 213 bp, Homo sapiens
caaaatttaagtccccaaaccttgcccttcctcccaacccaaatgttctgagcacaagagacccaggcgctctgagggggtaagagcaggaaaggcacctcagcgccacgatgcagagcatggcttgctgacgcatgttgcccatcaaaatctcagtggattcttcaagaattagtatctagaaaggccaggaaacaaacaaacaacaacaaa

SEQ ID NO: 228626 - DNA, 350 bp, Homo sapiens
atttgactcacgatgtttccttcattttcttgtctgatgagcccacatctttgaggttcatgcaaacacccagttctgggaatgagattctgtgtgccattgcccatggggaaatgactgctaaccaaattcttaatctccaccaattattaaaaggcagttctagccattaaacattgaaaattctatttagacagactgttaaaaaaaaaaaacagagacacttttcatattggcttttcttattgacctaactaaacactcattgcagtcttgttccaaaactatatcttccattagcacaaaggaaaacctgttcttatagttcatgtagtagggtatggaatata

SEQ ID NO: 228627 - DNA, 568 bp, Homo sapiens
tataataaagtatggtcccaaactgggaacaatgcaaatttccagtaccaggagaatgaataagcaaattgaggtatattcatgcaatacaactcaacaattaaaagggacaaattacagatatgagaaagaatgtggatgaatcctagaaacgttatgttgaacaaaagaagccagacacaaaatagtacgtactttgattccatttatgggcatacagctaagctatggtggtagaaatcagaacagtggttgcttcttgaaggaagaattgattgaaaaggggcataaacgaactttctgggatgatagaaatgttctgtatcatagtagggatgtggattatctggatgtatgtatttgtcaaaacagatcagacaacatctgtgcctttcactgtatttaaattataaatcaatttttaaaaaagtaatggaatagtatatacaggaaagagtatttgcttagaaactagatgtggtttctcgtcttgactctgccctaaatttatatatgccttgggcaagttcattcaatcagtcatttgttcataatgtatttaacaaag

SEQ ID NO: 228628 - DNA, 462 bp, Homo sapiens
cgcctctgctatcgttgggaggttgtattttcatgattccttcaataactgcagcctagcattttacttcaggaatatcagtattccttaggaggaacatccttatcagcgggacatcagcgccacagcacaaggttgcgaaaaagagactgaggctcaggctgtgtgaagggaacagagtgctgggctccccgggcagcccacattggaagggtgggctctttccatgtttcaggaaagacctggccctcgggggcgcatcaacaggtgtgtggacagatggaagaggctggaggttacctcacagccgagagaacagaacaaacactagcttgaggaagacgctgaggcacagggcggtgaccctggaatgtgaaacagaggattcaatgcctgcgtggatctaggactaagaactggatctgacactcagcattaacagaaagccaggtttttcttaaa

SEQ ID NO: 228629 - DNA, 480 bp, Homo sapiens
cacctgtatcagtaatggacttgggtcttctctagatgttacttgctcacttttatcattcatctactcacccaattaaatatctactaaataaaattatgtgaaagggttcagcctagtggctggcgtatgagcagaacaagtgttcatctgtactacagacaaagcataggtctctttttttgtgtgggtgtgaggttattgggttgaccatgataatctctcaggttccttttgttgcagaaacccgctgctcctaggccagcttcttctctctcctagaaggcgagaattgggttcctggctcattttccctgcctgtgcatcctgtcctctccccacagcctaatgcctccaccagaagttactccacagaagaagaaaagttaaagaataagtttttcattctctagggtttctaggtcccagggaacatccgagggggcatctagtcaaagagcacttttatctagggagaaa

SEQ ID NO: 228630 - DNA, 566 bp, Homo sapiens
gttgtttgtaagttatatactttaaatataaaaatgtatatccataaaaggaatatttacttggcaataaaaaggatgaagtactgatacatgctacaatatgaatggaccttgaaaacatcgttaagtgaaagaagccagtcacaaaagagaacatattttatgattccatttatatgagttgtccagaatgggcaaatatctagaagcagaaaggagattcatggttgccaagggttgtggggaatagagtttctgcttatgaacaagaagtttctggggtgatgaaagaattcaaaaatagaatgtagtgatggctgctctgggaactctgggaacatactaaaagccatggagctgtacacttcaaatggttgaataatacggtataagaattatatctcaataaagctggaagggtggaaaaggttataccatgctaccactcatgaaaagaaagttggagtggctgtattaatatcagagaaagtagatttcagagcaaaaaatattatcaggacaaagagggtcgtttcctattataaagaggacatataaccctaaat

SEQ ID NO: 228631 - DNA, 201 bp, Homo sapiens
agtagtggcatttgtgtctgtgttgtccaaagtctgtactttgtatataatggacaggaataatttttgtcacaaaaatttttaagaggatgaagcaggtttccaaacagcatttcggttacaaattatgtaaatgcctgtatgcacttggacaaaaagcttgagagatgttaacggcacttgtctctcggtcgccagctt

SEQ ID NO: 228632 - DNA, 803 bp, Homo sapiens
agtgacaagaaagacacttttcctctgtggtattctctgcaaaaccccataatcccagtctaatcgtgagaaaaaccagtcaaatacagaatgcagtggtggatattctagaggatacctggctagtactctcttaagattgtcaaaatcatcaaaaatgaggaaagaatgaaaaactgtcatagaggagaagagagcaggaaggtattagtagtacaagatggtactctagattatggaatatcttaaggggaaaaatgataacattctagtaaaatctgtaatgtaattaatagtaacataccaacgctggttttggttttgagaaatatacacacatggcaatttaagatgctaatgactgtagaaaattagtggggatatatgagaactgtctgcacaatctttgcaacttttctttaaatctaaagttatccaaaatagtgtttgtctaacctccctgactataattggctgaaattatatattctctaccaaattaccagactaaaaaatatctgactatcgggcttaacaatttcacatttattttctcaaaagagttttggcttttattacacataatactgaaatttcccatcatgtttgggggtgaatccctactttgctattcctgtggcttccttgggcaagtttttaatttccccgtgctttaaccctccttttcgcaaaacacaagatatgcaagagtatatactctcacaagatcatagggagaattagataatgcctgcaaatctctctctctctctcacacacacacacacacacacacacacaca

SEQ ID NO: 228633 - DNA, 385 bp, Homo sapiens
taagtcataaaaatggaaaattcattcaacaactctagtctccttagtgttttacattgtatttcccatggaattgatttgctttatgttaaaatcatatcagaaaatccatcttctctgacaagagcaggattcagttgcacagaataaacaaatatatcttttaaaatagttttagaagagtatatatattatcataaatgaaatcataaaccacccccctctgcattcacatagaatacagacactaggttgcataattctaaaataaactctattgatttttagttagagtttgaagttagctacagggaattgcagaaggaagcattttaaagtacctttactgacagaccatctaactactttgaatattttatttaaa

SEQ ID NO: 228634 - DNA, 627 bp, Homo sapiens
gagtgggaaacttttaaatataaggaaattcggcttacctacttgacagtgtttgctgtctctctctctctcatcccctaagtataccagcaggcagcctccttaaagttgtttcaaagttctgtgttcttgagattatcaaatgatattatttaaaacaaaaatccttctagaaaacttcccttatataatgaataattacttagtcattaaagggtagccagagatttcatttaacatggcatactgaataaaacagcatattctatctaccacaaattaggtagtggctttacttagtatttactgatgtatggtttcatatattatcttttcagtaaaagatttatataatgttatttcaaatacctggatgtttgtgttgaatcaaaaacctgtgtttttgagagagaattttttttacccttatgatagtttaacccatcctcctaaaattagccccatcatggttacctcagccctgtcctcatttttattatatatttttaaaaagttttttggttttgttactgtattcctaaatacaggttgagtatccctgagctgaaagtttgggaacagaagtgtttcaaattttagatgtttttggatcttggaatattcaaa

SEQ ID NO: 228635 - DNA, 1145 bp, Homo sapiens
tggctgggggtctggcaggaatgggaggcatccagaacaagaaggagaccgtgcaaagcctgaacaaccacctggcctcctacctggacagagtgaggagcctggagaccgagaactggaggctggagagcaaaatctgggagcacctggagaagaagggaccccaggtcagagactggagccattgcttcaagaccatcgaggacctgagggctcagatcttcacaaatactgtggacaacgcccgcatcgttctgcagatcaacaatgcccatcttgctgctgatgactttagagtcaagtatgagacagagctggccatgcgccagtctgtggagaacgacaccatgggctctgcaaggtcattgatgacaccaatgtcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtccgtggaggttggagctgctgagatgatgctcacagagctgagatgtacagtccagtccttggagatcaagctggactccgtgagaaatctgaagcccagcttggagaacagcctgagggaggtggaggcccgctacaccctgcagatagagcagctcagtgggatcctgctgcacctggagctggcactgacttgggcagagggacagccaggcccaggattacgagaccctgctgaacatcaatgtcaagctggaggctgagattgccacctaccgccgcctgctggaagatggcgaggacttcaatcttggtgatgccctggacagcagcaactccatgcaaaccatccaaaaaccaccacccgccggatagtggatggcaaagtggtgtctgagaccgatgacaccaaagttctgagacattaagccagcagaagcagggtaccctttggggagcaggaggccaataaaaagttcagaggtataa

SEQ ID NO: 228636 - DNA, 640 bp, Homo sapiens
gatgaatttgaccagagtcattatttgtataatattaagaaagtaactcagggaaatatttgtttgatttccaagtaaagaagacatttccaagcataaaagcaaagaaagaggcgtaaaggaatgactgatagccctgactacataaaaatattttagtatagtatttaatgatgaagaaaacccttcatgacatgttgctatgtttaaaaaaaaaaccagcatggacaatataattcaattttgcaaaatctgtgtctgagagttatatagatatatacctgaaaaaatgccaaatgttaagaggataggatcatgggtaatttttattttcttctttatgcttttctgaatttcccaaaattttctacataaaacatgtcaaaaatgactatgtttttaaaactaaactcagttacacttgagtcatatatttctacaggtttttagaatcagcagttgaattctatttaattcagtggcagaccaaagataaagcaagggcttgtgaaaaaaatgtttgggactaaaatggcctgaaatggaaagttctcctagacattgaagatgtataatatacaggtggatctaatctgatcctgttacagaaaggcagcagtacaaaaaaaaagaaagaaag

SEQ ID NO: 228637 - DNA, 429 bp, Homo sapiens
cagcccctccatggagagtatcaaagagatgctctctgctcctttcaaaggagtattgcttgtggcctctcattgattggcactacctgggcagaaataggaaaacaggggttttctgcccttctcaattcaatctgctcccttatgccagttattttgttttaaatctgcttggcaccagagttataatattgccaataaaaataatttctagaccagctaccctggtcagctcagaatgctctcctcaaaactaagagacagacaagaggagtatctcagtgaacaggaaagagcagacaagtgcaataggaaaagggataaagacaaatcaagctcttggtttgattataggattagctttggccattggatttattgactttcaatttggatcaccatatggagggagggagggagggaaggagg

SEQ ID NO: 228638 - DNA, 383 bp, Homo sapiens
tgaggtttccagcaattcagttgaggctgctggccagccggggcttctgttattggtgcccacaccatttggttggcccctccaggagaaaggcctgaggagcctggggacttgtacgatgtagcttggtggccaggagggtgggtgcctgtgtcagagcgcttgagccagatcctgaatctgctactcacaaggagtgtgagtctggatacattgataaacccttctgtaaatgcaaataatttcttaatctgtcaaatgtgaatcataattgtacctatactttattggatcgtgggaagattaaaagggttaatatatggaaacacttaatacagagcctatacgtaataaacacccaataaatgtaagcttttaatatc

SEQ ID NO: 228639 - DNA, 371 bp, Homo sapiens
atcaccatggcacatgtatacctatgtaacaaacctgaacactcagcacatctactccagaacgtacagtgaaataaataaaactacaaaaaactagccgggagtggtggcgtgcacctgcaattccagctactcaggaggctgaggcaggagaatcacttgaacccgggaggcggaagttgcactccagcctggatgacagagcaagagtctgtctcaaaaaataaaaataaaaaataaatgtccccttcttgtcgtaatagccctggcagtcctgactggggaaaccagctggaaggtggggcctcctgggagaccaagccctgacccaattatagatggaagcccagtaacagctcatccctttaaaa

SEQ ID NO: 228640 - DNA, 843 bp, Homo sapiens
tttctgtttggttgccgccctaacggccagaactaaagcaccttgcaaggaatgaagttggttcttgaagtccgtgctgactggctgggcgcatttgcgcatttgcttctctggctgcaaaatggcccgcaacagcactcactaatttgttgctaacttcaggaactgtgcggacaggtctctgaggcttctgagccgcgctatgtccagtagatctgggcgcctcagaacctgtcacagccgacggaagcgtttatctgagtttcttgtttcttcccaaccttttgattttcgcaccattacgcgctcaactatgcctcttcttttgtcctatggtctcaactaattaaaggaagaaaagcaatgcatgtgtgtgtgtaattttaaagaaactatgctgtcttatagaaaaccaaaccatcatttttatcttttgtaccaggtattcaagtatgttttgagcaccgacgggctgtgaactggactgtgctgaaagctcctctccctcttctctctttaagccctttatatttgacatcagcttcccccacattctccaaagcttctctcacaaataaagccaggtgctcaggctgagaagattcaaggaaagggttcctcacgtagttatacagttgtgttccaggggaaggaaaatattgttcggttttgttctgcaattccccacggtggttttcggtaagacttgagacttccttattctaaagtccaagcagcagtggaaacatttcaagatccctttttgcaatataacttttccaaagattcaatatttatttaaacccaaaaatcttgtcactcgaagtaaaacgattttctcca

SEQ ID NO: 228641 - DNA, 446 bp, Homo sapiens
tacagatccaaaaaccgagtctcagaaaagcagagtggataagagcccaaatctagtaactaagaattgaaaaggaggaagatgagcatgagcacatgaacgaagagtgtagtagtagagggaaatgaatgaaatctcaaccctaagcttgaagagaagaaaagtgcacgcgcagatgaaacagaagttcaagacaccaaaattcatttactcatatgaaagagaaagacagaactgggctaattttaagaacctgaaggcaaggccagcttatagaatttaagagtactagtcaaagtttccaggccccccaacagcaagcaattttcagttattccactgttatttataattgactcgatggcatagaggtctacaggtatcttttagagaaagtatataattattacagtcaaaattaaaagttggaagtcaattggccatgt

SEQ ID NO: 228642 - DNA, 503 bp, Homo sapiens
ctcatttgaatctgccttctgagagttatttcatcaaaaccatatttctccttgcacttgttcctatgtgaagcagacagttacacctaacctttgtaaatttagaaaataaaaattgcatttgagtagaaaaagcatttggtaggcttttcaggctatttaacttaattatttccattaatcctctgtatatttctaatgtatttacacatttccttaagagttttacagcatctcaaataatatcattgcattttggtggatgttttactaaataatgtctgtttgttatcaccttaaacaatttgtcatgattcaatttaattcaattgaaatcaaattctcctgaaattgtttatgtaaaagattatcaaatattttatccatcctgacaagtggtttattatagttctacaatttatgggtaacacacactagaggcttggggaagcagggaagcagcaggaacattaaaacattaaatacctgttataattctgtct

SEQ ID NO: 228643 - DNA, 443 bp, Homo sapiens
aacccaattagatttgctaatttgtggtatttgtgtgtctcctgtacagacattttctcatttggattcctgacacttggtaaataaaattactattattgttctcttgtttctttgaatttggaattcctggaacacaggaaaatttgatacacgtcctaaaagaaaaagaggagaacaaactgagtgctacttaatatgggggcagcacagtggctcacaccaataattccagtgctttgggaggctgaggctggaggattgcttgaggccaggagttccagaccggcctgggcaacatagcaagatcccatctctaccaaaaaaataaaaattagccagggtggtggcatgagcctgtagttctagctacttaagtaggttgaggcgggaggattgcttgagcccaggagtttgaggctgcagtgagctatgatttcttc

SEQ ID NO: 228644 - DNA, 487 bp, Homo sapiens
atgggaaacgatttcctcttcttcctcctcagtccagcctttactaatagctcctcaatacatctgggctctgttttggcatctgagccacggggggcatcttggggtgtggaaggagcttccactgtgatggctgatctgggcttgaatcccacatctgccactcactaacgagtggccttggtcaaatgagataatctttctgggtcttagttttcttatctttaaaatggaggtaataacatcttcctcatcaaattaaatgagaaaatgcatgtgaaattcctgacccatgataggtgctcagtaaatgctacttctttctttccttccacaagaatgaatgtaatcaatttacgaacaggattctggactgtgtttggcatcatttacatgctgccattacacaaacaaagatgtttgagcctggagttggcactactttgttgtaaactgaagttgtcattaaactgaaatgaacacagta

SEQ ID NO: 228645 - DNA, 412 bp, Homo sapiens
agttggctgatgggaggagtctggaatgcattagagccagagctgctgggggcaaggctgtggctctgctgggccacttggggcaacacgctcttcctctctgagccttggttttctcatttggaaaaagggaagtaaaaaagaaaatcctaccccagcagtttgggatgccaaggtgggcggatcacctgaggtcatgagctcgagaccagcctggacaacatggcgaaaccctgtctctactaaaaatacaaaaattagctgggtgtgatggcggatgcctgtgatcccaggtacttgggaggctgaggcactagaatcccttgaacccgggaggcggaagttgctgtgagccgagattgcaccactgacctctctgagccttggttttctcatttggaaaaaggcaagt

SEQ ID NO: 228646 - DNA, 570 bp, Homo sapiens
atgttattctttctacgttgtaacctttgcaagtatagcatttgaagtttagttgccagtgatgtgtgtctcaattcttcttgaagtagatgagattcacttccttcctttaaatatgaggaagccaaggcaaggagaagaaaagtgaattaactaaggagagaaagctaagagcaaagttccttgctgagtttaggataaagagacagacgaggaggaacccaattactaggggacaccattaggatgaaagagcagaagtatggaaatgggaatggggaactgtatccacccatagaattgtcaacaggtatgcacgtagcatctgcgattccgggagagctgacaggctaggagccagctgtagcttacacttgaaaataataataatatccacttaggggtatggaattatttatcaccactggtggaatttttgccaaaggcaagaaatgaaaacatccgatgaaaaatgtcctcagtccacagcccattacactgacacaccgtacaaactgattaactctctggccaagaataaacagtactatagttactactaaaaaaaaa

SEQ ID NO: 228647 - DNA, 520 bp, Homo sapiens
atgttattctttctacgttgtaacctttgcaagtatagcatttgaagtttagttgccagtgatgtgtgtctcaattcttcttgaagtagatgagattcacttccttcctttaaatatgaggaagccaaggcaaggagaagaaaagtgaattaactaaggagagaaagctaagagcaaaggggacaccattaggatgaaagagcagaagtatggaaatgggaatggggaactgtatccacccatagaattgtcaacagaaatgttaatgtgttcaatgacgatcaagccccaggctctactgagcattctacataatgtacagtatattgcatttaaaattttgcaaactcctgaattacaaaatacatttggctccatgtttgaggataggcaattctagatctacaaaagaaaaaatggacaaggcaaatcagaaagcaagcattattcacgaaagccaagatatggaaataacctaagtgtccatcaacggataaataaagaaaatgtgccacacgta

SEQ ID NO: 228648 - DNA, 475 bp, Homo sapiens
cactgcagcgggatctgaacagtgtttcgcctccgtgtacaactggactcctgcgtgcctgcaggctcacactgcttctccctctccctcctaggcactgctcaggcctcacggccgcaatcgccccatctcgcccatgccagtcttgctcctcccagtcactctgcactcactccccggccacctcacagagttaagtggcatctacatgctgagggctgtacatctaagtccctggccagacctgtctctccagacttgacactccgcttgtttgcatgatacccagccgaaacaaacatcatcttcccaaaactgcatctgcagacagtttcctatctaacctgcaacaacccatccttccaggaacttccagtcgccatcctcatttcctcacacaccccacattcagtccaccaggaaatcctactgacccagcttccaaataaactctatccgggtttgaaactttgtc

SEQ ID NO: 228649 - DNA, 524 bp, Homo sapiens
cagagacagatgaggtggctcccagagtcaggtaaggacaacactcgaagaggggtgcagctgagaacagcagctgggacaggtgcttcatatcgctaaaggcacctcaacagaatctgctactgataaataattttaattttcttttgagctgtttaatttttaatcttattgtgaataatttcaagtacataccaaagtagaaagaatagcacagagaactctagtacacacacgcctattatcagtaagaatcaacacgtggccaactttgttctgtctgtgagtgttgagttcttagataacagagcttgtcattctctgtatgataggaacaccaacatacatagcataatttaaataattattttaattgaaatattctagttaagaaacagtttagaatactagagagagacttggatttatgatataatgctatgatcctttgtagcttaaaacacattgtaattttctactaaatgtaatatagaataaacagtttatgttatcaaatgcattca

SEQ ID NO: 228650 - DNA, 458 bp, Homo sapiens
agtcctttagcgaactcacactcccacctcgaatgtttgctaatccaaacagaaggttcttaggatccccatggccacaggtgggtggtgctagcatctgagcaggtggaagggctcgtaggactcccatcaatcaggaagagcctttgattggcactgctgagccatttgggctaaaatgttgttaaccaagtggatgggggtggttctttgtgactgttgctccactatataaatgtactgagggtctacccctttctggacaggctgctgcactcagtgggcaaagtactggctggagatcaggagccataggtgcttctgccaccaccatcgggggtgcttggatattcaactctcccctagggctcagttcttctgtgcaaagatgaagagagctatgctgcctcaagttacaagtttcttcaaataataaaagcaaatgccgtatttactta

SEQ ID NO: 228651 - DNA, 294 bp, Homo sapiens
tcattatcgggggaagccactgcaccacaaacccagaacaggaagctgaatgacaagctgaattaaaacaaaaagcccttgaaaaatacagacaggacgatccaaacaaaaaattccataccagagttggaagctgagccaaacaaatctttcataaaggaaagtcaaaagttaaaaaaacaggaggaaaagcaagaacctagaggacattccagagtgagaactgaaaaaacacccaacaaaataaaacaggaaaaatattatcacagaaataacataagaacattagcaaga

SEQ ID NO: 228652 - DNA, 707 bp, Homo sapiens
tggtcttgaactcccgacctcaagtgatctgcccgccccggcctcccaaagtgctgggatcacaagcgtgagccaccgcacctggcccttcctctgaggccttcgtctccaagaatccagcaaagtgacaataatgaaaataatgtcactaaagggccagcaccacagaagaaatctcactggaacacctgacttcaagtgtgaccttgaatctcactgagctctcaaatgtaactgccagttccccaaaatgtgaggaactgagaaacaggtaaaatgacatcacatggacacagccagccccacacaaaccagaaaaacacacggagcaaaggccccagggctcctgcaagttaaatgtagaaaccaccaactgccctcatacaaacaagcaaactagagaagaaaaccccttttccacagtggaaaatcagttgccgggcatgctggctcgcgcctgtaatcccagcactttggaaggccgaggcgagagggttgcatgagtctaggagttcaagcccagcctgggcaacatagcaagatcccatctcttaaaaaaaaaaaatgaacgaagaaaaaaaaattagttgggtgtggtggtgcgcacttatagtcccagctactcaggaggctgaggtgggaggatcacctgagccgaggacatagaggctgcagtgagccaggctgcactccagcctgggtgagag

SEQ ID NO: 228653 - DNA, 426 bp, Homo sapiens
tctatgtgattcttggaggatgtggtcaaagatttgggttaagtagccactaaatcacatggtatgcaacatgctcttgctctttctcatgatgccagcccggagtaccatgcagcctaattcacctactagtccagccagcagatgctgccctagactctgccagccttatctcattttctccagatcgtgcctggctctctggtggctggtgacacacccatctgcagaggtatcgctacctgtcagagaacaacttcatccataaggtagctcagcagtgccccttcttctgctcagggcagccaggggtgggaggaggctgctctcttgggctgcccatctactctgggcattgatatctcaagtgcaaacctggctaactccagcttctttagatcccttccttatcaacacctgaagggg

SEQ ID NO: 228654 - DNA, 625 bp, Homo sapiens
ctaacccctgtgtcatgagttatcacgttaaaagtccatagaaaaaattttttttaacccagttctttttgtgtatatattttttgccttgataatactagtttattgagtttgccgagtgacacattgccaaatcttatgccctatttttaattcctcagatacatgatctttctgtatagtcttagacagtctttacccctagtctgtttggatgaagagcttggtagagaggttgagtttgatatctaagtgtcagcggcatcaaactcggagccaggtattatgataaagtgctttaacatattcagtgaatccctacaacaggctgaagatgttatttttatccccattttttagaaaactttattcagttataattgaagacctctacgctgcacatatataaagccgtaagtttggtttgatcagttttgacatatatgtatacccattaaaccactactacaataaacataatcttctgtcaatcccaaaagttttcttgtgccctttgtaatccatctctctttccaacctcataccgaagcaaccactttctgtcagtagagactagtttgcattttcttgaatcttaaataaatgaaatcattatccccacaca

SEQ ID NO: 228655 - DNA, 304 bp, Homo sapiens
ctgagagaagctttcccactcactgtagatgaaagtagggtcaggagcttctgaggatggactcctgtttggtggaaaggtccccggagccacagctgtaacccctcttgatactctggtctgccctgagaggcgtggaaagcaggggccttcacccaccgggccccacacaccagaaccccacacagcgggcccccacacaccagaacccacacagcgggcccccacacaccagaaccccacacagcgagtccccccacaccagaacccacacagcgggcccccacacaccagaacccacaca

SEQ ID NO: 228656 - DNA, 506 bp, Homo sapiens
agggcctttctctgttgcccaggctggagtgcagtgaggcaatcttggctcaccacaatctctccctcctggattcaagcaattctcctgcctcagcctcccgagtagctgggattacaggcatgcaccactacacccggataatttttgtatttttagtagagatggggttttaccatgttggccaggctggtcttgaactcctgacctcgtgatcagcctgcctcggcctcctaaagtgctgggattacatgcatgagccactgtgccctgccaacttgttaaatttttaatcattctgctcaccttttgcaaccttactgacttttgtgtctaccttatctagcagtggctgaaatttccttctatgattatagatttgtctgttatttcttatagatttctcaatattgcttgtattattattttaagttaataccattaggcataaaaattcaaaattgttatcgcttactgaataaataaatcttaatctattatcaagt

SEQ ID NO: 228657 - DNA, 561 bp, Homo sapiens
agggcctttctctgttgcccaggctggagtgcagtgaggcaatcttggctcaccacaatctctccctcctggattcaagcaattctcctgcctcagcctcccgagtagctgggattacaggcatgcaccactacacccggataatttttgtatttttagtagagatggggttttaccatgttggccaggctggtcttgaactcctgacctcgtgatcagcctgcctcggcctcctaaagtgctgggattacatgcatgagccactgtgccctgccaacttgttaaatttttaatcattctgctcaccttttgcaaccttactgacttttgtgtctaccttatctagcagtggctgaaatttccttctatgattatagatttgtctgttatttcttatagatttctcaatattgcttgtattattattttaagttaataccattaggcataaaaattcaaaattgttatcgcttactgaataaataaatcttaatctattatcaagtggaaaaaaatattaaaaaactgataatggcctcggttggcctcagcggcggaact

SEQ ID NO: 228658 - DNA, 583 bp, Homo sapiens
atgtctcaaggattgtgactttatagatataggggatggtgagttactgactgaggaaatgtaatgctcaggagaaggaggtaacattaaggcaataaataacagtaactccgacagcaatgattatgtttgttcatcaggtcctttcctgcctgcactgtgacaccccaaaagtcacagtgattagctaaaagcagctgaagttttcatggtcccaatcctggagtgaatacttgataagtgtcctcaaacatgagtgctcctgagaggttcaggcaggaattcttccagggcacttcattcctttatgtctatttagtaagtggaccccactgatttagggcttctcatcctaggtagaaagggtgactttttttttttgtcttcagcagtaatggttagattttgcatcgctgcatccactcagtcacagagggtcactgagagcctattgtggccctgtctttagaattgctcaaaggcttttatgctttccctttctgctaagctctgaccctgttttaggatctggcccttcttaaactgtcattcacagagaggtcttggaggagtcagagtcctt

SEQ ID NO: 228659 - DNA, 473 bp, Homo sapiens
cgcaagtctttctttcggggaaaatgaaaaggggtcaagatttggaccagatgacacccaatgtcccattcaacggtcgcattctgtcatccacaggaattagtcctgtatccgaaacattctctggtagtcaaaagcttataagcacaagatgtgaaggaggccacacttaaaaaaaaacttgaaatggagtttcatttggaaggacactgactaaggaaaaacagagaaaaggatgaaacccaagccaactctgcaactctattaaaaacaccaagacttcaatataatctccttaaagggaggcagtgcattcttcatggctagagcttcagcagctatctagaaccatatggtggaagccacttactgagaactgtgaaacaagagcctgggtccctgacatatgaagccaccatacctaccttaacctctctttcacttgagggaaaaatacatctttcttaggtaaa

SEQ ID NO: 228660 - DNA, 412 bp, Homo sapiens
cagatgtataggagaaaatttatcacgtagataatgaggatattcagagactaattagcacctttatatgttctgccttaagctgattacatgatctgagtcagatatactgatttgatttctattgttttgttgtgctttatactccagtagtttgagtaggtgagggaatgttctccagttctgtgccgttttccttgggagattttcatctcccacttctatccattcttagtctggtttgattgtcttggatggtttttctcattcctttttgtttaaacttgggaaagagactttgattttgtctttaaatttttgtgttgattttaatataccaactgcttgctgctttgggcgtgtatctgaaatctaaaaaacattactcaacattttatttattccaacattt

SEQ ID NO: 228661 - DNA, 526 bp, Homo sapiens
tttagttttatctttgttacctctttaatcataaatgctctttcataatcaactttttaatttccctctctatgcttcgtgttagacttaatcacatcattgcttttgttacccaaaatggcggcatacaggtggattgaaatggaatcaaatacaaagaagtctgcaggattttcatgggagttgcacaggctctagggacaacagcatggactaaaaggcactgaaattaccccaaacacaaagagatctgcaggcttccagattatcttggggtaggggcagactgggaaatctacccagccactgaaatggctcctttcttcagaaatccagatgccacataaggtgatggagaagaaaggacatctcagagtgtgaacccaggagccatgcagaccagtggactgaggaatgactctgggggtcaatgaggcccaaatcaaagtgcaatgctctctcctggaggtgccagcatttgccctgtggatttcagaattactaaagaccagtgactgctctgtgc

SEQ ID NO: 228662 - DNA, 522 bp, Homo sapiens
tttagttttatctttgttacctctttaatcataaatgctctttcataatcaactttttaatttccctctctatgcttcgtgttagacttaatcacatcattgcttttgttacccaaaatggcggcatacagatgtggttttcacctgcacttgtaactggcgtttgagtattgttggcacactcaccggaagaatgttcccgtcccctgccccaaacctcacatcttcatcctgattagattgagtttcagttctgccaaggaccaccctgaatttattttttcttgaaagatgaacgaaagtggtcaaggctggtctacttctgaggcttttgaagggaacccgctcttcatttcttcctgggcagctcttgagagcatccttctatcactgcgttccatggtagctcatccattctggttgtgttgctccgtgtacccttctgcatgaaaagtcatccttcttcagcttgtaacagtgcagcttttatttgaaataaaagtttatcctccgtgaaatggt

SEQ ID NO: 228663 - DNA, 649 bp, Homo sapiens
tttagttttatctttgttacctctttaatcataaatgctctttcataatcaactttttaatttccctctctatgcttcgtgttagacttaatcacatcattgcttttgttacccaaaatggcggcatacagatgtggttttcacctgcacttgtaactggcgtttgagtattgttggcacactcaccggaagaatgttcccgtcccctgccccaaacctcacatcttcatcctgattagattgagtttcagttctgccaaggaccaccctgaatttattttttcttgaaagatggttagaaagacactttttctttgtctgaaactgtgtttattattgagcaataatttggtttgatatgggatttgatcttaaaaagtaccttcctttgaaattgatatgacactccattgcctttaagaacgaaagtggtcaaggctggtctacttctgaggcttttgaagggaacccgctcttcatttcttcctgggcagctcttgagagcatccttctatcactgcgttccatggtagctcatccattctggttgtgttgctccgtgtacccttctgcatgaaaagtcatccttcttcagcttgtaacagtgcagcttttatttgaaataaaagtttatcctccgtgaaatggt

SEQ ID NO: 228664 - DNA, 158 bp, Homo sapiens
tcatctaaggtaatgagttaaacccaaaagtaacagtgacatgataagtgaaactgtttgcatactttgttttttaaattgctctatcatgtttatcttttttatagctactcaataagacattgcaatgaatttttaattaaaaccaatatgtctat

SEQ ID NO: 228665 - DNA, 210 bp, Homo sapiens
gcccaggatgtggcaggaatggcaaactccattgccatcagaggccgacaaggtaatagagggaatgggcataaggtgcaggaagtggaggggagtagagtgacccagagggtgcatgccccacctaaaggcattcaaatctattatttcaaaaactccatgctgacaagcagagtgtcctggggactaaggctgcagccgtgtagatgg

SEQ ID NO: 228666 - DNA, 480 bp, Homo sapiens
ggaacatatgtatgcctcctgcactcagacgtctgcttgggagacctcttgagaggggtgaaaccatcccggtaatgagtgaaaactcagaattgactgaatatctctccaaaagagactgtttgaaaccagaagagaatgggctatattctattggcaagctcaagcattattttctgctatttatagaaataatacctaaaagacaagacaaagtcagttatcacagctccaggcattgtggcttcatgcaactatgaccaaagcaggaagaaaaggaatggcagagacttctcagaagctctccaacagacttctctttgaatctcattggccagaactggagcacaaacccattcctaaaccaacttatggcaaaaagagggttgtcaagattgtcctagaccagttgtaattggtacctttgatcaagtgggactcatggagtatagttataaaacaatttcatttttgtctcct

SEQ ID NO: 228667 - DNA, 206 bp, Homo sapiens
ctctctaatctaccttaaggctagtaaaataaaacatgagacaacagtagcaacaaaaatcaagcaaattttccatgagctgcaaaaaaaaaaatttttttttttcgagatggagactccctctgtcgcccaggctggagtgcagtgagccgggatcgtgccactgcattcccgcctggcgacagagcaagattctgtctcaaaaa

SEQ ID NO: 228668 - DNA, 453 bp, Homo sapiens
aagcaagagggagaataacaaatcactcatgctctcaaagcccatacttacaaagagaaaacaggcaccgatcattgctgctttgactgttacatctagatctgcaggaacatgaattccgaaattgtcagcatttgtgaagacatcatttacaaatcctgaccagtactttgaaatcttcccaattatggagaatatcaggataaataattaaggctcagccaccacaagatggcagcaggtacatagttcaattgtatcatctaagcatgaaggcgatttctttacttgaggtccagattttaaacctgaattctccatcttaaaaatgtaaaagaagatatgtttgaaaaaatatttcagaaggaattaaattaatttctaggcataatttgtaaactttcaaatttcagttgctaaaattttataattattaaaacatttaaatattat

SEQ ID NO: 228669 - DNA, 591 bp, Homo sapiens
gtctttaagatcccctagtctccatgggatttgctcagttgtgaggtgcttgagaaggctgaagtttcctaggggatggtagtgtggtgaaaaggtcaatcattttttgtctaaaccattgaagaaccctctgtagtcggaactaaaccctagtgaagcatcagggaaaggtgaaacaccgtccattgagttctagtccttttctggttctctggactgaggaatactaccgagcattccaggcaaaaggccaggagttctttcaaagatgacatatgcttgatcagaactagctgcataatttgcagagttcagtacatattgaaagttgggcctcttgttctaatatcattaagaatttcaagatggccacagcagagaatcaaatatgggacctgtctgagcacagggccctgtgcagctgcatgggtcacatgcccatgaagtaatccctatatttgacagtagcctaaaagtcacctaggaaaaagccaggcctacgcattgaccaagaagtttttccttgtctgatcatgtgcccactgagataatagagtaatatccatgccaggaactttaccaatatgactg

SEQ ID NO: 228670 - DNA, 190 bp, Homo sapiens
ggaaggatttaatacatctcatctaaaaaattgtatccattataaaacttctgcctttgtgaattttctatcgtgaccactgtttctattaaatccaatttttctggacatatatttgtaggtctaaattttatcaaaacaatttgatcttttataaaatctctaataaattcttcagtgtgaaatttta

SEQ ID NO: 228671 - DNA, 251 bp, Homo sapiens
gaacaatatttaaaaatccatacttacaaaggaattcaagtagaagatatctgttttgtctataaaggaatctgccattatcatcttttaaatcacatgtttgaaaatataatttgtattcctgggtcctcttatttatcttttatctttgagatgcattcttactctgtcactcaggctggagtacagtgagctgagatcacgccactacactccagtctgggtgacagagtgaggggactctgtctctg

SEQ ID NO: 228672 - DNA, 360 bp, Homo sapiens
atatttgatggttaaaaatgagaatgatcataaatagattaaccatactgtatagataactaaccaaggagttttggcttaatgtgatttgctccataacactgtgccaatgacatttcatcagggttggcataattgtgaagaaaatatttgtattcagggtcaatagtgtgccaggtcacaagaggagttccaaacttcttgtttgcctcttgagaagtttttcttgttgagctgctggagtaaacactcattattatttttattaacttctacctgtgtggcttagtccaggaagctgcccaaacactattgagatggagttgttttgcttctcttcaaatgtttatctttttgcta

SEQ ID NO: 228673 - DNA, 500 bp, Homo sapiens
aattgggaaagattccattacacaggtgacatttaagcaaagtcttgaataagggagggaatagtaccatgagatatcctggtgaaaagcaatttaggctgagggcacagcagggaagaggccctgatgtgggaacatccctggtgtcttgaggtacagaggccagcatggctggcacggagtaagaagttggaggtgccgggcatggtgactcacacctgtaatcccagcactttgggtggctgaggcagatgggtcacctgagcccaggagcttgagaccagcctgggcaacatggtgagaccccatctctacaaaaaaatacaaagaaaattagccagatgtggtagcatgcatctgtagtcccaattgcttgggaggctgagatgggaggatcaaattacttgggaggctgagatgggaggatcacttgagtccaggaggtggaggttgcagtgagctgagatcatgtcagggtgacagagcgagaccctgtctca

SEQ ID NO: 228674 - DNA, 479 bp, Homo sapiens
ctaaatctttgagatattggtaagtataacatttattcttgcttgctcttttcctctcttctcccattatttggcctatgctttctcttaaaaaaaaaaaaaaaaagctttattgctgggattacaggcatgagccaccgcgcccggcctatttttaattttttgaggaattgccatactgtattccatggcatttggaccattttatgttttcatcacagtgtgcaaggattccggtttctcccattctcactaacacttgttattttggttttttgagagtagccatcctaatgggtgtgaagtggtatctcattgtggttttgatgtgctcttcagtgccattttaatttgaactatatctctgaaacccactcattcccttttttcctaaatctttgagatattggtaagtataacatttattcttgcttgctcttttcctctcttctcccattatttggcctatgctttctctt

SEQ ID NO: 228675 - DNA, 468 bp, Homo sapiens
gggctggagtgaaggagtcctgatctatggttgatattaaatgtaactaacttcactatctaatgtgccttcttctttttaagaatgagattggtggcatgtctaaagttggattttggttctaatacattaaaaaaataactttcttatcttgaaaaagcaactagtgaacagtagagatgcttgctcactttatgagtgccatgtattaagggagttttgaagtgatatttatctgtacaacttcaaatctaccatggcattctgtggtagagtaaaaactttagagctaaacatacctgatgtttatacatgacatatagctgcatgtccttgggtaagttatttaatttctctcaaccctaaattttgactgtttaaagtaggttttataggttttatgtaatttgaagtgttgttgtaaataataacgataataaaatatcttacacagttcttggtttgcaa

SEQ ID NO: 228676 - DNA, 296 bp, Homo sapiens
ctgctacaaataatgctttcttgtgactggtctggcaatgatagcaaaacagcatttcctctggtattttcctatttatgttccataagcaagagaaaacaaacttggattttcagatgtgatacacttcaaagagcagtaagttagtaagtacgctaacatttgatcctcacaaaaactcaagcttcaaattatctctgaagaaatagtccaaattaatttaaggtaagtaaatacagtactcatatttgtataacataacttagagcctactttttaagtgccttatatgtagt

SEQ ID NO: 228677 - DNA, 297 bp, Homo sapiens
caagtcctttctcaatgcttgtaattctctgagcatatctattaacacattattttaaaaaataactactcagcaatattctgagtaaactttagaatgcctaagaaatatgtagggtgctatttttaaagggccactgccagaaatttgaaaattgtgaatcagtaagtttaagacattgcccaagaatctgaactttaatcacccctgatgattctttttctttctttctttctttttctttcttctttccttcctttcttctttctttttctttctttctttccttccttcttt

SEQ ID NO: 228678 - DNA, 202 bp, Homo sapiens
ccctgggcaacatataagaccccaactctacaaaaaataaaaaatgtaaaaaattagccagacatcgtgtctcacgtctatagtcctagctacttgggaggctgagatgggaagatcccctgaacccaggagtctgaggatgtagtgagctatgatcacgccactatactccagcctgggcaacagagtgaaactgtgtaca

SEQ ID NO: 228679 - DNA, 1215 bp, Homo sapiens
agcggagttccggtccggcagagatcgcggagagacgcagaacgcagcccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcatagg

SEQ ID NO: 228680 - DNA, 1275 bp, Homo sapiens
agcggagttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcatagg

SEQ ID NO: 228681 - DNA, 462 bp, Homo sapiens
ctaaacattttttctgagtataaaattactaagtgtagaaaatctggaaaatatacaaagaaaaatcaagattttgcattttgagtggcacagcttaagaaagctatttgaattggtctgattccctgaaaacaatatatgcatgtatttctgagccaggtttggttatagggagaaaaaaacagaaaagacaataaatctgggcattaataggcttaaatagtatttagttatttgggatctgaagaagaatctccaaaggaagcttgtccaaaagtggaaattttagcatttatatttaggtccaatttgggttgctttaaatgtcttttttgtttttttaagttaaaaatggagacagtctaaatgcaatgtgggattctggattggatcctggaagagaaaaaggacattagtggaaaaactggtgaaatctaaataaagtctagagttttgtacata

SEQ ID NO: 228682 - DNA, 453 bp, Homo sapiens
gagatgatactgggcagaatcaaataatttggtgacttttagtatttaaatggcaaaaggggtgagtcaaagacaattgcttggtattgagcttgagggcctaaaggaacagtagtgctattgagaatggacatgctgagttgtctgtggtgaatcttgtaaatggaaatatcttactgaaagttggaaacgtgggagcagaatagaggtaagagtatagatacagatcttgaggtcataacaaaagtgatggactttaatgaatgagctttctagaagaagtttagagagaagatgacatatgaagtattacagacagctacttgaaaaatgcccataaaaacaagagaagtaaggaagaatccaaaagataggaagaaaaaccaaaaaaggacaaaaataaggggttttaaggaagggatagatagtacagttaaatgcagtagggactga

SEQ ID NO: 228683 - DNA, 522 bp, Homo sapiens
ctgccaactcaaacgagctaagttgacttcctctcttctctttgactttatttcccttctctgtttctatcagccaaaatctacctgttctccaagactctgctcaaatacaatctctttcttcaagccttctcagatgtctccacgtgaaagtaatatttagcatcctttagcacattaaagcgttcctgtgcccagtggttctgaaattttaacgtgcatcagagttccctggaggacttttacaaccataaattgctagacccccagccacagtttctcatttagcaggtgtatggtggggcacaagcatttccatttctaacaagtccccaagtgatgccaacactgccgagccagagaccacactttgagagctgccaccagaacaagactgagcatgtctcacttccccttataaagcttcttgggaacagaaaagaattctgtctttgtatttccataactcttcagcccaagtttatattcagtagatactcaacaaatatttatcaaattaaa

SEQ ID NO: 228684 - DNA, 502 bp, Homo sapiens
tgacctgtttgaaaacagaaagaaaaagaacaacatcaaattgtatgtacgcagagatttcatcatggataactgtgaggagctaatccctgaatatctgaacttcattagaggggtggtagactcggaggatctccctctaaacatttcccgtgagatgttgcaacaaagcaaaattttgaaagttatcaggaagaatttggtcaaaaaatgcttagaactctttactgaactggcggaagataaagagaactacaagaaattctatgagcagttctctacataaagcttggaatacacgaagactctcatgagatggtttctctcaaggactactgcaccagaatgaaggagaaccagaaacatatctattatatcacaggtgagaccaaggaccaggtagctaactcagcctttgtggaacgtcttcggcatggcttagaagtgatctatatgattgagcccattgatgagtactgtgtccaacagctgaaggaatttg

SEQ ID NO: 228685 - DNA, 437 bp, Homo sapiens
cgggggggggaagaaggagccaggcagtaggttgtggggttacaggatcgggctgaatttcagaatgaagagaaccagagatgggccaaatggtttacctggcttttatttcggctctgtaataatcctaaacagtacacagatattttctcctgcctccagcttgctacctgcagatggcgctcatcatctgatccaaaactgctctggacccccgcatgcggaagacgggaggacaagcgccctcagccagacttggtgactgtttctccccagggcctttacatctcatcccaaaccacaactaaaatcagcactcctcctctcccactctcccctgagtttggggttccagaactcagcaaaaagtttccctttttcctcacataattattgtataagaaataaagtcagaggcatttctggattactttcga

SEQ ID NO: 228686 - DNA, 415 bp, Homo sapiens
taacctgtccaggcacgatggaacattgaataaccccttattctaaattcctggtccctgtaagactccttccccatgcccttgcccttttatgaccttcccctaaagtccttgaggcttaagcgggcatagtctgcagcaaacactggggaagctgagtccagacttcagagcacaggctttggatctaggccagctggatttgaacctcacatttgtgatcagctggcatgactgtttccaaaaagtccattttaatcctctacgtgaccctctgtaaaatggggatactgaacggtgagctagcacgattttacagagagtgaatttttttttttttttttttttgtgagacagagtcttactctgtcgcccaggctggagtgcagtggtgcaatctcggctgactgcaacc

SEQ ID NO: 228687 - DNA, 527 bp, Homo sapiens
agagcataagagtcacaatatttaagaaagcgaattttaagccaattgcttgctggcctgctgaatttgaagtacttctatctctcacttctgattaaacatggaagaaaacagactggctaatttggttatactttgtccaaatacaatgttaacgtaatggaacccttaaatatccaaaataataactgaatgctagttataatacaataataaaaagtttaaaaatcttccaaatgtgctgttaacagtacaaattcaagtacagaattattatgccattttaagtattatctactttataaaaaaatcacagtggtcttcatcacatggcaaaaaaacaaatttcactcttctccaaaggagtaaggccatcctaaatgtaactacaaacaattgtgtaaaactttttgggttttttcccacaagctactaaacattttccattgcactatacttgaattactcagggaaaataagatgacatatgttgtagttttgcagtgcaaaaaagagctttcatttta

SEQ ID NO: 228688 - DNA, 199 bp, Homo sapiens
atttttaaatttaacatcagtgagggcatcctatccatttcatttcatgattccattacatcatttcacttagatgaaatgatgacttgagatgaaatgatgagatgaaatgacgaaatgatgagatgagatgatgagatgaaattttgagatgaaatggtgagtagaaatgatgagatgaaatgatgagacgaaatga

SEQ ID NO: 228689 - DNA, 465 bp, Homo sapiens
tttcaatgagaattttaagttggtttaaaatatttttttctttaccggaggagtggtattataggttgaggagttaccggttgaattttgtccccctcaacaaagatgttgaagtcctgacccccagtatctgtgaacgtgaccttatttggaattggggtctttgcagatgatccagttaaggtgaggccattaagggtgagccctcatccaggatgactggtggcttttaaaaggggggaattttggacacagtcacagggagggcaccatatgaaggtgaaggcagagtctgcggcaatgtttctataagccaaggaacctgaggattgccagtgacccccagaagttaagggaggggcctggaacagattctcccccagagccctcagaacaaaccctgccaacaccttgatctcagacttctggcctccagaactgttcagcaataaacgtctgttgttt

SEQ ID NO: 228690 - DNA, 373 bp, Homo sapiens
gagtctctgctagtaatttcattatttttaaatttgaattaattgacttaaaataatacagttaagaagtataaccagcaggattatggagaaaggtttctttttccttaaaaaaaaacagtgctctcagtgttacacttaagatgagattgaaattttcttttttacgccaggtgccccgttctaagattcagagcagcaatgtgaatattcatccttgcagtggagctgagagaagttgtagggcaaatcctgggaacaaggtcactttaaacaaaaaagttctccaagtttcccatgcttataaggctggctgggcttaattaaagtcaatggatgaccaaaaaataaataaataaatagagagagagag

SEQ ID NO: 228691 - DNA, 1745 bp, Homo sapiens
gaaaaaaccctatgaatgtacgcagtgtgggaaagcattatcctctcttacaagttttcaaacacacataagaatgcactctggagaaagaccttatgaatgtaagatatgtgggaaaggcttttgttctgccaattcatttcaaagacatgaaaaaactcacagtggagagaaaccctataaatgcaagcaatgtggtaaagccttcattcattccagttcccttcgttatcatgaaaggattcacactggagagaaacctatgagtgtaagcaatgtgggaaggccttcagatcttcctcacaccttcaattgcatggtaggactcacactggagagaagccctatgaatgtcaggaatgtgggaaagccttcagatctatgaagaaccttcaaagtcatgaaaggacacaaacacacgtaagaatacactctggagaaagaccttataaatgtaagctatgtgggaaaggcttttattgtcccaaatcattgcaaagacatgaaaaaactcacactggagagaaactctatgaatgcaagcaatgtggtgaagccttcagtagttccagttcctttcgataccatgaaaggactcacactggagagaaaccctataaatgcaagcaatgtgggaaagccttcagagctgcctcagtccttcgaatgcatggtaggactcaccctgaagataaaccctatgagtgtaagcaatgagggaaagccttcagatctgcctcacacctttgaatgcatggtaggacacacaatcaagagaaaccatgaatgtaaagaatgtgggaaacccttcaggtctgcccagaaccttcgaattcagtaaaggacacaagcacacataagaatgcattctggatagctgaacaaaaggcagcagaaacttctgcagacttaaatgtccctgtctgacagctttgaagagagtagcagtcctcccagcatggagtttgagatctaagaatggacagtctgcctcctcaagtgggtccctgatctccaagtagcctaactgggaggcacttcccagtaggggccaactgacacctcatacggccgtgtgcccctctgtgacgaagcttccagaggaaggatcaggcaacaacatttgccgttctgcaatatttgctgttctgcagcccctgctggtgatacccaggcaaacagggtctggagtggacctcaagcaaaatccaacagacctcagctgagggtcctgactgttagaaggaaaactaacaaacagaaaggacaaccacaccaaaacccatctgtacatcaccatcatcaaagaccaaaagtagataaaaccacaaagatggggagaaaccagagcagaaaagctgaaaattctaaacatcagagcgcctcttctcctccaaaggaacgcagctcctcgccagcaatggaacaaagctggactttgactttgacgagctgagagaagaaggcttcagatgatcggtaataacaaacttctccaagctaaaggaggatgttcgaacccatcacaaagaagctaaaaaccttgaaaaaagattagacaaaatggctaactagaataaacagtgtagagaagaccttaaatgacccgatggagctgaaaaccatggcacgagaactatgtgatgcatgcacaagcttcagtagctgattcaatcaagtggaagaaaaggtatcagtaattgaagatcaaatggatgaaatgaagtgagaagagaagtttagag

SEQ ID NO: 228692 - DNA, 901 bp, Homo sapiens
cttatttgtgaaatcctagcagtccaagaagaaagacttgcatatattgatattggcatctctccaactaaatgtcccaaccagattaccctgcagtaagctcacaggccacaagccctactcacatgctcagtcagtgctctccagctaaatgtcccaaccaggtcaccctgcagtaagctcacagaccacaagccctactcacatgctcagtcagtgctctccagctaaatgtcccaaccagatcaccctgcaataagctcacagaccacaagtcctactcacatgctcagtcagtgctctccagctaaatgtcccaaccaggtcaccctgcagtaagctcacagaccacaagccctaccctttgccagctgtatgacaaaaattaggaggagatttacattttaatcatatggatatgcataaagccatcccaaaggtaaccataagaatgtctactagctcttcaaagttggggcagaagtttaaccgctctgtggggggctattctagctgggagttggcggagttttacagagtccgtgaatgggaaactcctggggtgtccctaatatatgcgatgcgtgattcactcttggcaattgggtcatccggatggcccctgcagagcttctgcagggtggcgagcttgggattggacgcctattgcgcgttacggtggcttgtaggtaccgggccggttaattcgagcctagacgtcttggttctcgtgttgtgcgtcggttcggtaagtaagggcccattggccgttcagtttcgcgccaaagattgggcgggcccctagcgtttggggccttttgggttaggaacacgcttgtaggcgcggggaggtaaagtaaccaggtgcgcgttattgaagtgagctctcccgcgtatcgtc

SEQ ID NO: 228693 - DNA, 384 bp, Homo sapiens
acttactaaatgctaagcactattcatgcattagttcaattaatcattacaacaattctatagagtaggtggtattattattatccttattttcctcattaagaaaatgaggccaaaataggcaagtaatttgcctaaggccacacaggtaacaaatgatagaactagaattcaaactctagcagtctggttccagagtccatcctcaatggcaacaaactgtgtgtatgtatgtatgtgcactcacacacattcacacacacacccctttaaggggaatatactaataacaggaaaaagtaaatttgttattttactttttaaagtgttaatcccaaaatggtataatgaaagcttgcaattaagtatcaagaaaatcacaca

SEQ ID NO: 228694 - DNA, 503 bp, Homo sapiens
agtgcttgaagctcttggatgggaaataagaggtttgtcactgagagctctctgctgtttggtcagcaggtgtctggttctggaatgttccaatgaagagtcctttttcctctcctctttaccatctttctgggggcttgtctgctgtctttcccctctggtccccttctccacatcactcctgatagggtctccaggggttcaggaagtgttctaccccctttctcccctcatctgcctcacctcccacacccagctgtcctctcgggtctgccttccccacctgcaggaggtcatgtaggggttcgccagataatatgggtccatggagcagggctgggggcttgtggagtggggttaggtatgggcttgtccctgctccaggcaccctaacaccgcaaggagcagctcaccccaatctcaccttcaagaagcagctgagcagttgactcggggtacgcagtgtttgacaaaacgaaatataactcaacttaaaagtgaag

SEQ ID NO: 228695 - DNA, 497 bp, Homo sapiens
tggagaaccagctggccgagatccgctgcgacctggagcgacagaaccaggagtaccaggtgctcctggacgtgaaggcccggctggagggtgagatcaacacgtactggggcctgctggacagcgaggacagcaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagct

SEQ ID NO: 228696 - DNA, 347 bp, Homo sapiens
attattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagtt

SEQ ID NO: 228697 - DNA, 455 bp, Homo sapiens
tatcacagttagggaggccttcccagagtttatttcagtatgtttaaggtttctttttctttctctctgaccctccatttattccttttacatttcatccatttgcaatttgtatatgaagtgtgaatctcatttttttcctcagatgcctactcagtgcactatttgttgaataatctatcattttcctgttgtgttgaaatgtcacgttttccttaagttaaaattctccacatagctctatttattttgggactttctattttcttccttgggtctgtctgttaatatcttaatatcacactgttttaatgattgagactttttttttttttttgagacagagtcatgaaagtggctcatgcctgtgattccagcactttgggaggctgaggagggtggactgcttgagcccaggagttcaagaccagccaacatggcgaaaccccatctct

SEQ ID NO: 228698 - DNA, 262 bp, Homo sapiens
ctttatttggtctggcctggttataagaacttagaagggtaggcaaaggacactataggtagctcacaatattctcgttaagttcactgcctcctcaaataaagacaactccttgactgttcatttcagactgttcattaaaactaattcagatctgctgaaataatgtctacctttgtagggggcaaaagaacattcatcaaaaaatttcacatagtgaagagaattgttcactttcttgagagtgaaaaccaataaactt

SEQ ID NO: 228699 - DNA, 422 bp, Homo sapiens
ggtgttattgagcaagacaggaaggcagctttctggataatcgaacgtgctagtgaacagagtgttgccagagatactccaggtgtacactcagatgtatacgtcatatgctccctgagtgattacgtgttccaggctctgagggtaggaaaatgaagacaacagtctctgtctcagggaagctccaggtccacaggggaaaatggaagtcaacgccaagtggtactgcagagtggcaaacaacacagcacaaagtgctccagaaacactcatcaggggtcagccatatgctggaaggcaggcaatggcccactccacagggaccctcacaaaacacacaaggcttggatgatgaaggggagatggaaaggctttgtagtttttcagggcaattgtaatgaatggcaattatcatggtaaca

SEQ ID NO: 228700 - DNA, 689 bp, Homo sapiens
ataaaataaaaatgcctgagtttggcatatataaaataaagcctttatttcccccacactatctaccccaggccttcatccatagactctatgttcttgctattttgaactatttataattccctctttcttcttctctccatgccattgaagaagccattccctctttctggaattctctttcctgttctctgcctggctagccccagattgtcctatcaatgaaatccttattgccttctatgggcaggcttctctgggagatctgggctagacatgcctggaacaggaggaagagaggggaagtgaatcagtgaagatgacttgggtggctgcttttttctctctctcagtatcactgtgccactgcacaggttcttgcacttccccacttctctttccctttagtcttggtcctgatgatctcttctttcctcctcttcttaaacaccagggaagaggaggagaaagcgtgtggacacatcactcagataaacgtttgagcagtgaatggatatcgtctcatgaaatggaaggctggtgtcctgcctcatccccagcaactccagtgctgggtttaaagagatgatgcactccaatgcagaacatgacacccggattcagacatgaagcgtctgttccttcaaatgcttagtaataaatgtaatggtttgctagagtcaaggtca

SEQ ID NO: 228701 - DNA, 622 bp, Homo sapiens
gtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgttaatgacatgtaccatgctccttgaatgtaacagttttatcacatttgaatgtttcacattgacttaaacatttgagtcaaagcataagggtttctgattgataaattctatatacacctaagaactggtaaataaatttgttcaatttcattgattttcaacagaagcatatttcataatcaatattataactatgataaattatgataatcagtaacaggttatcagaatcaaatgtaaatgttatataaggatcaataagtaacaggttatcagaatcaaatgttgttatataaggatttctctattttcctcccattaatttatatacatactaatattctagtcaagagatatactgaatgccttactattagggccaa

SEQ ID NO: 228702 - DNA, 572 bp, Homo sapiens
gtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgttaatgacatgtaccatgctccttgaatgtaacagttttatcacatttattgataaattctatatacacctaagaactggtaaataaatttgttcaatttcattgattttcaacagaagcatatttcataatcaatattataactatgataaattatgataatcagtaacaggttatcagaatcaaatgtaaatgttatataaggatcaataagtaacaggttatcagaatcaaatgttgttatataaggatttctctattttcctcccattaatttatatacatactaatattctagtcaagagatatactgaatgccttactattagggccaa

SEQ ID NO: 228703 - DNA, 303 bp, Homo sapiens
tgcgcagtatttgaggaagataaattatcaggctcctgcttccaaagcggttttatcttaagaacctttatggggattgttgactgttggtcacatgccctaccacttaggtttcaggccctataattagattccgggcagtgtggtttgaggggatactataatgaagacaatatcagaacacttggaggtgaacttggagctccagaggacattactattccttactcacctttcatagatctgcctttatttttcttgtctgagtcattttttcccatggagtcaattctctaaaaactg

SEQ ID NO: 228704 - DNA, 410 bp, Homo sapiens
agcccattgaattatgagcattttcttggaaatgcagcaaaaatgtgttctgacagatgcctttgggtcccttgggttctttgctaagacagctatagagagagggctcaataaggtggggcctgtgatgggacattgcttttactgcactggtgatagaacaaaagtcagacagggcacaacacacactgatacaaccaatcacccagtcacactgcagccttaggaaacccatgagcttgtggcagcaggcaaacttgcttcagagttccaagaatccaaatgttcctggtgtgtctgttgtcttgcgatatagactgagatcacaggattgaagatacgaccagagtcatgctgttgaaagagactggctgagtagtgatgaaaaataaacttggtcaatctatgct

SEQ ID NO: 228705 - DNA, 985 bp, Homo sapiens
cactcacacaaagcgctttctcagcgagtgcggctgcggcgtaagtttggttttgcaaatctcccgtttccctccccgtgtggagtctgaggacccgccagtcagacaggagttatttcctggtggatctttccaaacatattattaaaaagtcacatgtgactttcccacagacttttatgaaataaaacccaaaggaacagcgtgcaacatgctcagttatggaagagaaaatattttatgatttcaaaaagtcctgacaaattttcaccctctctaagaaaggaagcttaagactataccttgctgttgtcacttacaagcagggatctgttggggtttggaattctctgtctcagcccggagcccagagttcagcgatagctgaatactggtgcgagctcagaagcttccgtgtgcggagaacaaagactgaggcgctctggggggagagcgctgtccgaagtgctgatcagacttcggatccacccaccgctcaggccgcctcccaggggctgaagggcggcagccgaaccggagagacgtgccggcggcgctcttctgtcctgctcttttccctggactcctttgtcttgacggggtcagctaaagacttcgaacctttactcatcaaagctcatcttcggaaactgctcatagcactttaacctcccggtgggagctcccagggcgccctaggtcctgccagcaggcaccgatttcaagtttccaggcacattctgaatgctcctcctggcagcgccacagagggtctgggggcccattcccgacccccggagcgccacacctcaggaggcctgtgattgttcaaaaggggaagtgagaaatgccgaaagacttacgttttcacaaatacaatttctattacctgaaaaaactgttgtgccccacgaagcccgtgttgcgcaggttcatctctcctgctgccacctccgcttcgctgtggtttcttaggtgtgactgt

SEQ ID NO: 228706 - DNA, 475 bp, Homo sapiens
acctttaagattaaaaaaaaaaacaaacaaaaaaaaacggcaaagttagaacacacaaaagatagtatagttccttacccatccaccacttggttttgaggagaaaagggaaataagaagagttgaagagaagaaaaacagaacagaagagtgggaaaggaagatgaaagggtgctctggagtactatgcacctgtttagaagtggggaagtagcacaaacactagcaaaagaagaaccaccatggagttcctccttgcacatctctctcccctcctgaaggcctagggtgagcccacagcattgttccagcagtgagggagtcttcactgccccctgagactctctcacggctcttaagatacctccctgaagtccctccaaagaattcaatgtgcccctagtctaaatcagtttcctccatcataaatactcatagatgatgcaacaataaaacgttaataacgataatggca

SEQ ID NO: 228707 - DNA, 1649 bp, Homo sapiens
  misc_feature (124)..(124): n is a, c, g, or t
  misc_feature (891)..(891): n is a, c, g, or t
  misc_feature (894)..(895): n is a, c, g, or t
  misc_feature (905)..(906): n is a, c, g, or t
gtcatgttttccaagggtgatttatattcctaggggatttgggtggttctcgcttctcaaaacccatatcaaatgactttgcctgtgactttttacaaaaattcttattctaatacctctctgngcccttcccaagcacacagatgatgttcagtaaatgccagacctctttcctcccatttcccatgtgccctgcctccctcacagccagtctgctctccttctttcctcccttcctctctttgccctcttcatccctctttcctttcccactatattctcatttgtgcaatttcccagttaaggtcagtgtcaccctgacttctctttctttttttaatcatcatctgtctttcttgacatttcacatcctgaataatttccttcagagaatcagttctttaagacatcagaacatgagtcaccctgcgaggtaccaccagactaacaccagggaccagcacccattctagcaaaacactgcctaagcagcctgaactgcgctagtttctttaatgagggttgtagcacagaaagttgctttcttttttttttaaagaaaggaaatcctctagcccaactaagctttcctgttaaacaagtgctttgagagacccattcagagtacttttcactagaaggacctttattgtgttttgtgagaaggaaggacaggcacaaacatgctgttagaatgtgccatggagaaagataagcccacaggttcgagtggagtaactttaccctttgtgtaaagattcagcaaagattctcagaaatgagcgggaatgttttcagtgctatgggatgagctctgtcgtttcctgatgaacacacttctcagcatgtgttctgggaaacactagtttttgtatttttggagttttcttnttnnttgtttgttnnttttgaggcaggagaatctcttgaacccaggagacggaagttgcagtgagctgagatcgcatcattggactccagcctcagcgagaacagcattgaatttccctttgtatgaactgtcttttcatgtcctttagccattctctcttcaattgtttctatggtttttttttctttttgatgttggactttttatctacttgttttccttgtttgctgcagtgtgtaccaaccagtgcagcttcttggttgttggtgggtctgtaagcaagcgttcggagccagcacagagaggatgagaggagggctgcactcatctgctcttccagatggcactgatcaaaggacgtggtgatcatgggaacactctggagagcacgtagccatatttagatatattgacaacacaaccatttagtagactcagggtgactttaagccacatgtcacatggcagctgttaaaatcatctctgtacatgtacatggatagttctgatggcacacccttgttagctttgtagcttttagctaaagggccatatggtgaaggtgcattttttgcatttcttatttcttctcttttctttgtcaatatatccattctagaaaatgagatgagccaggcacagtgtggtgcatgcctgtaatcccagctactctgaaggctgaggcaggaggatcacttgagcccaggaatttgaggccagcctaggcactgggcaacatagtgagactccgtctctt

SEQ ID NO: 228708 - DNA, 773 bp, Homo sapiens
atgaaaaaaacccaaaacacctggttgatggccatttggtcaaacacctctaggagtctggagttgagtggccagaactcagtctttctttacatgctgtgttaagcaggcttttatctcattcaggtgttagaagtggagggaggaacacagttaggctgtgttctactgcactgcatagggaggcagggtatcacccaggcacaacgcccactttgcaagtaaataatcagtagcatgaagctcacttctgcaggacccaccatgacaaagtggagagctgggcggttaaccagtgaaccaattgagtggctctgggctcctatacccctttcattccacagcctgtgatacacccttagagtcaaaatatcaaattcagtgggccatgagtcttgcccaaaagtataaatctttttttcatatggactatttgggtctattttcaaaaatccctttttcttctctaaactatctcaattccacatttcactttgcaggtgtagacatgacttttaggttgttgatgatttaatgctattgaaatgttcttatatgcaaaacacctagatagatgcagagtgtgggacaaagacaaccagcacattgctaagcccaagtagcaaatttcctgaccccattttaaaggttctgagacagataggcggaataggtccccctgtctttgagtagaagagttggcaagcaagctggactaaatgggccatgtgcaattttgctgtctgttcacatttcaaataaactaatgtgtt

SEQ ID NO: 228709 - DNA, 508 bp, Homo sapiens
ggaccctccacactcttggaactgtacacctagaccaaactaaaatacagtcactcttgctaaatgtaacataatcaaactaagactttaaggaaacaagcaaatcctagaaaagaccaggtttttgtattttttttcctcctgtaaacagtaccttccaacataaggaggtaccctctactctaacacttacaaaaataataagaataataacctggagtccttgtaaggtgaaaccttacaaaacccactgctctgctgtttcctagtgggtttcaagaggaaataagtacttttacagtggtgatggtgaaatcaatgactaacattttggtcaatctcccacaatttagagaatgaccaaaacgggggaattgttaaatcaagtttatcctaaattgatgggatcaatcatactccaaaccttgacactgcacaatatacccatgtaacaaacctacacatgtacctcctgaatctaaaataaaagttgaaattctaaaaaatg

SEQ ID NO: 228710 - DNA, 472 bp, Homo sapiens
cattattttcatcttcaggttttctttcactatctaatttctttcttttttttttaatcaagctctaaacttgatgttattgttctggggccccaaatctttgtgcttgatttagttttcacttggaagagaaatagtcaccatctatttgcaggtgcaagttaaggcctgttagaaagcttggcgtctacgctatgagctctgagtaatattttctagtgtatagttttgatcagatgaagtgtgtatttgtgggaagaaagaagcttgtattgttttatgtttgtaccataggtcataattactgtattgtttataggataataaactcattaggcaattatgccttgttgggttatttgaaacatttgtttttaacttgaatgctctcaggtaggtaataattagatttcatttgggatcttttattttaatgaaagttacccagaataaactgcattttttttggttt

SEQ ID NO: 228711 - DNA, 435 bp, Homo sapiens
caagagggctgagcaggaaatggagcccctcatttggctgcaattaccactccacagggggctagggctggggaggggaaaagatacgaagggcaagtaaattaatggatgtggcattcctaaggagaatgggaacagggagttagcctccaataaatcaaacgctccagacccccaaacgcacagatgagcagtgcctcttctgagtttggcctgcaggtatgatacacgccgtgtacatgtgtgcacacatgcacagactgaattttgtgaagtaaattgcaaatccaagagtttggggggacaacaccagaaaaacatttacgtcattcttgattccaaaatattctgctggaaaatgtccaaaatctaataaaatttaagttatatttctctgagagctctaaccgtgaaaaataaagaaaaaaataagcc

SEQ ID NO: 228712 - DNA, 383 bp, Homo sapiens
tcataattcatttttatttattcttttttctattagagacagggcctcattctgtcacccagcctggagtgcagtggagtgatagatcatggctcactgcagcctcaaactccagggctcaagggatcctcccacaccagcctcctaagcagctgagactacaggcacacactaccatgcccagctaattttttttctttttctgagacggggtctcgctatgttgcccaggctggtctcaaactcctaagctcaagtgatcctcttgcctcagccttctttttttcagacagagtctcgctctgtcacccaggtttgggttttctgtccttgtggctgaagggaccctgagtgaaggctgcagactcatcaggggcagatgg

SEQ ID NO: 228713 - DNA, 454 bp, Homo sapiens
ggaggaaaacagcaatgtttctagccttgaggctgggtgctcagtaggatggcaatgtggtaacacacacaaagcagaggaccatgtttgggtaaaagatgatcagtttcttttcagatatgttgcatttaacatggaaacagaatatccaaacagccctattctagactagggccccaaatgtgagggctgtccttatcttactaaggatagagataaattgtattactcctctggggaaacccaacggatgagttcaccttccgagaatgttgaacctactcacattgtacaggcttctcatctttcagaaaaagttaatgacttctagactcctccttatcctactctgcttcaacatctccttacagcgcaaaccagcttggagatagcctttgcctgcattttgagcagtcaagacattaatcaaaagtcttgtaatgatgccatgggg

SEQ ID NO: 228714 - DNA, 412 bp, Homo sapiens
ccttttttgttaaacttattttaaatgctttagtatttaaagggtatatgtttttaattaatctgcatatttaaaaactttttgtaacgcgaataactacttcctgatttacatctcaatatattctcctttcatttgcccaattaaaaaaatatgtagtctctattattgctgtttactaatagttttagatcccaatgtgtattagaattatagctacaaaaagttgcaagtaaaatttaacaatttcctattgaaacaggatctcattattatgtttttaaatgtgtagaattaacactttaaataaacaggtgtgaaaattgtaaaggaatatatatgacaactattttctgtacattaacgtccaaacattatacttgtttttcataataaaaaacattttgaaaca

SEQ ID NO: 228715 - DNA, 805 bp, Homo sapiens
ctattatatgcggtttaaatccagataccagtaagatctgtatgttgtgattgattgaaatgttttaggaggttttcccttccatctgttttcctcttactattttatttgttgaagcaacttgcttatcccatagagcaagggttgggcaggattttgctgattacattcctgtggtggtgttcaacatattcctttgtttattgtattttttgtaaattgttaaggtggttgtagcatctagaggcttgctctcagattcagcgttaacaccccactccagcacacacacagccacctcataggtgtagtactgtattcttctatttggatgcacataatatctggttgtctttttgtgatggtaccagtcattgatgattcatacccaattaggggttgcagagggatgctattctaattctatcattcttctttattgggtggactgtttctagaaagagaaactttcccttatttactatttggttacccagtggtatcatttacacaggaaagccaggatatatgtttgattctttcctttttatttaccaattttcagaatattgagctgcttcactggcatctctgacagtggccagttagttcttaatttttccttttttcccctttagattcattttgaactcatggatttgaatatatgtaatgtattttggtccatcgcaggtattatccttaatgcttttgtccatacagtgagagcctcatcaggttggctcttgagtcttctcaacatgatcctagagactttgattgatccttgcttgctgggatgtaa

SEQ ID NO: 228716 - DNA, 761 bp, Homo sapiens
ctattatatgcggtttaaatccagataccagtaagatctgtatgttgtgattgattgaaatgttttaggaggttttcccttccatctgttttcctcttactattttatttgttgaagcaacttgcttatcccatagagcaagggttggtcctttgtttattgtattttttgtaaattgttaaggtggttgtagcatctagaggcttgctctcagattcagcgttaacaccccactccagcacacacacagccacctcataggtgtagtactgtattcttctatttggatgcacataatatctggttgtctttttgtgatggtaccagtcattgatgattcatacccaattaggggttgcagagggatgctattctaattctatcattcttctttattgggtggactgtttctagaaagagaaactttcccttatttactatttggttacccagtggtatcatttacacaggaaagccaggatatatgtttgattctttcctttttatttaccaattttcagaatattgagctgcttcactggcatctctgacagtggccagttagttcttaatttttccttttttcccctttagattcattttgaactcatggatttgaatatatgtaatgtattttggtccatcgcaggtattatccttaatgcttttgtccatacagtgagagcctcatcaggttggctcttgagtcttctcaacatgatcctagagactttgattgatccttgcttgctgggatgtaa

SEQ ID NO: 228717 - DNA, 752 bp, Homo sapiens
ctattatatgcggtttaaatccagataccagtaagatctgtatgttgtgattgattgaaatgttttaggaggttttcccttccatctgttttcctcttactattttatttgttgaagcaacttgcttatcccatagagcaagggttggcacaggcatctcatgtagtttgccagttgctgctatagagcttctcctttgtttattgtattttttgtaaattgttaaggtggttgtagcatctagaggcttgctctcagattcagcgttaacaccccactccagcacacacacagccacctcataggtgtagtactgtattcttctatttggatgcacataatatctggttgtctttttgtgatggtaccagtcattgatgattcatacccaattaggggttgcagagggatgctattctaattctatcattcttctttattgggtggactgtttctagaaagagaaactttcccttatttactatttggttacccagtggtatcatttacacaatattgagctgcttcactggcatctctgacagtggccagttagttcttaatttttccttttttcccctttagattcattttgaactcatggatttgaatatatgtaatgtattttggtccatcgcaggtattatccttaatgcttttgtccatacagtgagagcctcatcaggttggctcttgagtcttctcaacatgatcctagagactttgattgatccttgcttgctgggatgtaa

SEQ ID NO: 228718 - DNA, 849 bp, Homo sapiens
ctattatatgcggtttaaatccagataccagtaagatctgtatgttgtgattgattgaaatgttttaggaggttttcccttccatctgttttcctcttactattttatttgttgaagcaacttgcttatcccatagagcaagggttggcacaggcatctcatgtagtttgccagttgctgctatagagcttcgcaggattttgctgattacattcctgtggtggtgttcaacatattcctttgtttattgtattttttgtaaattgttaaggtggttgtagcatctagaggcttgctctcagattcagcgttaacaccccactccagcacacacacagccacctcataggtgtagtactgtattcttctatttggatgcacataatatctggttgtctttttgtgatggtaccagtcattgatgattcatacccaattaggggttgcagagggatgctattctaattctatcattcttctttattgggtggactgtttctagaaagagaaactttcccttatttactatttggttacccagtggtatcatttacacaggaaagccaggatatatgtttgattctttcctttttatttaccaattttcagaatattgagctgcttcactggcatctctgacagtggccagttagttcttaatttttccttttttcccctttagattcattttgaactcatggatttgaatatatgtaatgtattttggtccatcgcaggtattatccttaatgcttttgtccatacagtgagagcctcatcaggttggctcttgagtcttctcaacatgatcctagagactttgattgatccttgcttgctgggatgtaa

SEQ ID NO: 228719 - DNA, 660 bp, Homo sapiens
aggaggcggaggttgcagtgagacgagatcacgccactgtactccagcctgggcagcagagcaagactctgtctaaaaaagagaaagaaagcttgaggactgttgggaatattggaattattcttcgttatccttttacctttgtatagtaccttacagattacaaagtttttggatccattatctcatttcctcctcatcactaactgtgagagcctattgatagggctcagaagttgagtgagtttgccaaagttacccaagtaccaggacttgaatgtgagtcttctgacttcagtgttcattttacccatcacacctgcctcttaaagtagagattgtcatattgtcctgtgtaaccttggtcgaggctaccttcacattgtgagtgctaggtcctattgtggtgaacacaccttcgggccagcatcaccaaagtgatcaagggtgtagagagtctgctgctggacaggctaaatgtgccaggactctcctcagtggaaaaggatttcctcaaagtctacagatccaggaaggaacaaatgttaccttcaccatacaggcttaagaaaggcaaatttgggacattaagtaactgtgtagacttctgcttctggctaagatggactaacagagaccagacttacctttgtccctctg

SEQ ID NO: 228720 - DNA, 606 bp, Homo sapiens
aggaggcggaggttgcagtgagacgagatcacgccactgtactccagcctgggcagcagagcaagactctgtctaatccttttacctttgtatagtaccttacagattacaaagtttttggatccattatctcatttcctcctcatcactaactgtgagagcctattgatagggctcagaagttgagtgagtttgccaaagttacccaagtaccaggacttgaatgtgagtcttctgacttcagtgttcattttacccatcacacctgcctcttaaagtagagattgtcatattgtcctgtgtaaccttggtcgaggctaccttcacattgtgagtgctaggtcctattgtggtgaacacaccttcgggccagcatcaccaaagtgatcaagggtgtagagagtctgctgctggacaggctaaatgtgccaggactctcctcagtggaaaaggatttcctcaaagtctacagatccaggaaggaacaaatgttaccttcaccatacaggcttaagaaaggcaaatttgggacattaagtaactgtgtagacttctgcttctggctaagatggactaacagagaccagacttacctttgtccctctg

SEQ ID NO: 228721 - DNA, 283 bp, Homo sapiens
ccttattaataggtgacttttcattcagtcaacaaacatctgtaagatagttaccgtacattgtactgtattctgggtgctggggatgtagctaaacaaaataagcaaaaatccctttgctctgggagtgtacattccggttagaagagattattaataaataaattttatttatttttgagatggagtctcacactctgtcgcccaggctggaggttgcagtgagccaagattgcaccactgcactccagcctgggcaacagagtgagactcgaactaaaaa

SEQ ID NO: 228722 - DNA, 516 bp, Homo sapiens
gccctggctccacttggttttgtcctggttcctctgcaagccccatcacaccctctgtcccctgatgtggggacttctccctcttccattcttctcaacacagcccctcagaaaactccacctctgacctgactctgctttctaatatttttttcaataccttcactcaatgatatcttgcatgcaattcccttttcttccaatgatgaggagcataatagctaatttgttgtgttttgtggcagaagtatttaggtattttcagctttcagaagaggaaactgatgggtgataatagatatcacagtagcatattgttctgtagttctctatttgaacctaggtcaaaataaaaagaattggatttaaattgcagcacaatagagatctttttgatacctaaacaattcaacattggaatggattattaatggaggatgtgacattttactcttgaaaatgcttgggagtaaatagaaagtttaaaaaaaaaaagtcactcttgaaaaaaaaaaa

SEQ ID NO: 228723 - DNA, 236 bp, Homo sapiens
aagggtctgcgacgtcagtgacataaagcccaataggacagaaaaaggaagcacttctctcattggaagtgttacctagatgtgggaatgacagtgcagtcattgtgaatggaggtcctggggccgaaccgcccaggtgagaatccagcctctaccaggagaagctgctgaagtctcatttcttcacctgtacaatgggcagagttgctttgaggattaaatgagataatccatac

SEQ ID NO: 228724 - DNA, 446 bp, Homo sapiens
gcaagaatagtagatgtgaaattgttgacatttaaatctgaaataagatgaaatggcacttcttgtctcttctgcctccatgtgagaagccaacagtgcttcaatataggatcacaacagctatgtttttgtctccccttgcatctgctttaggaaacacctgtttttttggcaagttgttttgatatcaggtagtcaattaagctgcatcatattgagcgtcaaatcttaattttttttaatagcaaaaggtgaagatccagaggactttgaactacaccaggcatcatttgaaacatcatgcagtttgtacctctagttaccacaggtgaattaaaccagctaatcaactgcagaatacatctagtatttttcccaatggtgtgctgctctttggggaaaagatttaaaggtttaccaaataaagttttgttcctgcactaata

SEQ ID NO: 228725 - DNA, 443 bp, Homo sapiens
aagattgaatatttcagggtctaaaggtagatatgagaatgattttgaagggagttatcaggacaaagggaataatgagtttgaactgaggaagaaaagactgaggatttataatcttatttttcgttttgctcttcaaactttatttcaactttctaaccccttatcattatgagaagacatgttgtcattgacctggagttgtcttttatagttgtgtgaccatgggaatagtaatgacacttactgatcagtatatgaactctggcagagaactatatttagatcatcacttgttccctggatggcttccaccagttttgctatataattttggaactcaatattagtgcttgtacccctcccttgaattctgatattatgcttattggctcttttcctgaagcaattaaaccatcttttatttgggctaaaaattttga

SEQ ID NO: 228726 - DNA, 488 bp, Homo sapiens
gtaaaattcattacaaataatgcagtctttatcatttttattcaaaagaattttaagggttttcaggaccactgttttaagctttcaaatatccataaatcaacagcattcagtagagacgaagtagagtcatacaaacctgtgttgaaatcttgacttggccactgaacagctgtgtggctgttaccctgagctagtttataatcttttagagcctcaatttcctaatttgtaaaatggggttaataacagtaactccttgggtaattatgaggagtgaataagataatgcatgtaacatgcttagcctggataacatactccacaaacgttagccgttgtatgtaataaacaaattaattatctgcttttgtgagttattgtgtgggagacaagtatggatggcacagtgcctaagatcaagtagctcaatagactagttgggatcacaaatactgtaaccactacagtgaagaaagcaggaatcc

SEQ ID NO: 228727 - DNA, 458 bp, Homo sapiens
caatgatttgccagtcatctgttttagagttgcattttaaaacctacttaagttctgaaatatactcatcagaaaagcaaaggtgctcagtttttaacctgtgtattactcatagaaaatactcaactctcccagaaaaagtgaaaggcaattataaagaaatgcagttgccattctggtaacatgtatgccaaacaagtccttatcagatgatgaggttcatgaaggcaagagttacttgcatttactacttttatatcgctctcacaatctaacatttttcatacaataggattacaataaaactatgtagaatgactacgtgaaggagatcaactcataactcatcaattccagacactgtttttatcttttcagataaaagggatcgatgtccccaaagaataatgcccagagccaatagatctggcctctgaaagcgctgtggttacataaga

SEQ ID NO: 228728 - DNA, 704 bp, Homo sapiens
  misc_feature (540)..(540): n is a, c, g, or t
tccttgcaagcattggaagttaaaacatgatggccatttattgatgatttattgatctctctgtatccccttgggcactagcggattctcgacagaaccacaaagtggagttggctgcagatgagtctgttcatggccccagtttctcacctattcctgagtcaccttttgcccctcagacacagagatgggatagcgccaggatgtgggtttgtgttgtctaatttcttggagtttgtacaggttttacctggtaccagcgtgaccttcccatgtaccctcttggtcagcaactttttacaaggagttaatcccactttctggaacttgctcattctcaaagtgagtggttattggtcctcaagacagtccgcagaaatttcagccccatgggaaagaaaaaattccaggtctctacctgatgcttggaaagccagccatgttaacttagtcaacaccaatgctcatcaaatacacacatttatctagtgttcccaacctagattcccagcctgggattctgtgggccagagcccagtngtagagattatagcctaatgtcccagcagagaatcactgattgcagataggaaaaatccagacatttctgaactccaagaccacagtgatttatgtggcctggtgataagctatgattgatatattactcaaagtttctgcttcccccaactctggcaagaact

SEQ ID NO: 228729 - DNA, 738 bp, Homo sapiens
actgctcctttgcgggatgaaccgcattttatctattcatggacgctaggactgcttccacgtggcttctgtggacaatgctgtgaacattgtttacgaggttttgcgtggacctgttttcatttatcttgcatagatacctaggagtgggattgctggggcgtgtggtgaactttcataatgtcttgaggaactgccaagccatcttccgcagcggctgcattacctagttcccaccggcaacgctggggagggtcctggcgtctccactccctcgacagctcctgccgttgtctgtccttgtgattctggccgtcccagggggtgggagctggtgtccccttggctttgatctgcgtttccctggtggccagccatgtggggcctctctccctgtctcatccacccgtgcctgtctttttttcattcattcacttatttatttatttagagacagggtcttactctgtcacccaggctggagtacagtggtgtgatcacagctcactgcggcttctacttcctgggttcaagagaacctcccatctcagcctcccaagtagctggaactacaggcgtgcaccaccatagctggttaattagaaaaaaaaaatttggccaggcgcagtagctcacgcctgtaatcccagcactttgggaggccgaggcgggtagatcacctgaggtcaggagttcaagaccagcctggccaacatggtgaaaccccatctctactaa

SEQ ID NO: 228730 - DNA, 685 bp, Homo sapiens
actgctcctttgcgggatgaaccgcattttatctattcatggacgctaggactgcttccacgtggcttctgtggacaatgctgtgaacattgtttacgaggttttgcgtggacctgttttcatttatcttgcatagatacctaggagtgggattgctggggcgtgtggtgaactttcataatgtcttgaggaactgccaagccatcttccgcagcggctgcattacctagttcccaccggcaacgctggggagggtcctggcgtctccactccctcgacagctcctgccgttgtctgtccttgtgattctggccgtcccagggggtgggagctggtgtccccttggctttgatctgcgtttccctggtggccagccatgtggggcctctctccctgtctcatccacccgtgctctgtcacccaggctggagtacagtggtgtgatcacagctcactgcggcttctacttcctgggttcaagagaacctcccatctcagcctcccaagtagctggaactacaggcgtgcaccaccatagctggttaattagaaaaaaaaaatttggccaggcgcagtagctcacgcctgtaatcccagcactttgggaggccgaggcgggtagatcacctgaggtcaggagttcaagaccagcctggccaacatggtgaaaccccatctctactaa

SEQ ID NO: 228731 - DNA, 423 bp, Homo sapiens
tggtgttctggattaccagaataaaaggggtgggggaggaaagaaagtttagcaagagcagagttttgtaaatagtgttgtaacaggaaaaagaaaacggttgggtgactgtgccaacaggaagccactgtgagcttagaaaagagtctatgcattcctaccaggtgagggcaatgctgtaccataatcctaatataaaaaggatcattccgtatatttgtttgaggaaggatacaggttaatctagatggatcaaaaggtcttaaagttcatgcagaccctttcaatacctgtactaattacagcgcttcttccaagaagacgtggatggtcttggtaacatttatgctaagacaaagactgaagtaatttcagtaaattccataatgttaataaagcatacaagcttaaactctctggaaa

SEQ ID NO: 228732 - DNA, 643 bp, Homo sapiens
aaataggcatttactttttctatttcactaactgtatgcctcctatttataagacaaaatagaaacatgaggtttggttaattatgtacaacctctctatcaggcatctattaccgtagctcatatatatataacaaaaagttgtgtgggaggtgaaattttctatttcctcgtaactgagcacaaactgaaaaattctgatattccttactatttgagtcttgcttttttcctgagtgcagaaagtgaaagatcagaaagtgacagattccaatctgttatgtcttggatttttgggaggcatgagtccatatggtacacactaccatgtcttccaaatagccttatctgaaataaaaaaaataaattatctgaacccatttgttgtctaaatttgaatagcaaaggtttagatagcaaaggatacctttacacccattccaacacgggattagcaaattgattggaacttgcatgctaagtctgattgattagtgatatttctagcaagggcatgggaataagaagtaatgatacacatgccctataattgccaccctttttctttccaaaatcagtaatttttaatttgagctctcttatagatgaagcattacagcaatggctatcttggggagggaga

SEQ ID NO: 228733 - DNA, 157 bp, Homo sapiens
tgaggattatttgcatctgtactcataaaggatattggtctgtaacatctttgtctgactttggtatctgggtgatactggcctcacagaatgagttaggaaatggctcctcttcttttatttttggaagaatttatgaaggggttttgttaattta

SEQ ID NO: 228734 - DNA, 474 bp, Homo sapiens
aattgtagctttatattctcattagacattatatagtacttgatccataggtgtgggatagcagagtggcttatagagggaggaattggatagtgatttgggtgagctgttaatccaaagaaaggcaaaatttggtgggatagaggtagcattggattgggccagaactctgacgccacaacttcttagagcagctaggtcaaacatcatttttttgcactactttttctacccgtaagacaaagatgtggactagaagtttcctagggcttttcaggtttaagattctggagcttgcccttctttctctctttaaaaagatagaaaagaggaattgttctggcctttttaggatatagtagagagtgtctaaaagatatccttttagattgactttccccccctgtgatttagagattttgtaacttttcattggggtttttttttttttttttttgagacagagtctcgctc

SEQ ID NO: 228735 - DNA, 468 bp, Homo sapiens
ctgggcctcccaaagtgctgggattacaggcgtgagccaccgcacccggcatggaagaggataattctgatcatgaaaagttacccaggagaaggagatttgtagtgagagggcaggctgggcgtgctggcctacacctataatctcagcactttgggaggtcgaggtgggcgaatcacttggggccaggagttggagaccagcttgggtaacagcaaaatcctatctctaataaaagtacacaaaattagccgggtgtggtggcgagcacctgtaatcccggctacttgggagtctgaggcttgagaatcgcttgaacccgggaggcagaggttgcactgaggcgagattgcaccagcctgtgcgacagagcaagacttcgcctcaaaaaaaaagaacataaacttttaatgaagctggtaggctttcaagttcaaatataagtgatgtttaagaaaaaaaaaatct

SEQ ID NO: 228736 - DNA, 415 bp, Homo sapiens
ccataaataattaatcacctgtagttatatcactattgtattttatatattttaagatctacattttaacctctctgaaagtggaatatatctactaatctatgctaaattaagagttttactgggccgggcacggtggctcactcctgtaatcccagcactttgggaggccaaggcgggcggatcatgaggtcaggagatcgagaccatcctggctaacacggtgaaaccccatctctactaaaaatacaaaaaaaaaattagacttgcgtggtgctgggtgcttgtagtcccagctactcgggaggctgagtcaggagaatggcgtgaactcgggaggcggaccttgcagtgagccaagatggcgccactgcactctagcctgggtgacagagcgatactccatctcggaaaa

SEQ ID NO: 228737 - DNA, 427 bp, Homo sapiens
caaattaagaaagttttcaatgtaaatgaagaaggagaaattattttagctatgttggaaagttaactatcacagagaaaaaaagcatgctaaaaaaaaaattaggacaacagtggaaaagtatccagtaattcccatgaaaaacaacatattagggagttctatattcaggcagagagagagagagagatcggtgtaaagaaaataggtataatcacagtattggttttttgttttttgcccaaggaagtaaataaaatttaagaggtgagcctcagtagacctcatgactaaacatggtgttggagaaatgtactttgcctaaacggaatagccaacagatgaggtgagacaccagcaacatatatacatgagcacatgcatcttcccagggagacgtgcagttttgatcacattcttagggtgg

SEQ ID NO: 228738 - DNA, 417 bp, Homo sapiens
actgtgtgctgagcacgtggggtgctgcaggcccttgtgctgcagagaagctggcccttgcctcaggcggcagagcagggaagtgcagtgggcctgaagccatgcggggctgggagggatgacctggtctgtcctctgagccaggcactgcacttggaatgggcttcttgaacgcaaagcccagaccaagtgtggcagaaacatgaaaggacaggcagtcggctgctgtgggcgggaggcaggacgcccaggcctgtccccacccccgtgacccagagcctccctgggcagtgactccaggatgtccaggagcttcttctctacctcacaggactggagaggctgtggtgagacgcatcctgtgaaggctgggctggccacaggcagctccccagggcgcccaccgccatctgctcc

SEQ ID NO: 228739 - DNA, 509 bp, Homo sapiens
gcaaccaccactctactttctgtctctatgaatttgactactcacagaatttgacctcacagaagtggaatcatacaatatttttccttttgtgtctggcttttctcacttcacgtgttctcaaggttcacccatgttgtggcatgtgtcagaatttccttccttttttaaggctgaatatcctattgtatggacagaccacattttggttatccattcgtctgtcttagacacttgggctgtttccacctcttgctactgtggaaaatgctgctgtgaacaagagtgtgcaaatatctctcagagcccttgcttgccatgctcttggaaggcacatttttttaaactgcacacaaggagcagttgctgcaggccaagggaggccaggctgctctcttctttggtggcaaagctcatgtttgatggagaaagcagaaagtctgggaagccttgggtggaaagaggaggggtggcaggtgagtagagtcaggttggggcaatcccagcca

SEQ ID NO: 228740 - DNA, 271 bp, Homo sapiens
cagaaagggatcaaaacagtacctactacataggcgccccaggaagatggatgagaccatgcagtgagggcgcctggctagcccgtggtacatgagcacttgttaccactactgtccatcattattacaaagaagaagaaaagaggactgctgccatcataaggctatttctccaagttgacatgtatttcccatgggctcagatcaattccctcccacacctaaagaaggtcccctttaaaatggcaataatcatcaacaacacaagttc

SEQ ID NO: 228741 - DNA, 717 bp, Homo sapiens
tgcgggccaccacacccggctaattttttgtatttttagtagaaacagggtttcaccgtgttagccaggatggtcttgatctcctgacctcctgatctgcccacctcggcctcccaaagtcctggaattacaggcatgagccacagcgcccagcccgagatacagcatctaaagcataggtctttctgaaatgtgactccctgtctcctctctgtataacccctggactgggagtccccggggctccctccactctgcccccagagctgggctgcagcccctgggcctctctcacagccgtacctctctccagcagaaggtgctgagggtcctggcttgaggcccatcctccttctgcagggccccatgccggggtggctccagcacctgcaggccaaggcccgggagagtggggaagcaggacctggcaacgcggagcagtggaggggccagggtgcagctgcgactgtgccccctctactgctgaagttttgtgcccccagtggggatgacagcaggcagcacctccagctccacgtgacgtcctcaaggggagcacccaggccgaggccacatccagcgagaaggcatgcctcagggcgggagtgcaggtagaggatcctgcctgtgtccactgcctcttgggagaagctctgcacggggtccaggctgggtggctcatctgccaagatgccacgcagcaccatcaccaggtag

SEQ ID NO: 228742 - DNA, 298 bp, Homo sapiens
gtctgtcacatttcctttggtccttagtttttaggagctttgcttttaaatgggtatacaacacttcaaaagcatgggtaagctgtgatctaaccatttcccttattttgtgcattcagatgccataaagcactgtggtgagagtttggatgggcctgcaacttcaaatgcacattctacattaagtccagacacaaaacagtagtaagaattatgtcagtacacagtaggcatttaaacatcccaagaaaaagaaaaacattccctgaaggaagccatgagttgagaaaggacagcc

SEQ ID NO: 228743 - DNA, 618 bp, Homo sapiens
attgcaaatagaaaaagtagtccaatgcccaggcttgggaacagggagacatgagggtccagcatttggaagtcaaacatagctccttccaggaataatttctgtcacctcagagaaagcgatcgtgaggcactggtgatatccatatcccccttcacacagtcgtccacagggctggcctttcctcagtacagtaggcaattacccacaggctgtgttccaaagggtgccagagaagccattgtcactgccccacagactgcaggctctgtaacagaaactgcatgatcagtgactcattaagatttccatgttcagagaacctcttcctaaaagccaaagaatcttagtaggattaatatatccagattgtaacatttagtattggtaagttcatcaggtggcctgtgaatttcagatcagagggctggatttaagagctttgtgctgaaagaggagagcaaggccatgaaaagcaagatgtggaagatgccaaggatcaattttgccttcataattttgtttaataatggtcttggtcaccagcatagagtctttaaagtgaatgcatgcccccagagggcttgcaaaacaatccattgagatgtgagaaataac

SEQ ID NO: 228744 - DNA, 976 bp, Homo sapiens
ggctcattaaaccctatagaactaacagcttttaaggacattaacagaaatatatcttcagatggataaataagatagggacctattcaagacagcagcatttttgtattgtgatacctcccctaagttactctcacaataaaaccttatttgagaattttccttcacttcaatctgtgacatagcattaggcatttagtataccttatttgtgaaacctaaggttcattcaacagatgaagttgcaaaacagttttcttggtagactcttggaacttgctcagttttttccttactttacctgcatgacacacattgggttgaaagttgtttggttttacccttcatttctcttaaatatgatttggttctttttcatgcattatatttttgaaatatatggaggaaatattttattgaatcaagaaatagaaaatattccttaaaccggtagtaaaaaggtgagttagaactccatgtctggaagacaattcaacttttaaaatattaagatgctataccacttaacaagtgaatactaaaatttttaatttaaagattgattgttctgtttttatgaccatgagaaaaatgtgacagcttcagctgtcatatgtttatcttgaatgcttttctaattatgtatttctggattattgactttgaatgccacagaccaactactttacatagagtaaaatattgattaacttttgtgctttgggtcactggcaaaagttgaacatcctgttaagtcaaggttaaccagaaacctttttgttcacgtctgaaattgaatatttataaaatgtgttagtatgtttcctgccttgataagttcacctatattgaatgtaatttgatctttgataattttttttaatcttgagaattctctgatgctgttttgaataccagtgttcaccatgttataaagttaaacataaaaattgaaataaattgaactaaatatgca

SEQ ID NO: 228745 - DNA, 487 bp, Homo sapiens
agaaactttatagtactacatttcatcaattgtaaggcatttttttttccacataacatttcagaatataggatacatcttaaagatgatggtgttatagttttaagtggtggtgttttttctttcttagcagtctgtaaaataatactgatagtgtctttaattcagtgcaataatgaccaatcatatgacatagctgcgtaagaacaggaactttgtctatagccaaatcatgaaatctgtgtatcatttttacccaaaacaataataaggtatctagttatccatagcagttttctgtaatctatcatacatattaaaaatatacaatttctctccttggttaccttaagttgaaaacagtccacagtgataataaacatactacaaagaataaactgctgaagaaatgccaaaacaaaataaagaaggttttgcgtttatagtgtatgctttctatgggggaattgaataaatgttgtaacac

SEQ ID NO: 228746 - DNA, 515 bp, Homo sapiens
ctcagaaggagcaaaaagcagagcagaatctaataggctgcttgcatacctgtcactggattcgatgaaatcctgttgtttattatgcacatgtcacatacctcaaaaatcaagttcttgggagagggaatttaattggcctaacttgtatcacccgcccttgggccggtcccaccaatttgcatgtaattgggtacagaattaaggtagtccccaaagaaaaaaatggtgctattaacaaatagagaagtatatgctgggtaggcaatatcaacagatttcgtctatgttaactttgagttggtttgctactagactgcagccttgttttaatatcaatttttttttctcgaagaattttactctttcaacaccaaggaaactcaagacaatagaaaactactggacaatagcaccaagtaatgtatttgtgtgtgaagactcactaatttatgcaattatacctcaatctatgcagtatcttcctaaagattattaaaaaatcaaatgtattt

SEQ ID NO: 228747 - DNA, 624 bp, Homo sapiens
gtcatgttttccaagggtgatttatattcctaggggatttgggtggttctcgcttctcaaaacccatatcaaatgactttgcctgtgactttttacaaaaattcttattctaatacctctctgcgcccttcccaagcacacagatgatgttcagtaaatgccagacctctttcctcccatttcccatgtgccctgcctccctcacagccagtctgctctccttctttcctcccttcctctctttgccctcttcatccctctttcctttcccactatattctcatttgtgcaatttcccagttaaggtcagtgtcaccctgacttctctttctttttttaatcatcatctgtctttcttgacatttcacatcctgaataatttccttcagagaatcagttctttaagacatcagaacatgagtcaccctgcgaggtaccaccagactaacaccagggaccagcacccattctagcaaaacactgcctaagcagcctgaactgcgctagtttctttaatgagggttgtagcacagaaagttgctttcttttttttttaaagaaaggaaatcctctagcccaactaagctttcctgttaaacaagtgctttgagagacccattcaga

SEQ ID NO: 228748 - DNA, 250 bp, Homo sapiens
atccagtgtttcttccctttatttttttcttcataaagactaaacacactgttcatatcattaagaaaatcatgctcaacactctaaactgggctttcattctcaattctaatatcaaggttaattatgtattgatttaaattggtcttttttgccttgaatattaactcacatacaattcagtggaattggtttcttggtgtgagatacaaaatgctttcttctttacaaacataggcttgacaaggta

SEQ ID NO: 228749 - DNA, 325 bp, Homo sapiens
gaggagggccaaagagttctgtttaggccacatcaagtttgagaagcttatgaaacattaaaatggctgtgccatgaagcagtaggcactaccgtgaccaccctatctaaaactgccaatccggccgggtatgatggttcatgcctgtaatggcatggtggcgctcacctgtaattccagctacttgggaggctgaggcacaagggtcacttgaacccaggaggcagaggttgcagtgaaccaagattgcaccacctcactccagcctgggcaatgaagtgagactctgtctcaataaaataaaataaaattccaatccttcaac

SEQ ID NO: 228750 - DNA, 475 bp, Homo sapiens
tgagctcaagtaacccaccctcctcagtctcccaaagtgctgagaatacaggcgtttgagccaccgtgcccaactgataaaattaattttgaaaagtattataaatattgtatgaggaaacagaagactgtcatcctggaaagccaaggccccagtcaatcacacccagaaactatgaggacttcgtacaggagacgcaggcgtagccagaagcgtgagaagagccccttctcccccagcaccagggagtggcgtacctcgccgaggtaaacctgcggtgcctagagctgctcgttcacacgcactatctcctcttctttgttgggcagaaatgccggtggaaatggtaataacaacaaccatatcaaaacagagccgacagaaccttaatagggaaatattccactgaccctacagatatgaaatgtcctaattaaataagcctacagttttaaattggaaaaatggaaaatca

SEQ ID NO: 228751 - DNA, 493 bp, Homo sapiens
tgtgaatgagatccttgttggaactctagagttgcttaccagagttcaaagaaaatgaaaaaaaaaaaaaaaaagggaggcagggaaggctggtgaaaaaaatgattcaaagggtagaaaatagatctctgaaggaaaatcttgtaagactggagtgttcagactagggaaggaaaaagagggtaaattaattcctaacctcaaatagcaaaaggtttctttttttttatgtgaatctttgtttctcaaagaacgttctatggaacccaagttctggagcggggtggcttctgaagtcaggtcagtcccccatggacaattcccaaagcacatttgcatctaagagggactgaggatttctgcagaaagaaccccattttactttgagtaacctactgtattccaaacattttcatctctggaaatttttagttttctaacacctttggaaaatgctgagtcagaatcactaagatgatgttcagtataagag

SEQ ID NO: 228752 - DNA, 228 bp, Homo sapiens
agcttatgggaggagttgtcggtgaggacactgaacctaaaaatggtgaagcagttgcagcaaactggcttttatcccatcagtgtctctctctcaacatcctgcatctgagtctggaagacaaactttttctgcttgtgaacctggcccaccagagcttttagcaatctggaaacagaactgggaacttccttgtaaacttcctgaagattgataaatgacatctat

SEQ ID NO: 228753 - DNA, 566 bp, Homo sapiens
ggaacagatggctgccccagggctttccttcatgttaaaagaacaacagtaactacatgtaatcaaattaaaaataaagcaaatgcacatataatgacactaaaataaaataaatgcctctaattataggtgtgtatgtgattcctatgtctctgggctattctttatcagaactaagaatgaactctggctgctgggtttattccaaagcactatccctcccaaaaaggtctcaaagtcagtttggccaagggcagtgaactttcatattaaaaagagaaaaaggccgggtgtggtggctcatgcctgtaatcccagcactttgggaggtgaggtgggcagatcacctgaggtcaggagttgaagaccagcctggccaacttggtgaaacctgtctctactaaaaatacaaaaaagtagccagacatggtgatgggcacccgtgatcccagctactcaggaggctgaggcaggagaactgcttggatccaggaggcagaggttgcagtgagcctagatcatgccattgcattcctgcctgggcaacaagagtgaaactccatctc

SEQ ID NO: 228754 - DNA, 280 bp, Homo sapiens
taataagtataaaaacaaacacacaacggagagaatcaacaaagccaaaactgaaaccactaataaaattggttaatccctaaagagaatgattaaaaggaaacaatttgacagttttcacaaaaggcatctgtgaaaagaaaaagaaaatagaaaaggaaaaggctgggcgtggtggctcacgcctgtaatcccagcactttgggaggctgaggcgggcggatcacctgaaatcaggagtttggcaccagcctggctaacatggtgaaaccccatttct

SEQ ID NO: 228755 - DNA, 215 bp, Homo sapiens
gggctctgaagttcagccttccctgttatttcccttcctaggccaagaggttgattggctgtctagggaaggtgggtttaatgacagctttataggagcaccagccaagcagggaacatcacaccaaatgtggtttgatacttctcctgcccctttgcctacggcacagatgctgtggcagctccaagtcttgctcccttttctttttgagacag

SEQ ID NO: 228756 - DNA, 775 bp, Homo sapiens
ttgttataaaagactttgttttggatattccttttagaactgtaaaagagtgaatgctttccctctccacccatctaccttgcttcaaagtacagaaatgaataggtcaatcctaattgcatgcttctgtctccaactaaaccatgacctttttttaaaaggacatttcatttggccagaacaggcttaattaaacaagtgtgttacttacatagagtgtctcttatcttcacaagtttaacacttaaagctgccttgtgataattttaacaattagttggagacaggaatatttataattgaagttgattattgacttctaagtcggtttaagaaaaaagaatctgacaggtttaattctcattgatatgaaggttaatgagtgaagagtgacagattttgcagtgctgtagtgttatgagaaaggtcatggtttagttggagacagaagcatgcaattaggattgacctattcatttctgtactttgaagcaaggtagatgggtggagagggaaagcattcactcttttacagttctaaaaggaatatccaaaacaaagtcttttataacaacaaacaacttctctcagatctaaactggaattagtgctattatgtatgaaatgaaacacagatttaaaataagaaatcatttcccattcctcactgtccagattcttactagctattctgtactgatcttagttaactggaagtttaatacctggttgtctatcactggcagaatagataaataaataatggcataatcat

SEQ ID NO: 228757 - DNA, 528 bp, Homo sapiens
ctgataaggtctgttaggttagatataattgctattttattttaaatcacagcaaagttatttgtgttcacccttgggtttatttagaaaatacaaggttacaaagggcttccaaagatcattattagcagtaagaagattaccgaggaaaggaaaagtggtaaggaagtgggaagaaaaccgaagactgatgactgaataagatcttacatatttgcatagctcagaaatttgaatactatatccaggagtctatttttttttcaacttgtaaaaaatggtagtaaaatacaaaaaacataaaatgttctatcttaaccatttttaggagcacagttcagtgttattaaatatattcacaatgttgtgcaaccattaccaccatccatctccataactctgttcatcttataaaactgaaactatggccgttttaagtccccattgcccttcttcccagtaaccactattctattttgtctccatgattttggttactctatatacttcatgtcagtggaattacac

SEQ ID NO: 228758 - DNA, 367 bp, Homo sapiens
atcgtggctgaagacaaatgaggagcaaagtcacattttccatggtggcaggcaagagagcttgtgtaggagaactcccctttataaaaccatcagatctcatgagacttattcaccatcatgagaacagcatgggaaagacctgtaccccatgattcaattacctcctactgggtcactctcacaccatatgggaattatgggagctataattcaagatgagatttgggtgaggacacagccaaaccatattacagtggatctttctttgtctcatagtcctcaggaggaaccaatcctgtgatgtattgattttggacttatagctcctagaactgagagataataaatttctgttgtttcagcc

SEQ ID NO: 228759 - DNA, 1066 bp, Homo sapiens
aaaatggcagggagaggcagtctgtggaccaagttcaggtgaaaggatcacccatcatgttgggcatcagatcaggcaggttcacacactacctgaggaagctggtctttgtgacagacaagagctgctctgcctcttgggaaacacaggcaccagttttagtgccatcttcttgcacccaaatgctgtcctttaactcatcagttacagtgctggatccctcatcactgccaatacggggctagcaatatgtctgccccagtgaatgcagccgccacggagccccagcctcctctatggcaggggccctgtggtggggaatgaggacttctctatcattaacctccatgcagttggctcaagaaaaggatatggtagttgggcaagggggctcacacctgtaatcccagcacacttgtaatcccaggagggtcgcttgagcccaggagtttaaggccagcccgggcaacatagcaacctgtttgtaggcaaaatgaggagttgaagttccccgtaggatcttctagggctcaaccagccttcatgtgcagtgggactggcaagaaatctgtcatccctgttaccactttgaaggtctcagtgtgtatgcaggtcctgaaaagttcaagtcccacctgaaacgcaacacagcatcatgctctgattcatcagtgattccctaatcaatgccattggcttgcattgggactatctatcccagcctatccagtgacttcagcagctgcagagccccagcctcttctttggcaggggcactgtggtgaggaggaaggattcccttatcacaaatctccatccaattggttctataaacagatatggtggcccaactgttgcgggaagtcagggaccccgaacggagggactggctggagccacagctgaggaacataaattgtgaagatttcatggacatttaccagttcccaaaattaatacttttatactttcttatgcctgtctttactgcaatcactaaacataaattgtgaagatttcatgaacatttatcagttcccaaataatactcttataatttcttatg

SEQ ID NO: 228760 - DNA, 437 bp, Homo sapiens
ttgcccagcacaagtgcatcactgaagtcccaagtcttgaacgtggccttggtcttgaggaagtcatgaacaccctggctagtgagggtgcaggctgctccaggatgatggtgtctaaagttgtgcacaaggtcacaggccctgcagaagcatcacccctcaggaatgggtagtacaggaagtccatgcacaggcagatctgctggtgccattacactatgagggcactgagctcaaatagggtggcaatatattcactgggattcctgcaaggtgaggctggggagaggaagcagctccataacacatatgaaaccctggaaacccttctcagccaaaatctcaggaccacattacacccagaaatgggtgccctctgagcacaattgtctctctgtctcccactctgagctccctcatggccccacatgccccag

SEQ ID NO: 228761 - DNA, 857 bp, Homo sapiens
attgaatagtacgattgagagatgagtgctatggagaaaaatccagccagaaagggagatgcagaagatagcaccagatcttctcaatgttgttttcatcatggacaggtgcgttccttagaagatgaagtgttagtgattcctgagtttttctcaccttcacgtcgattgatctgaatttggagagtctgttttctgtgtctggctctgcactcaactttgtaggggaccctgtcgaggtccccacactgtggcttcaggtagacagagcagatgggagcccatttcagttcattgtcttgctgaccaatggggaactgtggtcaggtgagaggaggcagcttttacaatcagacttcattgaatagtgtgggctgctgtttccttgtaacaaaaccccataatgatggcagtttccggatgtgtctttttaggacttcagaacttattatttgaatagaagtttaaagcatctggatgatgatgctgtagctaaaacagctgcttgtcagaagagaccctatttaacacttctaaacttgtttcagaggtggaggaaaggataatctgggaaggcctccctctcaagtccacaggttggtatcagctgtgttcatcccccaaaaggaaaataaaatgacaacaatattttggtcacagaattcctgagaaacctctgtttctatcttcatgtctttaagatagggacatgaattccccatgatctgggtgatagggttagggtggccaggacactgttactttgtgtgtgacacaggtggctcctcatgacagttcctccatgccttagaacatgttgtctgtctggtcatccctgggggtagagctgagtgacc

SEQ ID NO: 228762 - DNA, 208 bp, Homo sapiens
attattgacttttaaaaataattttctcttcttttttccctgaagataagtcccatagactcagcatggtctaaaatgtgtaaaactaccttgtcaagtactgttattatctctatcatgggttttcttgtttgcagaaattttttaggttaaattctatcctgcatgcaaatttttctaaaaggagttttttattctagttctaaaa

SEQ ID NO: 228763 - DNA, 414 bp, Homo sapiens
cttaaggattttagaatagttgaccagagagcaagaagacaaagtagtcttaatcctaagaagattaggagcagaagagccagggagagtaggccgtggtgagggcagtagtggtgtttaacaaagaaggctaaactctggcacccagagtggctaaactcagccacccaaacagctgtggctatccagacccagaacaaaagcataacacacaccagtccttgctgtaatgctaggctttaacattgttaaatgttgaacaattttgtgatattagggttccccccgctctctctctcgctctctctttcaagcccttgaaagtcctcaaaccagtccagtgtgtagtctgtagattataaccttcagaattaccaaagatatttcagtacaaaaaaaaaacaggggaaaaac

SEQ ID NO: 228764 - DNA, 422 bp, Homo sapiens
aggtgggaggatcacttgaggccagaagttcaagaccagcctgggggacatgatgaaacctggtctctacaaaaaatacaaaaaaaggcagggtgcagtggctcatgcctgtaatcccagcactttgggaggccaaggcaggtggatcatgaggtcagagttcaagatcagcctggtttgagaatctggtctctggttcgagaccagaccaggagttcgagaccagcctagtagatagaagatgaaaccccatagctactaaaaatacaaaatttagccagcacggtggtgggcacctgtaatcccagctacttgggaggctgaggcagaagaattgcttgaacctgggagacaaaggtggcagtgagccaagatcatgccactgcactctagcctgggcatcagagcaagactccatctca

SEQ ID NO: 228765 - DNA, 429 bp, Homo sapiens
gtaacaagaaatgcctcagcagatgagctctttgtaaaatgaagaggccttctacaccaagatatggatgtttgagatctagcttcatatgcattgcaaatctgacactcctacatatatttaggcacaaaacaagagattccattatatataatccagtgttaatcatttgccatatcagaaaggtaaaggacaattcattcacgcatccattcatttaacaattattaattgagcactgtgctagctgaacaattcagatttgttgcatgaactcccagaaattatagtctgtgggagatgtgaacttataattaggtaattacaatagactgtgtaagtacaatgatagagaagtgcagactgctacaaagtttaaccattttaatataacaatactaaacatgcacatatttactaaaataatct

SEQ ID NO: 228766 - DNA, 334 bp, Homo sapiens
tgcggtgggggtggtgggtggggggagaaccactcttctgaagtggatatttaccttttcaggcgtgttttcataatttagcttcgtcagtctatatccacaaacaatatattatattattttgcaagtacttatacttttaaaaaatgatctcatgtgaggatgtcctattgtatcatattttttcacgaaacattattattgttatatccatgttgtgcatacaggtagacttagcttattaatttaaatgaggtataatattccatcatataaatgtaccacaagttgttatccatttgctgagtgttaattttccattaaataaatgcct

SEQ ID NO: 228767 - DNA, 1067 bp, Homo sapiens
gatcctgggaagggaaaatgtatgattttacctgtaaggaagcacttagtgtagcagaaagcacatggcctttggaactgggcagatatgggattgaattctagccctagcatttccttgatgggcaaacttctgcaggttacttaatctctctaaggcccaatttcctcacctgtaaactggtggtattacttgaccttgcagaattgctgtgaagtttggaaataatgcatgttgggtgctcaataagtagtagttaggaagaataattactgtgttgagtaatttatttgttaattgttataaaaacaattctctatcctttcggaaaaagggaccaaatgcaacataaaaatgttttctcttgtcactgcacatttaactgtcacagagtcccagaatgtcagaactggaagaaactttgctcctctaacccaaccccttattttataggcacagcaatagtcccaggaaagtgtagtaatttgcctaaagccacccacagaagtggttagtactagagccaaaactagaacccgtatctcctaaccccatacccttcccattatataggaaaagatatgtggttatataagtcttgcagaattctctgccatttcaatattcgctttactaggaaagttaagttgtacctttatttaaactaaggcacacgtagaaggaaactaatcaaacttgggcaaaggtaggttgtgcctagagcttgcttgagttctgagtgggacagttagttttttggtattggggtttgtttgtttgtttgtggttttacagcaggtggagtgggttaagtataatacatgaggccagtcatggtggctcacgtctgtaatcccaacactttgggaggccaaggtgggaggatcacgtgaggtcaggagttcgagaccagcctggccaacatggcaaaaccccatctctactaaaaatacaaaaaaatcagctgggcacggtggcacgcacctgtagtcccagctagtccggaggctgaggcacaagaattgcttgaacccaggcggtggctgaggttgtagtgagccaaaatc

SEQ ID NO: 228768 - DNA, 912 bp, Homo sapiens
gttcttccagcacatggaccaatacaggcactctctcattggacctgcattaatttgaggttgcttcattttgcctcttacagtgactcctacagagctaggcttgctgagtctctacggtgactgatggagtcagttggaggggccagttgctactgaaaatgctcagagacctaactcctaatttacccataaacaccagctagccaggctgtatcatgtctgctgtaattagttagcgagctgacttagcacctcagtgctataatttaaagtaaaccctgaacagtcttagacttgagtatgcacggtacagttaagtttaatctgtatacaggttgtctctttggagtctgggaatcagtttatgctattggtcttctctgacaatctccaggtcacgcagatttgtactgtctaggacataattagcctagattatactcagtgattgccagcttcacagtggcctgtgaacaaattattttgtttaatgtgagtgaatcaataatgtgtcagcagtagcatcactactcacatgctataaaatgcaagacagagttcagatgtttttatattttaaaatagaatgtatattccttactgtgttaggtgattactagtttttttaacagatgaatctgcttctataatagtgttctaccccaagaaaatattgctgacacaaattgatttatggaaagttttatttgctactacctataaatgagttgtgctggaatttgttgctgtatctgcagttcttagtatttgctaatataaaagatccttgttatcttagtgccaaaaggctacttaaatgaattcataaaatatccttaccagaaattcataggaaacagtgaaaaaagtttgttactttactttgaaaaataaaaacctcaaaagttt

SEQ ID NO: 228769 - DNA, 507 bp, Homo sapiens
gagacatatcttaatagtaatacatgttaagtgctttgattcaattcctgttgttgaaacccaaaagcaaaaaaaccccaaaacctttgagaaagctgctggtaccaaaatggagtcacttacattaaactccagcaaaatggagtggtgggaggccatcaagaagccctcacgcccacatgcctgaaacaggacttatcccaagactttcctgcacccagaccagcatcacgacttagtgcaaggacttctcgaggctgcagtattccagatctgccaccagcacgcaacactgacctggcaacagccgcctcccccaatcaacagagccaactcctgcagtgagcttctgtcacctacgagccttgtttcaaagccgctcatgtgtacatctgtttgtctttaaaagattcctctttggctgggattacaagcatgagccacctcacccggcctaaaatctggagatatcaaacctaaatatatattcccttcttttacaaagtg

SEQ ID NO: 228770 - DNA, 486 bp, Homo sapiens
tgcttctcctgttccataggcacaaagatacaagtgcctggtcgctctagtcctgcactgtgaaaaatctcaacccagttttgcttagaccagacaaaggtggtagctggctgagaattagctgtagagcaggctgtgtgaccgagccgtctgtgtgcagccatgttcagaagcccagggttttccagctatttgggagctttcaaattctctgagaaacaaggcttctgcctgtaactattgaacagccaaaggcacttccttaggggaaggagtttctatttcaacaataaaaacttaagcttcattggattcccatgtcaaaggaaagtttcaagataaagtagccttgtctcaaggactgttaaattttgaagatttgtcgtagcttttaaaattattctcttgaatatctaactcttaagtttcaatgtttggcaatatgttttctccctagaatttgatttattaaaatgtatgaagcaa

SEQ ID NO: 228771 - DNA, 396 bp, Homo sapiens
ctcagtttgggttaatgattaccccactcactgattgtgtgacactggggataagtcacttttcctctctgagtcccattttccataaacaagaatagaaaggtgctcttggccaggtgtggtggctcacacccgtaatcccagcactttgggaggcccaggtgggcggatcacttgaggtcaggagtttgagaccagcctgaccaacatggtgaaaccccacctccactaaaaatttagccgggtgtggtggcattgcctgaaatcccagctactcaggaggctgaggcaggagaattgcttggacctgggagacagaggttgcagtgagctgagattgcaccattgcactccagcctggatgacagagtgagactccagtgagactccaactca

SEQ ID NO: 228772 - DNA, 486 bp, Homo sapiens
agtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggattttagaagcattggctgaccggtgacaatgaagttaacatttgtacagatc

SEQ ID NO: 228773 - DNA, 489 bp, Homo sapiens
tccttaagtccttagctctcactgcactccttcccaattctccagattgactgtctcagcctctgagccactgcacttactgtttcctctgcctggaaaactactccccagcctcccactttataataattttcatccttgtctcagctccaacctcaccttctcaaagaggcttggtctgccagattttaaaaaactgcaccccgggtcaggcatggtggcttacgcctgtaatcccagcacttcgggatgccaaggcgggcggctcacttgaggtcaggagtttgagaccagcctggccaacatggcgaaacccagtctctgctaaaaatacaaaaactagccgggtgtggtggcggacgcctgtagtcccagctactcgggaggctgaggcaggaggatcgcttgaacccgggaggcggaggttgcagtgagccaagatcgagccattgcactccagcctgggtgacagagagactccatctgaaa

SEQ ID NO: 228774 - DNA, 556 bp, Homo sapiens
ctcagtcaagtgtcctctgctctaatagttccctacctggttgggaaaacaagctacttaaaccttgtcttttagtagttttaggagataccatttttggcacttgtgttatgttacattcttgatacacaagaggtcagtagcgttctgcttataagcatttcttgaaatcaaacatgggctaaacttcatactttggttgtttttttttttaattgaagctacagtgttcaccatactttcattgtttttcttttttctgccacttgcttacatcttaaggaaattgctttatgggtgaaacattttccaagcattgttggaaattttttactggttaattggacttgtccacaattaaaaaaaaagtttaaaccttttcagtaattcagactaacagccagaagtgaattaacttattttaaatgaaggtgaaactataatctgaatgtgtgagtttagtacaatagagaatgaatttgtattagtggggaatcattcttttttctccctagtagttgttttttgttgtcgttgttgctgttgtataaaaaaa

SEQ ID NO: 228775 - DNA, 365 bp, Homo sapiens
gcagaggctgcagtgagccgaggtcacgccactacactccagcctgggagacatagtgagactccgtctccaaaagaaaccaaacaaaaaaaagaaaatctaaatataaaaccaaggttgtggaacgtcccatcccagggaaagaatccacaatcctgttttggtcaagctgacacctgccagaccagcaggtggcccattactcaaaatagtaatggaaaccagacatgctgacttgtgcatctgaactccatgtcctgaccccctagctgcagctgtgcctcggtagaacaccccttttcgttcctgtcttgatgattgttggagcactctgtaagtttccctaataaatgctttggactgat

SEQ ID NO: 228776 - DNA, 604 bp, Homo sapiens
ggctagaaaaagcctgtattgctgagaatagagcattaaggacaattctgatgaggattcagaagaagagagctgtagggaaaatctggaacttcttagagagttgtcatcagttggtagaactataagtggtaaaggtctttctgatgatatctcagaaatgaagaacaagatactggacactggagtaaaggccatccttgttaaatagttgcaaagaacttggcgaaattatgttcatatcctaagactttatggaatgcagaatttaagagtgatgaactaggatatgctgcagaagaaataactcagcagcagagcatttaggttactggatggctacttttaaccacttaaactaagctgggggaagggaatgacttgaagacagaatttataattaaaagagaggcagaatggaaatacttggaaaatttgcagcctggccatagtaaagaatgcaaaaggtatgtttaggagagcaaaccaagggtgtggtccaggaaccatttgctgaagagattaatattcctagaggagacccaagggctatttatcaagacagtggaaaaagaccccagaggcattttggagatctttgagg

SEQ ID NO: 228777 - DNA, 493 bp, Homo sapiens
cagttattatgaagtgacctcgttgtcttatgtcatctgttttgtatttagcaatagacttcaagatggagatacagctgatcagagtgtgctgagcctggcattagtttcacaaggaaatcaccatgccctggccatattctttttcagcttcgaatgcgacattcattacatgacgatgagaagatactaatttttcgatttagacattagagtcatgtgcagttcagggcatggcatcagggtgggagaggtgctggatgagctctgtgatgtaaggaaggagaagtggctaggatggccaaaggtgggaggagggggccctggggatgggttgagttggaagagctgtggaaagcatgagtcccaggccgggccctgtggctcacaccgtaatcctagcactttgggaggccaaggtgggcagatcacttgaggtcaggagtttgagaccagcctgaccaatgtggtaaaaccccatctctgctttaaa

SEQ ID NO: 228778 - DNA, 378 bp, Homo sapiens
caaacaggtatgaagatggcaacgattataaaatattgaagaaatggctgaatgagttgtttaatgtaaacggtaccagtattgagggattgatagaccaggtactctttgcaaagacttcagtttcagaatccaactgggtttgttttatgttgtcaaagtcattttgggaataaagaaagacacaaaggcacgagaaaaattttttaaaatctgctttgggagacagaatgtagtaattaaagcttcttttgtgctatgaatcatgaatgttattaacatcttatttacttagaacttgtttattctattgaaaatagttactatacaaaaaagacacctttaattttgtgtttaaatatattcaaattaaaacca

SEQ ID NO: 228779 - DNA, 583 bp, Homo sapiens
tgaacggattcttgggtgctggtaatattctatttcttgccttgaatggtagttcttacaagtatttgctttgtagaaaaaatcactcagattaacaactaggttctgaacactcttctttctgtattacatacatcactaaaagtgattttaaaaaaaaagcaaaacataataacaaacatagcagagtttagcatggctaacttcagccaactggaaaattaaattacactgaactgctcacttttcccccaagttccagtaattgagggattaaaaatcttaagatttggctttcaggcagaccaaaaaacccctacaaatattcccccagctaactcatgtaaataagtattcaaaacagaaataacatatattgcattgtctgatttcctataatggttttctttttaaaaccccaaaaacataaaaaatgcaaaaagaaagaggaagagtaaggaaagaaaaacaacgaaagataacataattagctcccaataaaccagacattagacaatcatcaattcacttctagtgtttactttcaagttacctttaagtaaaacatgagattttcttagtg

SEQ ID NO: 228780 - DNA, 257 bp, Homo sapiens
gtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtga

SEQ ID NO: 228781 - DNA, 870 bp, Homo sapiens
  misc_feature (656)..(656): n is a, c, g, or t
  misc_feature (661)..(661): n is a, c, g, or t
  misc_feature (663)..(663): n is a, c, g, or t
tgcaacttcacagctttaaggctgtctaaaggtcagcaaaacctaggcacagtttaggacaggattagaacaggagagcttaaggccgggcatggtggctcacgcctgtaatcccaacactttgggaggccgaagtgggcggatcactggaggtgaggagtttgagaccagcctgaccaacatggtgaaaccctgtctctactaaaacaatacaaaaattagccaggtggtaaagagcagtcaggtgcacctgtgaggaagtcaggtgccgtgactcagactcgagtaaacacgaagtatgagttcaacccagaaaactgctctctcttgggttttgcaaacttgtcagaaataaatcactaactttagaaagctttggtgcaagaaaaaaaaaaaaatttagccaggtggggtggcggacgctctgtaatcccagctactagggaggctgaggctgaagaatcacttgaacccgggaggcggaggttgcagtgagcagagatcgcaccattgcactccagcctgagtgaccacagtgaaactgtctcacaaaagaaaaaaaaaaaaggagtgggagagtttaaattcagataaactttaaattttaaattttttttgtggggacggattctttgtcggcccagggtggattcccntctcncnatttttttctattcggtggacgcggccgggggctcccctgtattccggcttggaaagggggctgggggggccctctggggcgggttcaaaccgctggcagttggtgacccctttcctcacatctacattcggggggcggggcccgttgtcccgattcagaagcgggagaacgctaccggcaagttgggccgtatgtgttcccggatc

SEQ ID NO: 228782 - DNA, 275 bp, Homo sapiens
aagacagtgtgatgactactttttggaataattgtcatttctttctgcatagacgtaatctaatatatgcagttttctaactaatttcatcattttatccagtagaaatgagccttcattatcagagataagcaacagcaaagagctaaaggtacctggatgcggtataatcttcgaagtttaaaggcaaatagtcataagtattgagcaaaaagaagtctggaaatacacatatagtaacctaattaaagaggcataaatgcctgaaaaagtat

SEQ ID NO: 228783 - DNA, 494 bp, Homo sapiens
gccggctctgcccgcgggcgggtgtttctctcggggtcgtagggtcggagcggagctcaatggcaggtgcttgggggaccaggaggtctcatcccaggacctggctcctctaaggtctgtctcactgaactcagtttttctgtggtggtgagtgcgaaagggaacttccgatggcttgctcggcggtctggtgctttcaggtcgttaagtttcctggcaagttgaggcggtgagatctagacgaggctgcgccgccgaaggtggcagggacgtctgtggtctcagctcccgggtgggtgacctagatcaagctcttcccaacatggatttcacccaggacagggagaagccggtgcgagcattccccacctttgtacttgaacctttctcctctttcagcggtgtggaggagatgcgagtgtatttatgttattgtgaattcacatgtatgttaaaataatttttaaagttatctttgggatttcacaagattc

SEQ ID NO: 228784 - DNA, 412 bp, Homo sapiens
atctctgaaggttttattccggatgcttctgcaccagaaagaaggttctagacataggtatcccgcaactacagtgatcacacaagtgccaaagcaccgtttcaattctacagtcaaacttatttaatttggtaaccaaatgcgtcaattccttcaattcccataatccagtttttgtcacctatccaagtctgttgtgggtgaccagggagtttatctttacctattcctgagctgccttcctttttaacccatagcacaagaggattcaactgcatttaatatacaaagtgcagagaactttaatgaccaagttaaattaaacgtatcatcactctgtcatttaatcaattattgggtgccgccatcaaggagttcatagataatattgtttgaatatgtatattttaat

SEQ ID NO: 228785 - DNA, 664 bp, Homo sapiens
ccacctcagcctcccaaagtgctgggattacaggtgtgagccactgtgcccggccttgactaccatattttaaatttactggaggacttttttgttctcttcttttttctttttttaatagcatcccgctcttatttcagaataaaaaaatttttaaggtatgttgagtaagaatctatagagcaatgaaaatgcaagagcaatagctatgggcaccaaatggtcaatcttcttatcataatgttgagtggaagaagccaggtccaccagacacatgctgctcatttatccaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcagctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatagcgagaccctgtctctacaaaaaattaaaaaaaaaaaaaaaaaccagctgcgtgtggtggca

SEQ ID NO: 228786 - DNA, 606 bp, Homo sapiens
  misc_feature (587)..(588): n is a, c, g, or t
ccacctcagcctcccaaagtgctgggattacaggtgtgagccactgtgcccggccttgactaccatattttaaatttactggaggacttttttgttctcttcttttttctttttttaatagcatcccgctcttatttcagaataaaaaaatttttaaggtatgttgagtaagaatctatagagcaatgaaaatgcaagagcaatagctatgggcaccaaatggtcaatcttcttatcataatgttgagtggaagaagccaggtccaccagacacatgctgctcatttatccaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcagctgagtgagggttgcatcggtgtttatttgataacacgttctaggggctgggcaagatggctcatgtttgtagtctcagtactttgggaggccaaagatgggaggacttttttgttctcttcttttttcttnntttaatagcatcccgctc

SEQ ID NO: 228787 - DNA, 377 bp, Homo sapiens
agggccatgaattttataagatttaattttaaggtgctagaagttttccttttttgaaactgaccccagtagtttggtgtggctatagtcctttacatagctgtcactgcactggtgtgattggtctgttcaaatagaccaaatgcaatcatgtccttaaccacccacctgcatttactattcctgtacaccaaggcagtttcctggctcttaggaagaaaagcacgatagaaattgtacaacttaggccgggcacagtggctcatgtttgtaaccccagcacttcgggaggccgaggtgggcggatcacctgaggtcaggagttcgagaccagcctggccaacatggagaaaccccatctctactaaaaatacaaa

SEQ ID NO: 228788 - DNA, 345 bp, Homo sapiens
gtgattatcacaatgttttggtcctcaacaatttttgatggcagctaattcatcacagtgtcctttggaatgaaatagatgggtagattactaaaatgatatttgatctaaacaacaagaatctaggtttgatagaaacttgacttgaatcactaaaatggaaattcatggctcctcaaacccagttctaaaacacctaaaaagttcatagaccaggccgggcacggtggctcacgcctgtaattccagcactttgggaggccgaggcgggcggatcacaaggtcaggagatcgagaccatcctggctaacaaggtgaaaccccgtctctactaaaaaaaaaaaa

SEQ ID NO: 228789 - DNA, 752 bp, Homo sapiens
gtggtggcgggtgcctgtaatctcagctcctcgggaggctgaggcaggagaatcgcttgaacctgggaggcggaggttgcagtgagcctgggggtaagagcaagacttcgtctcaaaaacaaaaaacaaaaaaacgaaggagtggtcagttgggcgcactccagcctggggacaagagcgagacttcctctcaaaaaaaaaaagaaggagcagtccgggcgcagtggctcacgcctataatcccagcactttgggaggctgaggcaggctgattatgaggtcaggagatctagaccatcctggctaacagggtgaaacctcatctcactaaaaatacaaaaaattagcagggcgtggtggcccccgcctgtagtcccagctactagggaggctgagtcaggagaattgcttgaacccaggaggcggaggctgcagtgagctgagattgtgccatcgcactccagcctgggcgacagagcaagactccgtctcaaaaaaaaaaaaaaagaagaaggagctagcctagatgaacctctacagagtcctgcagcccggatgttatggcagtttatagacatcaaccaaaccttagggcttttctgtactgagcatgtgcccaacgcctgagtttatagcatctctaatccttccagcaaccctccgtagggtaaatcatgatgtccattttatgactaaagaaacaaaagtttaaagggggttaaagtgattggccccagactacatagagacaa

SEQ ID NO: 228790 - DNA, 367 bp, Homo sapiens
agttaaggtacaattgatagagtcaagttatatatattagtatagggtttaaaggctaaaagaatttagcctatgcctaaaatagtcaggagccaatttaaagtttttaaaaaactctttttctttgatattataaataatatatgttgttacacgagtaacacgattggaaaaacatcagattaaaaattcatttttaggcccttcttagagtacaattattaaagaacagttgaaaattggttttgtggccaggcacggtggctcacgcctgtaatcccatcactttgggaggccgcggcgggtggatcacgaggtcaggagattgagaccatcctggctaacacggtgaaacgctgtctctact

SEQ ID NO: 228791 - DNA, 353 bp, Homo sapiens
aaattaggctttaaaggggctgctggttttcagttcacacacacaatcgaactctgctgtagtttccatatttataaaaaatccctgctgtgaagctaacaaggaaaaagcctctgaatctcttctttctgcttatcaagaatcaaaatagaaacaaggaatgtttgaaataatacagaaatggcactgaggaatgtgaacattctggggggaagggaataacttatgtgttgttgggggtgcttgtgcatgcgaatataaaaattgatattcatagactcgttaaccacagtgttagggggctagagatttgatttaatccttgatatttttattttcataaaggccagaga

SEQ ID NO: 228792 - DNA, 559 bp, Homo sapiens
caaatatttattgaatgatttttccagacactggactaagtgtgttacaggcattgctatttcagttgatcttcatgggaacccttttaggaagatattgtcaccagcattttaagggaacaggacagaggttaggcagttagctccagccttatagccaatgagcagcaaagacaagattcgttatctgattctgaagcttggtgaatggccttctctcacagtatgagaacatacttgttaactctcagcgtgtctgccacatgctataaaaaatttaataattgagaaatcagttttaaacttggaacaattttggaaacaggaggcaagatagctgttgtagaatctggagatggaagatttgggttgtttatactcctttggtggtgaagctctattcatttggaatttgctctggacaattttccctgagaaagtctcttgctttaggatgtcttatgctgttgccaacacaaagaatttttcctatgaaaatgaactcttgattatcctgatttaacaaataaagaatttcttgttgacttgacagcaacaa

SEQ ID NO: 228793 - DNA, 314 bp, Homo sapiens
tgcaatgctgtgagcattgtagaaaaaacctgggcaggcactaggaaaatgagctcttctggtggttctgccactggctggttgtggggacctgggtacatctgtcaccttcttgggccttcttaattaggaaatgctgctttcagaatctcttagtttcattttttttgtgtgggttttctctttttcttttttcttttttttttttttcattttaatcttctatttccatggctgtgcctttccagaattaaatgaaatgtttcttgatgcagactgttataatctagtagggtggtttggcaaaaaaaaaa

SEQ ID NO: 228794 - DNA, 390 bp, Homo sapiens
atctcttgtgcagaaaaattccaaataatttgagtagacacaacatcctcaaagaggtagaaaataactcctttcttcttaattgtgggctacacatagtgacttctttcccaaaaatacagaggaaagcagcaggagacagactaacttttcagtggagaaacctgacaaacactatctcatcaaggtcaacatcggtagtgatgccatactgatattatagacccttgatatgatgtgatgaaaatggcacttttcctctgtggtcttcctcccaaaatctcatagccacagtctaatcatgagaaaaacaccaggcaaatcccaattgaaaggcattctacaaaatatctgtcaaactattaaggtcattaaaaacaaggaaagtct

SEQ ID NO: 228795 - DNA, 438 bp, Homo sapiens
cagctcccctgggctcctgtgatcaaagtgtctttccataagtctcccagggctggcacagtctggtaggaggggaggagacagtgtgacagactctgactgagcagagggaaatcacagggaggccgccaagacattcctgcccgcttaggccagaagacatcacctcctcgtccccctggcctgaggaaggctggaggtagtgcggcaggaggcaacaatgagaggtagggaaaggggtgcagcgttcctggtctttaaaaatgaaggccaccactcccctcctgccagcagatgttgaacagtgtggtcctgaagaagcatcccagctggcctggttgtgagatgcagaaagaggataactctccccagcccccgctgttaccaaacccctctgagccctagttttcattaatcaaatgagaatataagtaccca

SEQ ID NO: 228796 - DNA, 442 bp, Homo sapiens
ccgaacacatctgaacatcagaaggaacaaactccggacacgctgcctttaagaactgtaacactcacctgagagtccgcagcttcattctggaagtcagtgagaccaagaacccaccaaattccggacacaggaggatcacttgaggctgagttcgtgaccagcctgggcaacagggagaccctatctctacaaaaataaaaacttagctggggatggtggttcatgcctgtagttccagctaaaatatatgtattttttattagtcaatttaaataagtaaatagataataaaaattttaaaaagagacaagagaatggcggttacatgggccagttgacttgtgaaaattcattagactggacacttgtcatcaaactatgtaattatacatttttctgcatgaatattttcaattaaaagtttattaagaaaagatgg

SEQ ID NO: 228797 - DNA, 283 bp, Homo sapiens
aatggtgagcaaaacagacacagtatgaataacaacagtgtccactctcatggagattagtacctaatggcaagaaaatagacaattcttatgctgaaatttgtaaagtatgctatttgggatgttgcttgtcactccccatctcactagtagcttccctatcccagctacttctgatctctgaattctcaccccccaaaccctactccattgcaccatcactgaagctccagccagtaaaataactggactaccagggccctgggacctcagagaataatca

SEQ ID NO: 228798 - DNA, 583 bp, Homo sapiens
cggggttcctttgcttttcccaccttacaccaaactccctatttttactcccacttttacctcctctccaagacacaacaaacaaaactagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaacttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccacatttt

SEQ ID NO: 228799 - DNA, 449 bp, Homo sapiens
cacaggcacacccaccaaaagacaggactgaaaggtttgcaaggggagtgagcagatttctaaaaataatttctgatacttgcccagggaatacaccgagaaatagaatcctgtaagaaactaatatcatgatcgagcatgtgcttctgaggattccgtgtctttcttgagctcttgtgtgaattaggatgttggatcctcaaagaggaaggccattaaacgcctgcctggaagttcagaataggctgggccagttaggggtcatgggtgatactgaggcaactggcctttgtattacccatggtctggggtattgtgcattcagatgcgagtgtgacagatgggcaaagacctctggctaacttgcacacctccctcaagtaacctcagctcagcctaagtaggagaatcagttgtttctcagggcctttaaatcacattcctccatg

SEQ ID NO: 228800 - DNA, 497 bp, Homo sapiens
gagtctggctgccctcagcactcgcgtcccgccctgcagcctgataagcttgacgccaaggcattctcccgagagccggcccagcagctgctggcaggagagtggcctcagggcagcgggaaggggacctccggggagagaatgaggcctgcgcaagggtcctggaaggacccaggagtcgccccggcttccctcccccaggccctggttgggcgccgtgggccgcgtcccagttgagcccggcgtggccgtttaatggcgtccctccgcgaccgaggacgaaggggcctagagaggctgtgcccaagcgacgctgcgaggccaggccgcgtctcgggccagggcggtccccttgccaccgccgctcttggccgccaggaccaagcacagcacgcagcgtcgcgaaaggggcggtcctggaaggcgcgaaggggtctccgggtctcgcgaacacggcggggtcggggcggagtcgtgggtcctcggtcgagcggccg

SEQ ID NO: 228801 - DNA, 454 bp, Homo sapiens
tatgaagaagaggagtgacatagtccgccagagtgtggccgaggagtaggaggagtgtgaagaggctggggtactgtccagaccagagacggtggtggccttgacatctccccagagatggggatggaggggagggaccatattccagagctgtttgggaggcagaagggagactgaggggagggtggggcatgaaagacagggaggtgcccagggcaggcaggttcctgccttgacagcaccaacaggagcaggaatctctccacggcactgaggcgccgggcagggaggggatggttcctgagaggccaacctgcctcccagtcctgggccccggggctggcggaggcctcctgtacacgcacacgcacgcacatgcgcacgcacacgcacgcgcacagacgctgcctggattttgctttgggttccgtcttctcactgcggaccctggatt

SEQ ID NO: 228802 - DNA, 355 bp, Homo sapiens
agaacagaactattttcagacatagatttaattctctaaattgggaagtctggcccatggcctattttgtaaataaagttttattggaacactgccatgttcattcactcgtatattgcctattgctatttttgtgctgcagaagctgaatagttgcaacaagacaccataaagcctacagagtctaaaatatttactacctggcactttgcagaaaagtttgccgactctgttcgtatcactacaattttgatatggtgtggcttgaaaaaaataaaaaataagttgttggcttttaaaaaatatattaaggtcatcctatcttgttcgtccccaacaccccatccacttcttc

SEQ ID NO: 228803 - DNA, 463 bp, Homo sapiens
aggtactttagtttgccattatcagggaagcaatgattagccaagcatagaaaacaactgagtcatgtgcttgtgtgccaggtatatgaaatgctgtcatttgggggaaagaaataggtttatttaaggaagtagattttggcttattgtaaagaagactttataattaagaaatctttaggccaggtgcggtggatcatgcctgtgatcccagcattttgggaggctgaggcgggcggatcacccgaggccaggagttcgagaccagcctggccaacatggtgaaaccctgtctctactaaaaatacaaaaattagccgggtgtggtggcacacgcctgtggtcccagctactagggaggctgaggcaggagaatcacttgaaaccgggaggtggaggttgcagttagctgaagtcgcgtcactgtactccatcctgggtgtcagagtgagactcggtctca

SEQ ID NO: 228804 - DNA, 786 bp, Homo sapiens
ctgtctagatttcttttcattatcttagaccattcagtaatgggaaagcagtaaaggggcatgaatattctagacacagcccggagagctatttgaacaagttgctggaacatttcttgctggagctgagggagcccaggtgaccttttctgactgccagcagcctggcccagagggtccagcctggcctgtgtggacagcccaggggtaggggatggcatgcaggcagaagggtctggccatcagcggatggagggagaggcaggagagggacagggacctttacccagattgaagcatatgaaattgttaacattcagccattttgacctatagaaacagcaatttcaatttaaaaaattaacaaaaggaatcacatcacacatctcttcattatcaactcctacagggattaaatcgattgtgaaaatccaggtgcccattcttcatagccaggaggagcagccaggccccacccagcacagctgggctcctccagctccctggggttgacactgggaggggccctggctgttgcggaggaggacaagcacttggtggctgtcagccctcttgatgcagaaactcatgctcctcagatccacagtgccctgacatggggtgagctctccccacaagtccctctctgcagaagccacagagttagcctagagcatggctgtgtacctggtttgccccacagggtgttcgaacctaagttgatctagcttttattggggctgggtacaggcctgagccactgcacctgactgggttgtttttttg

SEQ ID NO: 228805 - DNA, 907 bp, Homo sapiens
cggaaagtacctagatgacaatgtttccattctgaaaaatagaaacatactattcaagaccaaggtagcagaaaagttacttgtatctgcttatcataagacgaaactctgcaacttggcaacggtggccagttttcgtaatgaaacagtctttagtaatttaatcttcatgcttcataacaaaccaaaaccccatgagatttccacattgcataattttgccttactaacagaatcatatccttaaggatgaccatcattcccccaactaaaacaaatacaaactaatgtatgatatttttttaagtgccagatcaatatggtctaaagcttcaataaggattgtgtgtaggtgaataaagacagctaagtgaatgtgtgtaaagtgtagcaaaagcagacagatatttatgtacagtattcatagaatggaaagttaaatatttttgcagtgtgtatttaaaagagaaactcaccataatagtgccgtctaaaaatctttgtaaagttaatttaatgtcctttagaagtgggagtctggtggaactgtgttggatttaagataccttttcactcttccgtatgtcatgagccttgtgggtcacctcactgtggtgcatgtgcaagggcgtgtgcacgcctgtgctttgccatcccatgttgtaaacagctgttccaaaggcacaaacgagtttagggtagactctgtaaacacctccttactcactatagtcaagaagtccagcggcgtcccaatatagaggtcccagtgcagtctgtccagaatagccagctccatcctcagcagctcattcggggaatagtcagagccatagtgctttgtgaagtcttttacttgtggaataaactgtaaaaagaaaataaagaggccaaagccctaaaaaat

SEQ ID NO: 228806 - DNA, 470 bp, Homo sapiens
atgcctgtatccctttgggtggattttttccccccacttaaattgcatgttttatttcccccaatcccagcaatagcacagaagccccatcatatccaacccaaactggtttcgagtaggttaaggttatagggacacttgtcagaacgttgatacaaagggctcccaaacgctgggcacaaatgtgtcagcaaacagatggaagtaaacagtgcactggcccaaatgcttcatgagtcagtttgattttgcaatgcagtttgcatccttgaaactgccagtctggagggagacagggtagcttgagggagtgaagttgaaattgcctcctattagctcaccctttcaacattaaacagaccaagagagaaatggttccaacatttcaccacatctatttcttatgcagtctaagctgggaatgccatgtaaatggatcactgcgaaatgcagcaatttaatttttctcc

SEQ ID NO: 228807 - DNA, 860 bp, Homo sapiens
aatttgcctggcaggccctgcgtttcccattgtccttctgccaccatggtgactggggacatgcccgtgcctgtgggggacaagcatgcatgtcagtttttgggcatgtcaatgctgattcctgtgccctggggtacggcccaccttctctcggtagagctgtgaccctgccaacaggaagtgctgggaaaacaagctcctgacacctccgtctggggtctggggtcgccttctcagcgtgggctgcttcatgacccataggtgttctggactttcctccccccgcccaaggattaaacagcacttggctccttgttaaaagcacattgatgttttgagcccagagggaggtgtggatcacacagcaggtcaacagcctccattttgcaccccgccattccctgtggctggttaaggtgggagtgggtagggaggagaaaacagaactagagagtgacattggggcgatgctgaccgagggtgtgacccaggccaggccaggctgctgtggccactgacctgctcctccctgcacttcacatgggagctcgggcattgggagccgtcaggccagtcctcaaggtacggccaagcagcccggaggccacctcccgaggcctgtgctagcagctcctggtccatgcctgccggtcagctcactgctccacccctgctaggcgttagatgtttccagaaggcctgagggccaggcaggtgaggggcttcaagttcactcagggcagctgttgagagtttagcgagttttatttttgcccccaaatttaaaagtatcacggaaggcagagctattacagagagaaaccaaccttttggttatcacacagcagcttttatgaatt

SEQ ID NO: 228808 - DNA, 283 bp, Homo sapiens
tttaaatagcgcgaggagggaagagtcagaagaaggttttgagcagaaaaactacgcaatagaaagtgtatacattgccctatagcagacagacccgggacgggaccagcctccagacgactttaaacccgaaaggaagcgacacccggcctctcactgggctgtctcaatttgctctgggcgaaggaagacgggcgagaatttccaggtctgtggggaccccacgtcccagggacagaagcggcggggacctgggaagcggagacttaatgcaacacagagc

SEQ ID NO: 228809 - DNA, 344 bp, Homo sapiens
ctagccaggcgtggtggcaggcgcctgtagtcccagctactcgcgaggctgaggcaggagaatggtgtaaacccaggaggcggagcttgcagtgagcagagatggcgccaccgcactccagcctgggcgacagagcgagactctgtctcaaaaaaaataaaataaaataaaataaaaatcatttggtagcccggttttatgggagatttttaggaaaccctataaaacaaataattcctatactatttaaattgtggtaggacatagaaaaaaataataagctttccttctcttttatatcataaccctaatactaacatctgatgaaggccatagcgcccccc

SEQ ID NO: 228810 - DNA, 723 bp, Homo sapiens
gcctaactttcttatgtgattcatgcccttcatagtctagtgacaatttattcatctaatatcagctcaacactcacaagtctcctgcccactattcctgatgtttcagtcattcaactctttcatctctctgtggaaaatgatccatttgcctgactctccttcatctccatctgatgaagtcttaattcatcctttaaaattcagctccaaggtcacaacctaccttctctgtgaagtgtccttgactccctgagagtaatatcactctgcccccaaagaataactcctataccacacagtattttgactgcatctgtcattgcaacagaaggtaagctcattcttgaattcattgaaatatttactgaggcagtgtgatgtgccaggccccatgctaaaccccaaggatatagaaatgaattatcttgcaaacactatgatcttaagagcatattttgtgctttaaaaaaatcagatcttaagcccctgacatgtaatatttagaaggtatataatacagtctctgtatatgaaaagtgttatttatttacaaaatggcaggacatgaaaaacaaggtatcagagtatttgcagtatttttttaaaactggtaagataataacttctcagctcaaacatctatttcccctttccagttcttctggaattgttaatccttaagaaacataatgaacaaaattcactctgccatctaaaatg

SEQ ID NO: 228811 - DNA, 723 bp, Homo sapiens
ctgtcacactttccattcattgagacattcatactgaggccacacttcctccagaatactcccagctagtgaattactgagctttgcaggagtattagagccaggtcactgctgcccaacacattcactccagcatttgttactgttagtcttttttgtaacagtcataattacagatgtgaggtgatatctcattgtggttttgatttacactaatttgatgatcagtaattttgagcatttttacatataacttttgggcacttgtatatcttcttttgataaatgtctatttagtggttttgctaatttttaaaataaaattattcatttttcattttggggttttttgctattgagttcctatatattatggatattaacctttggcagatacattataatctgtgatatttttctgccattctgaaggttgtctcttcactctgttaattattttctttgatatgcagaagggttatagtttgacataataccatttgtctattattgctcttgttgcctgggcttttgaggtcttatcccaaaaaatatttacccagagccatgtcatcaagtgtttctctcaagttttcttctagtagttttatcatttcaggtcttacatttaaagccttaattcattttgagttgaattttgtatacagtgatagtctaatttcatccttctgtcattcaatcaataaacaaaaaatcccatca

SEQ ID NO: 228812 - DNA, 441 bp, Homo sapiens
tagagtttttccataaacaaataactttttattgtggagaatttcaaatatgtacaaaaagaaacagtataatgagtcccccatcatctagcttcagttattttcagtttatggcattcttcttttatgtatattctcattcagttctctctttttttgagattattttgaagcaaatttcaaacatcacatattctgttagtaaatatttcagtatgtatccctgaatgatgaggactttagaaaaatataatcacactgcttttatcatacaaaaaaaaccccaaataatagtatcaagttatttagtctgttcaaatttctgattgtctcaaaaatgtcaaatgcatatgtgtgcttgtgtatgtgtgggttgtagtttgaggaatcaggatcaaataaagtcagtgtattgcacttggttgatatagtttttagtct

SEQ ID NO: 228813 - DNA, 405 bp, Homo sapiens
  misc_feature (259)..(259): n is a, c, g, or t
  misc_feature (296)..(296): n is a, c, g, or t
  misc_feature (311)..(311): n is a, c, g, or t
  misc_feature (321)..(321): n is a, c, g, or t
  misc_feature (330)..(330): n is a, c, g, or t
  misc_feature (351)..(351): n is a, c, g, or t
  misc_feature (368)..(368): n is a, c, g, or t
  misc_feature (385)..(385): n is a, c, g, or t
  misc_feature (392)..(392): n is a, c, g, or t
tttccataaggaaagggtataccaaagagaataatacttttaacaaaatgtcagtgggaaagttttaattacttcagagagttggattctttctaaacatcctggactgcaggaatctctgcaaattaggattctccctacaggtttgtggattcagagtttggctctgcatttcaataatcattgcagctgttttatttgttgttttactttgagaacaaaggtgtttcttccgagagcttccccagggcctcacacntcaaattttcttcctcgtcccaagtgacatggcaagnttttagtaactagtngcttgttctnagggaaacnaaagttgtggctccaaaatgnttccttaaaaatgtcangtgattttggtataatncatcctnctctgaaagaaaa

SEQ ID NO: 228814 - DNA, 489 bp, Homo sapiens
aataaataatggctcctcttcagttgtatgccgtgaatgtaaattaagaagccgctacaacgctcgacataacctttctgacgccacaaaaatgaatgaattatatccatacacacacacaggcacacacaccacgcaccacgcatcacatgtcattctgaaaactgattctgagcttaattcgaaaaacgtgaaatacaactggtcccgtcaacggctcgtaatctgaaggtttcttgcatttccaagcacgtccataacacctcatccgtttccagtttgttactgtttccaaccgaagggagagaattttccacacagaattatctcctcgggtccaaatactagaccgaagtccccacacggggctggctggcggcgtggaaccggccagcccgccgagagccgcctggcgcccgcggggaagacgcagagcccgcggccaggagccgcccggtgccccgggagtcgccggccctcggcggccgc

SEQ ID NO: 228815 - DNA, 428 bp, Homo sapiens
aagtctcgacctcaggtgatccgcccgcctcggcctcccaaaatgctaggattacagaagacgtgagccaccgcacccggccacctgtacatacttttaagaatgaaagtaaagtatgtcccattatgatctatgcaattctatgcttgaggtccaaaaaacatatacatacctacgttttactaaattataaaaataatatgtgcacatcatagaacacctggaaaatgttaatgctttgatacatttttttctcatgtcacatttgtatgcagtgatgttttaatgtaatgtgattatatggtactctacataccagtcgatattctgacttctaaaaattaaagagtataagcatttcccccatgtcattatacatttttgtaaacattgttttaaatagctcttgaatcctctactgagtggct

SEQ ID NO: 228816 - DNA, 537 bp, Homo sapiens
atgtgatgcagacacacaaagtacgcacaagctgttggaaaaatgctgccgactgacttgcctgctgcagggctgccacaaactgtaaaaatgcagcgcacctgtgaagcgccacgaagccacacatgatggggtgggacacgtctgtgcatggctggggaaacagtcacccttgtgggtgtacagctcttcagatgttttgcattagaatgcaggcataaagtcccttatgtatttttaatttccaagcaacaataatttaaaaatcagttggagagtgtcagcaggtgcttctaggttctgtgtggtgagcccccaggtcctggcgtgtagggctctggatgtctctgtacacgggatagaaacatggtcacgtgggaatgccaatatgacttattgcttattgagctgtgcaggcttttctgctttatcaattacgcctccaggaagctgtgaaagaaagcttcatccatctcccacaggatttgtctccatatttgtgacacataataaaatgttatgtactctttatgtaat

SEQ ID NO: 228817 - DNA, 532 bp, Homo sapiens
tattttttaaaaagtaagcagttatactgcttttaatattgattggtctttttatttggcttggagttcttcaaagcagtgaagtgtgttcatagtccagatttttttttagtaaacacaattttgctgccaaatatatataaataaaacacaaaacaaaaattaaaaaatgttgaaaatattagaccatctccctttttaccaccttccctttttaccttttactgccatttacatccacacatccacacacacaatgctatgctatgtttaatagcatttccctgattaccaatattaggcattatatattgtctattcatgttttcatattttgtataatgtctatatcctttgttcattaaattgtgttatttgtattattctttataattctttaacacattgctgtttatatgttggttatattttacattttcttctagtttatgggaagtctttttcttttcctaagacaatctattgataaatataagctatgaatattaaagttataattaaagttaacaaa

SEQ ID NO: 228818 - DNA, 476 bp, Homo sapiens
atccctgtgtctgtgaactcatggagcacgttttagccaaggtctaaccctttgcgctagagaagaggaccctcacccaccattgaatgagcagtacacacaaaataaaatatgagggttcaaccaaaggagacggtgaagggagagttttaaccctcataaataacaggtataagactaaaatctgtcatttgtaccccttcctcagtgctctttcctatctaagataatgtatcctgtgttaattaatacacatttttataaggggttgttttataaatcttacctcttttctgcattatgtgaatagtaagatggagaatgttgcttattataataaagtgataactcagctaatattcttatttcttcaccctcattgagattttctatgaaatatcatttggagaacatttcttattataatgaaaagtgataactcagctaattttcttatttctttacctgtcattgag

SEQ ID NO: 228819 - DNA, 800 bp, Homo sapiens
agaaatggaaaataattctaattgtacacatgtctgataaaagagacttaaaatacatgaagcaaaatgtaacagattaaaatagaaaaaaagatgatttcagagtcttagttacgattttaatatccttccctacaattgatagaacaagacaaaatctgtatgaagacataaaaactctaaacaatagtgctaaccaccttgacgtaattgatattttaaaatataacactaaaaatactgcagtatgcaagctctttgcaagtgtatgtatttcattccccaacattcatatgctactccatctttggctaatgatacctgtccttaattcctttttaaaaacttgatatcatacagattatgcccttgtgccacaatggaattaaattagaaatcaatgagaataagataacaagaaaaaaaaacaacagcaaaatacatggaaattatgtaagatacttctaaatagcccataggtcaaaaatacttgggctagtctgttcttgcattgctataaagaaatacctgaggccgggcgcggtggctcacgcctgtaatcccagcactttgggaggccgaggtgggcggatcacgaggtcaggagatcgagaccagtctggctaacgcggtgaaaccccgtctctgctaaaaatacaaaaaattagccaggcgtggtggcgggtgtctgtagtcccagctactccggaggctgaggcaggagaatggcatgaacccgggagacggagcttgcagtgagctgacattgcgccactgcactccagcctgggcgacagagc

SEQ ID NO: 228820 - DNA, 391 bp, Homo sapiens
taaagtcctataagagcccggcatctggctgcactgcctgtatttgagcactgtcagttcacgcctttccagctcagatcatatgggcttgggatcaagagaaacaaattggttgtagtctcagcttcgtttctaactctgcctattacataatgtaaggccaaacccctctctgagcctcaaaaacctcatgtataaaatgataggactgaaatacaaggcttctaagattacttgtagatttagacattatgactctgtatataaacacacattttaaaatcttattagtattaccttacagattagatttttgaaaatatttttgttactgtaatttcctactctctccaaaatttcaaataaacgtcaactgattcactatccaatc

SEQ ID NO: 228821 - DNA, 130 bp, Homo sapiens
agcttctgtgccatgcttctttattgttttgggtacttggaaatccattctgcattcgctcaggtacagacctcagatttggtggaagcaatactgatgatggaaccgcagtactatgtatcttacccta

SEQ ID NO: 228822 - DNA, 506 bp, Homo sapiens
  misc_feature (502)..(503): n is a, c, g, or t
  misc_feature (506)..(506): n is a, c, g, or t
gaaagccaagctgcttctcctgtcattgtacccagacagcagggactatccaggctctgattaaacatgttctatacctggaatgttaaagaaaatgaatccctttccggggttagaaaaaagagaagtatgtgaagggggaagaaagatgagtcatgtgaacagaagttgaatggaatatcaactagaaaactgagccccactgacggagctgctgtgtttgatgcagtgggtttaggaacaaagagattgcccgagttaggagatgagaagcaggcactaggggcgctcgcctgcaggaagcaggaacaggagctctccggcacacctcagatgccagtgctggctgtaaaagccaacttgctgtaaaagccaacttgctctaaacagtgccagttttgcagcctcacaggccgacaattacagaaacctcattatacttgagtagcttaatgtaattatcgaaccacagctgtgtgatgttggagcggccgcaaccttnnggn

SEQ ID NO: 228823 - DNA, 512 bp, Homo sapiens
attaagcaaattgaaagctcttagcaaaaagagggggcctgaaagcaagttgccagaaatggggctgagttctgtgtttttgatatggcagaagtcaggatgttttctgtgggtttgtgacttcatgtttgttattacccatgaatacctaagcaaaaccgagggagggctaacacaacaatactaatgccatgttaatgacattataatgagctgggttaagttaagtacatttaggttgatttattgtgcctgtgcctaagttggaacagtccctttgggcaacatcctggcacaaggggaaattcttaaccacgtttcttcccattagctgcagaggcagtgtaggtgctgtgttgaggttgttcctgtgaacattgcctttctctgtccttctcccgagaccctccctctttgtctgcctatccagcccctaaccacctcctccctcaatggaatgtgttaataccaccaccataattgtaaaataaaatattccagtgaaatagaag

SEQ ID NO: 228824 - DNA, 86 bp, Homo sapiens
ctaggttcttgcttgtacttttatgtgggactttttaaaagagttcaaacaatagggaaatatgacacaaaggaacctgaaaaaca

SEQ ID NO: 228825 - DNA, 499 bp, Homo sapiens
ttggcacactgcccagtgtggtgcttggtacatggaggcctgcagaggtggcactgagcagcagaaagaacatcagctttcaagtttgttaggcctgggtttgagtcttatctaccatttgccaggtaggtgaccattgcccaagaaataacctctctgagtctgttacattttctgtaaaatggagaaggaaggctgggcatggtgactcacacctgtaatcccagcactttgggaggtcaaggtgggtagatcgcttgagctcagcagttcaagaccagtctgggcaacagggtgaaaccctgtctctacgagaaatacaagagttagccaggcgtgatggtggatgcccgtagtaccagctactcatgaggccgaggtacaaggatcgctcgagcccgggaggtcaagccttgaggccaaggtggaagttgcaatgagctgagattgagccactgcactccagcctgagtgacagagcaagaccctatctcaaaaa

SEQ ID NO: 228826 - DNA, 284 bp, Homo sapiens
ccatccctccctccatccccttctctccaccccaaaaggaaactctctgccgccatcattactgttatgtcaagatgcccaaactctccataacatatcccatcctccgaccacgttcagtattgatgactttcattcagtgttatgaatgggaagggcgggaagggagggagtagccagtggggaggggcgggtggtgggggtgggatggagaatggagatcttttttgtcttttttaaaaaaaaaaacaaaacaaatttgtcatttaatggatccaaaaacc

SEQ ID NO: 228827 - DNA, 110 bp, Homo sapiens
ctgtggccttccagggagtctgactcttacagacaaagcccatggacgcgaactcatgcccacagcccgtctttggactttataaagcctaagcccacaggctggccact

SEQ ID NO: 228828 - DNA, 934 bp, Homo sapiens
gtacagaaggaagatagcagattccttgatcactaaatcggctttaccatgcagacaggatctaatccatatatgcccctatctaagatgatctggcccaagtggatggagaataaacctctaattctgcctggccctatggattcatttgtagcttttagcacaggacccaggtcctatagaactaaagtctcagaaatacatgaggagatgcctgactttggagaacaccaagaatattttcaatgtgcccaatatccaaatggtagctcctatagtgagagaagtcaggggagaacaaaatctgcgaactttaaagcaagataagaactgaatctgattactacttgtcgacaccaactttctcctccagagacaggaaatttcctgagttgtgagtacaattttgtatccactgggtatagactagccaaagaagagctttacttcaggggtgatcgagctcatcatggggaatagacacaggtgaacttctcatgacatggcttcctggaatgatagatcatcggaaaaacaattgttcaagcagcattggtaataagaatgagccctctcagggactagctgatagagctagtttgggtttgctgtaggccaagcaataatgaatctctttcaaagagagactgggggtagaggtgaccattaacctatatactcactttggttcactattagtggcagtattttaacttcactgggacatctttgatgtggtttagaaataagtccaacttgttttgtgggacatcccttggtccaggagcaatctaaggtcagattaaattttctggatggttgtgaaactgtagaacctgcctcattggtcagatttgggttgatttagtcactgaccccacaagacaaacattaacacaaaatacccccacttaggcttataattagaaagtac

SEQ ID NO: 228829 - DNA, 476 bp, Homo sapiens
ttttcttcttttcttccttccttcctttcttttctttctctttctttctttcttctttttttaacagacaaggttttgctctgttacccaggctggagtacagtggcacaatcctagcccactgcagcctcaaactcctgggctcaagtgatcctcctgccttagcctcctgagtaactggaactacaggtatccgtcaccacacctagctcatttttttaagtgatggggtcttgctatgttgcccaggctggtcttaaactcctgagcacaaacaatcctcccatctcagctgcccagagtgccaggattacaggcgtgagccaccgtgcccagccttgtacatttcatacaagtggcatcctacagtatgtggcctttgcggctggcttgtctcattcagcactgttctcaagtttcatccttgtggtagcatgaatcagtacctcattcatttctatggtccaatattctcc

SEQ ID NO: 228830 - DNA, 444 bp, Homo sapiens
cattagatctttggttagaattatactgaggttaagaatatgatcaatgaaaaacacgaacagaggacagaaaggtgatgagacttactgaatctaagccagtgtgctactgcggcagatctaaaatcaagaatgttccattaaaaaaattaagcgtgggccggcacagtggctcacacctgtaatcccagcactttgggaggttgaggcaggaggatcacaaggtcaagagttcgtgaccagcctgaccaacatggtgaaaccctatctctagtaagaatacaaaataattagctgggcatggtggcacgtgcctataatcccagctactcgagaggctgagccaggagaattgcttgaacccgggaggaggaggttgcagtgagccgagattgtgccactgcactccagcccaggtgacagagcaagattccatctcaggaa

SEQ ID NO: 228831 - DNA, 499 bp, Homo sapiens
tagaattgcgaggggagtaaagcaaccaagtaattgtataggtacccttgggaactaggattttcagcatggaggaaaggggaaacagaagcaagatagcagagattcatctaaattggaattggaagtatcagtgtgaatgaatatgagttcatgataaatctcatctattaaaaaatatacacatttcctaatattttcattgaaatagtcgagaaactaatcaagcagcaatgagctcctccacccatgactccttggggatataggtgattttggtctagagcaggaactgtacaagttagactggaatatttggacatacagatagcatagtaagtatggtgtcaaggactactgagagtatatcaaaagttctcaagagccaaattgaagaggctcccactggctatttatgggataattggaacatcaataagaataataaattgaaagcattaaataaggtttaaacccaagagttcataataccaaaaaa

SEQ ID NO: 228832 - DNA, 322 bp, Homo sapiens
ggacggcttgtgagtttgaaggtctgagacccaggagagctgagggtgtcagctccagtctgagtctgaaggtgtgaattctagtgtgagtcagaaggcctgagacccaggagagccaatggtgtgagttccagtctgagtctgaagtcctgagacccaggagagctgagggtgcccctagctcctctgaggcacgggaatatccagtttcttctcccctctgaagaacctgcctgataacaaccatagtgctttaaatggcatctcccaaaagataagtccgtgcccttctccctaaaacctgggaaggtgactttattta

SEQ ID NO: 228833 - DNA, 360 bp, Homo sapiens
ctccttgactccctctgttcacgcagcagggcagaaaacatctccacgggggccacgacactgtgaagggaatcagcagtagctcccagaagaacagcggaaactgcaggcaggtgaagaccttggcagcactagccccggctccgccccgtgccttctccccagacaacaccccatacccggcagcaagggtggaagaccagtaccaccgtaatatgttgtgacaaagcagaaataatgcacctgtaagagtcagatggcaagagggaaatggaatgagctcatcgatggttttcccggcagtagcttggggataaggactacttgtcatgtgctttatatatttacccacatgttaac

SEQ ID NO: 228834 - DNA, 402 bp, Homo sapiens
gttgaaaagagcaaaaaaaaaaaaaagagagagaccgaagtacaattacaatcccatcccacaaaaaggtcaagggctacctgaaagaccggtggccccaggatcctcaaagcatccaaaccatccctatactctcaggaaagaaataaaagccaaagtgataacttaaaaatgaagctgccacccacaggggatgaggacttggatggagcccagcatcaacaaggcggatcacttgagcctgggagtttgaggctgcagtgagccatgattgtgtcactgcacttcagcctgggaacagagcaagaccctgtctcaaaacaaacaaacaaaaacaaaagagtccaataaccttcatggacacacaaccattcttaataaaatgttagccaatcaagtcca

SEQ ID NO: 228835 - DNA, 597 bp, Homo sapiens
  misc_feature (383)..(383): n is a, c, g, or t
  misc_feature (558)..(558): n is a, c, g, or t
  misc_feature (580)..(580): n is a, c, g, or t
  misc_feature (591)..(591): n is a, c, g, or t
gctattttttgtatttttagtagagacggggtttcacgttgttggtcaggctggtctcaaactcctgacctcaggtgatccacccgccttggcctcccaaagtgctgggattacaggtgtgagccaccgcggctggtcaaaattttttttttttggtactttttttgcagaggcggggtttcgacacgttgcccaggctggtcttgaactcctgagctcaagctatccatccacctgcctcggcctcccatagtgctgggactacaggcgggagcacagcacctagccccttccttttcttgtctctgtgaatgaggtttggagccgagacactgaagtatagataattgcaaaaaggctctgtgtgctccgggatggagcangtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctactgctctctgcggttatggctcagncccactggcccagtgaaccctnagaggctgcanggactg

SEQ ID NO: 228836 - DNA, 328 bp, Homo sapiens
atttttcaactatttttagttgttagaaatctccattttgccaaattttcttgatccagatgcagcgcaccaacatggcacgtgtatacatacgtaacaaacctacacgttgtgcatatgtaccctaaaacttaaagtataataaaaaaaaaagaaatctccattttgaatttctgcaaatgaggtatgtaaaaagcacatatttttaaatgacttttgttcttcctcttagaaatggtgaaaattggaccacatttttttgtttagtgtaaggatcattcatttgtattttaagacaagaaaggcacttttgaattttcaactaagt

SEQ ID NO: 228837 - DNA, 410 bp, Homo sapiens
tgatcaggaattcaaactgctttgcctttccttcacatgcacacggagctgtgtgtgtggggtccacgactctgggcagaaggtagccttgaactgcttggacaccctccctcggcaccagctttctcacttgggtcttgttaatctcaggtactccttgaaagcagtggccaagtttccttcataacgtgccccctaggagcccatgcaggtccttacacccagggacggctcagagagggcctggtggctgatcagcgagtctcctggcatctgtatccaccctgaactgggtgaagggaactttcctccagggccaaggatgtaatgagctgcctgcttaggaggaaagctagacgtattcccattgagtagatttgaaaaacaaggctgatggtggatcataaagt

SEQ ID NO: 228838 - DNA, 934 bp, Homo sapiens
tgtagcatactcaaggagacctccagcctcctcttaaggagtgatgatctagagagaagcagggtcagtcccattcttagccactagactcaattattttgtgtctcctaaaggaataatatttccaacagtgagaactgtaggaaaacgattattacagtagaacttaacacttgtttttgattatggaaatctgaggaggcttttcgtaatgcttgaggaatgccaagcagcagactacgagaacttgagtatggaaatagcttagcaaatagcaaaattacaactgtaccttttgcaggcacggaagatagatgaatccagtctcctgaactaacaatagttactagtaataacaatataccatacagattacataagttatataaataacaacttgttatttatatggaagagagacctaatgtgataaacacaatttcaatcttgtaagcatttatttaaactttatatctacctggtctcttatccaagattttcctgaacactttaagctggtctcactcctgtgctcccttcagggctgttttcccgccaaactggatcattcagcccacccaagtaactcctgagacttggcttgacttctcccagagctccttctatgcctgacacaggtaagatacacagtgtctttcatttcatcttctacgaaaatatttgggatacacacatccttaactatcttcattctaccctttgtgagtaactcaattctgaactgttttccactaattctggtttacaaactagtatggaaacctcctttcagccatccataatttcttgctccaagttcgggggtacattttacttttagtataggactctgggccaggcatagtggctcacgcctgtaatcccaacactttgggaggccaaggcggatggatcacctgaggtcaggagtttg

SEQ ID NO: 228839 - DNA, 416 bp, Homo sapiens
agagattcaagtcttattattttaataataagatattgatttgttggcccacagtttgaaaagatgctgaattacgggagggacaatcagtagttctaatgttgggatataatcagaaaaattaacctcttattccccagaatttctaaaccaataggactcaagacaaatgaatgtgatcctaggttagagtgtgaatggaatttacattatgtatatacgtagaagagctggatatatagttgtttagttttttatataataccaaattatatttcagagatacttatttttgtgtttcttggaaacttagacaagttattttagaaaaatcctaatgatttttttctcttcacccactcccttctcactaaaaaaggattgcttcattgtcatgaaaattaaatctagaatcc

SEQ ID NO: 228840 - DNA, 322 bp, Homo sapiens
aaaaatgttcatggtaacaaaatattggaaatagcccaagggaccatcaatagggaatttattaaattgtgtatatttatgtaatatattaattttcacacaggcactatcatcgtttggtgcaagccagttctttattgtatgatactgtcccgatcattcactacagggcagtttataactttggacctggcacaataagtggaggttgcacattcaaattttgagacaactcaaaatgctcccacacattttcatgtgcctctagggtggggcattccacttgagaatcattaatattatggaattccgtacaactgta

SEQ ID NO: 228841 - DNA, 427 bp, Homo sapiens
aaacgtcatggtgtttttcactgaccacagctgtcttgtggcaatctcttgagcagtcaacatctatggctggcgcaataagtcattaaatcaaaatacatcaattactggttttcaaagagagtcttgatttctgcataatgtgacttacataagggtaactgtattgttgctgagtgtgattgcacaaagaactcactgggcactgctttaacaaatgaaagcaggtcagagggaaatgtatcctttataaatggcttcatctattcattcaatttaggaaaccatttcttttaggctggtaatttaaggatagcactgctgaggactaggaatttgtttttacctgtactatttcatctgattataaaagtaatatatgccgaccaaaaaaaaaaattacacaaataaatgtcttacagagaat

SEQ ID NO: 228842 - DNA, 214 bp, Homo sapiens
gagcaattgaaaaagcaccaaaactaagaaatcagaaccaatcgcatttttaaggcatatacagcaggcgaggtgcctgctcttatgtaatctcctcactaacgtgaaaaagatgggaccctcctcctccgcatgttacagatgagggagcgcgatctggctcagtgatttgctccaggtcagaagctttccatagggaagcaacaccccgccc

SEQ ID NO: 228843 - DNA, 272 bp, Homo sapiens
tgacaaatagagtccagatgccaatgttactggtatttatgatattataatgcactgcactctatggcaaactgctaaagtgccattttgttacttcttcttttttttttttttttgagacggagtctcgctctgtcgccaggctggagtgcagtggcgcgatcttggctcaccgcaacctccgcctcctgggttcaaccaattatcctgcctcagcctcctgagtagctgggactacatgtgcgtggccatgtatttttagtagagacggg

SEQ ID NO: 228844 - DNA, 475 bp, Homo sapiens
ctatgagaacccaggctcagcaggctaagctgttctccacccaccccaagaggtggctgtgggggcaacagacaggcgggagggggaagcagggacagcagggttcagacagagtttgccttgacgtgacactcccccagagccaagacctgggggatgtttcagaggtcctggtttcctattggactgacagacacatttgctgagctgcagacatttaaagctcctgtctcttttctcctcagagctccagcgggttttctctcactctgcatacaacatgcatactaattggaatctctccctgagaagaagccttcttcctgacagatcctttaagaatagctgtaggttttgaagaaacccaagatggcattgcctgtaattataaagtaattggtgtaattgagagctcagggtctcatgcaaatcatcctcccatttctaactttacatcaagactatttttattttt

SEQ ID NO: 228845 - DNA, 433 bp, Homo sapiens
ctgggcaatgtgaatatgagtttgttggaaaagtcctcatctagcagcgaagacgtgtgatctctatctcctgagcaacaccatttcacaaatgaggaccctggaacagttaacaaggttcctaaagcctctatattcaatgtgtggccccggaaccagaagcattgtaatcacctggaagcttgcttgtcataaatacagatacttagaccttgcttcagacatactgaaacagaatctgcattttaacaaaagacccagaggattgcttttacattgtgtgtgtgtgtgtgtgtgtgcatttaaaaagatacaggtgtcacaatttcttattgtttggtcaattttaaaatttaatactgtataatggatatctcttatgtcaacacagatctacgttattattcatcataaataaacagtaagttattgt

SEQ ID NO: 228846 - DNA, 437 bp, Homo sapiens
tgtgcaataagacatttgggataactggtaaaacttgagtgggatttgaggataaaatggtgatagtgtatctgtatttcttgattttgatggttatgttgagatgatgtaggagaacatctttgtaggacagacactatttaggagtgataaggggccaggtgcagtggcttatgcctgtaatcctagcactttgggaggcctaggcaggtggatcacttgaggtcgggagtttgaaaccagcctggccaacttgaagaaaccctgtctctactaaaaatacaaaaaagccgggcatggtggcagatgcctgtaataccagctactcaggaggctgaggaagaattgcttgaacccgggaggtggaggttgcagtgagcggagatcacgccactgcactccagaatgagcaacagacagagtgagactcccatctc

SEQ ID NO: 228847 - DNA, 482 bp, Homo sapiens
agatgagatttgggtgggacacagccaaacgatatcagttactaaagttatcttggcatattattactctgctcagatttttttttggataatacctgcagaataaggtccattccacatattatcacatttaacactacatggcctaattctgctgtgacccacttttctcatcccagcatggcctctttccttccatggaaaatgggatccatacagcctgctggaatgcccattttctcctacagctggaatgcccattttctcctacagcatttacagaactgacttggctcagtttcctcttcctggaatactctctgcctcatttccttctggaaaaatctccattcagcaggcatcttattgaggatctcctttgtgccaaagactgctcactggtagggagctcaaagatgaatgaaatctgggccctgttctcaatatcacagaagtgttatgagcaaaaaagtcacaaaaca

SEQ ID NO: 228848 - DNA, 308 bp, Homo sapiens
tcatgcctcaggaactgagaaccttagcaccagacagaaaacctccactttcagaaaaagtcctgaatcttggggagggagctctctcttcaaaagccgatctggcctcttcttatacagaaatgagccgcacaatgacatttcgttcaatgacagatcacatataagacagtgatcccataagattatgacggagctgaaaaattcctatcacccagtgatgtcgtagccatgataacatcatcgtgcaatgcattatgttaccttttctatggttaggtgcataaatacttacccttgtgttacca

SEQ ID NO: 228849 - DNA, 393 bp, Homo sapiens
actccatctcaaaaaaacaaaaaaaagaatgatgttagctgtggcttttaaaaaaaaaatgctgtttatcagctgggcgtggtggctcacgcctataatctcagcactttgggaggttgaggtgggtggatcacaaggtcaggagttcaagaccagcctggccgagatgatgaaaccccatctctactaaaaatacaaaaaattagccaggcgcagtggcacgtgctgtaatcccagctactcgggaggctgaggcaggagaatcacttgaactcggagggcagaggttgcagtgagctgggatcgtgccactgcactccagcctgggcgacagagtaagactccgtctcaggaaaaaaatcaaaaaccaaaaaacaaacaaaaaaattgctc

SEQ ID NO: 228850 - DNA, 417 bp, Homo sapiens
tctgattagataaaagcgagaaatacagaggctgccggttacactgagaaattacatttttttgtaaagagagcatagtgcccgtgtgctcccaagatcttaaattataaacaggagggggacaaagcaagagggaaacaaacttcaaaaggagcaaataacaaaagcctcttttgctgctcttgaagggaggggggaagggggaagaaagaaaagaaagttgctgaatcgggacattctggaagtgcctttgctgtgtttactagccccatccccgcctgctgcacccggagacgtctgaagtctctaatcgctcagcgaaaagttggtttcgggaagggcagcgccggggtgcgggagggcaaaggaggaagaggaatgcatatgactgtgagaaggaaaagtaatcgtggcaaa

SEQ ID NO: 228851 - DNA, 535 bp, Homo sapiens
acattgagatgccgaaagtgttaggagaaatcattttattggggggatgcagagaaagagagaatgggagtgacttgatcaagatcacacagcattaggggctgcgtttgacctaaacttctcgactttttttatcagcccaaagcaggcaggcaggatgaagtgggatgacattacagttcacttggtccacctgagaacctgagattctggtatgtacacagcttgtctgagtcaggttgtgaacttggtcctttagggcacatgagaatatgtctctgcttataggtctgaaagtaataaggaagagtagggtttggggcatgagaaaaatgggcattctcctgcaaagtcatttgcattaagtatctttaagcaaggcaggaccagactcaacagatagggatgggtgggactgcttctgttgcctagggaagcttagtggagtttggagatttaaaggtgagcaaactctgaccagtgggccaaatacagcccactacctatttttgtaaataaagttttattgaatcac

SEQ ID NO: 228852 - DNA, 528 bp, Homo sapiens
tgaaagctttcacctcttgctgaaggaaaacaccccatgctgcctttgaaagcttctgcaagttttgtgtatccaaaatgatggccatgcctgagaccacacctgaccccaccgactaagggacagaggaggtggcccgagcttctccatgtttcccttagagcgcctccaggtgtcctctggatctgtcatgcacaagccaaactgtctgcaagggaaaccaaggatggaactggactatatagcctgtactggaaaacaggccacagtgtggtactgttaacctgtgctgcctgacttaggtacaccctcttgtgttgcccaaactatggtacactctgagtttgcagggagaccatgtgtatgctcgggtattgtacagcttatgtgccctgcctgtcatgacactgcctcagccctggatggcttccaggtcagctcgaacttcctgtccagagctgtgttttacctgaattgatgccccaattgattgaattggccaagtataaagaaaaagtactgaaattt

SEQ ID NO: 228853 - DNA, 388 bp, Homo sapiens
tgaaatctcagtttgcttggacaagctggggtaagactctgtgacatgttgtttaagatcagtgcatgctggggccagtttacttgaaaggggatctgtagattgaagatgctgctgcctctcttacatgagaataatctgcttatgtgcctggccttggccagacagaaaggaaatgtcgggcatcagctgtctgaaggtgcggtgaggaactgaagagaacagaaggaaaacctggctggtaaatgcagacgagccactgaaggattccaggaaggaagccccgagggtgttgctgtctcccttgccagctttttatctcttgcaaatgtggacacgttatcagggcggatctattagaaaatgaatccactgaaacatctgcaaa

SEQ ID NO: 228854 - DNA, 421 bp, Homo sapiens
taagccaggcacagaaagacaaataccacatgttctcacttatatgtgggaggtgaaaaacttgacctcatggagatagggaatagaataagttatccggggctgagaaggggaaatgaagagaaattggtgaatatgtacaaatttccatttagatcaaaggaataagttctgatgttagaaagcatactagagtgaactatagttagcaaaaatatattgcatatttcaaagtagttggaagagaggacttgaaatgttaccaacacatagaagtggtaaatactcaagatcatggataccccaaatacgctgacttgaccattacacattctatgcatgcaagaaatgctcatgtgtaccttatatatatgtaaaatatgtatcaataaaagaaaatatataaaatagttttaaaata

SEQ ID NO: 228855 - DNA, 453 bp, Homo sapiens
tgggagctaagaacataaagtacattgatttctttattacagctagcagatatttaataatgttagcacaggtctttgaataaattttgcttctaagaaaagttactatttactcctaattagacggagacgaaagtctttgaagaggaacctctactttactttttacaaagatgtcatgaaaaaggaatgctattaaaaaatcggagacaaacaaaggctcctagaaattaaaaattaagttagatcatctgaaattaaaattttaaattaagatgaggagatataatgaagtttcccactaaataatatgaaaaaacaaaattaaaaaccaaaaaaatggaatggacaataacagggcccactgaatatccaaatgatgagttcaaaaagaccctcacgaagacatagactcatgaaatttcagaacactgaagaaaatgaaagaggaaa

SEQ ID NO: 228856 - DNA, 1111 bp, Homo sapiens
ctcacttcttggtgcctgcctaatcctccaaatcaccacaggactattcctagccatacactactcaccagacgcttcaaccgccttctcatcgatcgcccatatcacccgagacgtaaattatggctgaatcatccgctaccttcacgccaatggcgcctcaatattcttcatctgcctcttcctacacatcggccgaggcctatattacggctcatttctttacctagaaacctgaaacattggcatcatcctcctacttacaactatagcaacagccttcatgggctatgtcctcccatgaggccaaatatccttctgaggggccacagtaattacaaacctgctatccgccgtcccatacatcggaacagatctggtccaatgaatctgaggaggctactcagtagatagtcccaccctcacacggttctttacctttcactttatcttgcccttcattatcacagccctagcagcgctccaccttctattcctacacgaaacaggatcaaacaaccccctaggaatcacctcccattccgacaaaatcaccttccacccctactacacaatcaaagacatcctcggcttatttctctttcttctcaccctaatgacgttaacactattctcaccatggttaggccttccctaaccatgctcctcaaagagaattaggtcttcccattattctctctcacagcactcctttctgatgcagaggcagtatctgagccactaacagtatggattgcctggaatccaatcctgactccacacttactagctgtgagaccttgggcaagtcacttagcaagtctcagtttcctcctctgtaaaatttgggaaatctatttcacagagttctgtgaagattaaatgaatgaatacatgtaaagtccttcccatagtgccatgacccatagtttaagtgttcactaaccatttgctgttaagattttccttcctagggccgggcaggtgggggcacctgtaatcccagctactcgggaggctgaggcaggagaatagcgtgaacccaggaggcggagcttgcagtgagcccagatcacgccactgcactccagcctgggtgacagagcgagac

SEQ ID NO: 228857 - DNA, 498 bp, Homo sapiens
agcatgagccaccaagccaggcctatttatggtttctgatcatttttatttctttaaaagaagtgtacaggtgggcacagtggctcactcctgtaatcccagcactttgggaggccaaggcaggtggatcatttgaggtcaggagtttgagaccagcctgaccaacatggtgaaaccccatctctactaaaaatacaaaaagttagccgagcgtggtggtggacgcctgtaatccctcctgctactcgggaggctgaggcaggagaaccacttgaacctgggtggcagaggtggcagtgagatgagattgtgccactgcactcaagcctgggcgacagagccaggctctgtctcaaaaaaaaaaaaaagaaaaaaaagaagtgtacactacagcaaagcatgtctgatgccagtgggctatgttggggtgggggtaagggtgtcaatttgacctgggggttctgaaagtctcaggaaaggcagatgggggaaggcccg

SEQ ID NO: 228858 - DNA, 425 bp, Homo sapiens
ctccgtgtgcacgcactggacttcctggagttattcatcaggatgaggggctggcctaactttaaaaatcaaaaagccaggccaggtgcagtggctcatgcctgtaatcccagcactttgctcacgcttgcaatcccagcacttggggaggccgaggtggccagatcatgaagtcaagagatccagaccatcctggccaacatggtgaaaccctgtccctactaaaaatacaacaaaattagctgggagtggtggcacgtgcctgtagtcccagctactcaggaggctgaggcaggagaattgctttaacctgggaggcggaggttgcagtaagccaagattgtgccactgcactccagcctggcgacagagtgagactccgtctcaaataaataaataaataaataaataaaataaaaaagcca

SEQ ID NO: 228859 - DNA, 377 bp, Homo sapiens
tccaagagtcaaaaacttgctatcttctgagatagacataggtaaataacctaccttcctaaaacaaagtacaaaatgtaccagtattttgaaaaagaaatcagcagggaagaagttgagaaagaaaattcttggacaagatcctacccattggattttacttgccttccacacttgaatttctctcatttgagtccacaagctaccaccagggacagcctgcttgctacactcctccgaactcccaatccaactaagagggaaaagaccttccttgatctgctcaacacagctgcatcatgacatagcattttagaaagtaacattatgacattttcaagtaagacggaatggaagtaattagaaatgcatatggg

SEQ ID NO: 228860 - DNA, 6050 bp, Homo sapiens
  misc_feature (6042)..(6045): n is a, c, g, or t
  misc_feature (6047)..(6050): n is a, c, g, or t
gagcgggtccgtagccacggcaacaggttgcttctgcagtctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcggactctgcccgtctaagactcccatcaatgaaaatgctcccgtctttgatcctgaaccggtcattgcccactgcttcaagcagttccagcagaaggacttccgcctgcctcagacccgccggcgaatcatcatggtgcctcgcaaggaggatcagacaccccttaatcctgcatcccaacctcaggctcccccaaagcccatccccagcttcaaagttctggaagctagagatatccaagagcagccagaggacaggaagacctggctgagccagaggtcgaagctgcggcaggagctagagtcctttggtgatgtaaagaggtggctggagaacaagcccagcatcacgccttcagaggccaaggtcttacacatgatccacgaggagcagagtgcccagccaaatgcctcccaggcaactaccaggaccaccaggaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcgtgcgtacccctccccatcctgtgcctccacctccccgtcctgggagcaagcatggtgcaggcagccttggcctctcctccaaactcacttcctcagtgtgttccccagttttggccgactgtggtttggccaagcctctggaaattttcaggcccagagattaactaaggagtagatattcccttgagtgcccagctaccactgtgtccattcaaagacaaatgagtcccagcccttgttcttagaggaggatactcagcccaccagagcccacctgagaggctgagaactgacccaaatggcaagcctttccagagacatttatgtgtgtgtgggtccaaggcctcctcactattaatccatagcttattgataaaattcttgttcagaaccagaattagcacatgtttacagtttactggaaagtgtattttggtattctgctatcaggggtattatggcagggttgctgtcaacagttgtaaaggttgtacatggctcaagttccatctgccaagcaatacatttgtggggccacatctgtccagacaaggcacagaggcaaattagaaatggacttgctaaagctctggctgtgaatttactctacaacacaaaggtgcattgtataatatttctttatatcttagtaccattcttgtagtaaacaaacaaacaaaaaagaaccattacaaccacccacccattctagcacccttcccaaacatagccacagctttgtttttctaaatgaaacaaatcttgctctgttcccatctaccaggttggcaggaacttaatctcatgcatgtttggggcttccttgtcctccctgagtcacacaggagccctggaggaggcagtggaggggtttcctaacaatggtaaagatctggggtgaggccgttggagtttacagtcacaccaagaggagttactcagcatcctcactggagtggctcatttggggacagcaggcagctcagagcatccattcctcagtcctccaggagattttcaatgtccagtctcaaccagctgccctgcagagaaactatcacctcccaagcagggtctctgcctctctcagagctcagggaagctcagcaccccaacagtcgctcctgcatgtgtcaccaccccaacagtagtaatctcctttatgtccagcacatttttaaggtcacctcaagttgggctgctttccctctgatactctttgtgcctttttgttataaattaccaagcttatcattatctgtgtagctggctgtgagtcatttcaatgaccacagtgtgctgtgatgcatattcgcagcagagatattttgggtcctgttatttcccagtaagtaaacacaaagccaagcagcagacctttgctctcatggtgctactttggcgtcatcactgagttctttttccctggtgagcaatagtgggtaagataggtagactggggtgtgtaagaattaaagaaagaggaaagaaacaggaaaggtggctcaatagtcaaagacaggtttattttagagaaaacaaacctgagaggggctgctggctgagttaggtcagagccacattctcttacagactaagagtttttaaggattcacagtggaagagtttatcagaggcttggactgcttctctgtctctttgttgtgtttatctgggaggcagagttgcgtgtctgtttccatacatctttctgcagctgcaggcatatcccccaagtctgcttttagcttccctatcttagtgcacctgaagggaaaggaatgtgcttattaaggcccacagttttactggggcccattgtatgagggtgaagtttggcagtcacccaagagactttcccccgacctccctctgtgcctgagctgtcttgtctgtgttttactgtctgctctttctggctgcttatagttagaagagaagtgatttccttgaaatgcatgaggctagaaagggagctggaacttaaagtggcggtgtttgtcccagatgacggtgctcctgctctgtccgggtgtctctcactttgtctaaagaggcaagagtttgagcgtcttggcaggggtgccttcttccagtagttcttcttgcagtagctcttcttcattcttgcagaatgatctcagtttatcctttatgtccgcagaggtcaggattgctattcctgctttacgaggaggaagctggagctcagagaggctgagccacttgttcacagcctcaatagaaggtggtaaggtcaggatattatttcagcttgagacgatgaaggtctgaaccagggcagggacaatgggattctttcattcattggaatctttgttgagcaactactatgtgccacttctagaaactgggaacacagcagtgggccagccaaagccccagctttcgatgagcttgcacctaaagggctggtggtcagggacggcctctctgagaagcagacattggagctgacatctgagtgattgacaggaactagtcttgggggaagcacaatctaggcagatagaactgtgaaggcaaaggccctggggtaggatagcttgcaagagacagaaggtggtcagggtggctgggtggaatgggtgaagggtgaatggtatgccatggaccaggtgggaaggcagctgaggccagatggtacagcagggccttgtagcccagggagaggactctgggttttggtctaaatgctgtgggaagccaagggaatgaggcgatctggtcggtcggtcagtctgtctatctatctatctatctatctatctatctatctatctatctatccatccatctacacatatccaacataaggagactcatgcaatggggtctccttatgttgcctaggctggagtgaagtggctattcacaggtgtgatcatagcttactgcagcctcaaattcctgggcataagcaatcctcccacttcagcttcctgagtagctagaaccacaggcgtgccactgcaccctgctttatatatgtgtatatatatttttggggggggatggagtcttgctctgccatccaggtttgagtgcagtggtgtgatctcttctcactgcaacctccacctcccgggttcaagcaattctcctgtctcagcctcccaagtaactactacaggtgcacaccactgcacccggctaatttttgtatttttagtagagatggggtttcaccatattggtcaggctggtcttgaactactgacctcagctgatccactcgcctcagcctcccaaagtaccctgctctatattttttgtttgtttgtttttgagagggagtctcaccgtgtcacccaggctggagtgcagtggcacgatctcggctcactgcaacctccaggtcccaggttaaagcaattctgcctcagcctcccgaatagctgggactacaggcacgtgccaccatgcccggctaattttttgtatttttagtagagacggggtttcacagtgttagccaggatggtctcgatctcctgacttcatgatccgccctcctcggcctcccaaagtgctgggattactggcgtgagccaccgcgcctggctatactctatattttttaaagatcctatttgctgcttggtgagacagggtgacaggacgagaatggcaaccagagggctggggttggtgcagtaagggacgccattagtggagatggagaggagggccacatctaaggtacagcttaggtggcttaggtgggcactgcccagacgtgtgggaagggagcggaggggtggcctggtgcctgctgggtgacactggataactgcttggcaggttccgtggctgggcaccctcttagtccctccttccttcatctcttccctctgactccagattatatcttggccaagcacagagattccctgaagggtccgctcaagaagcaggaggtggattcagccccacagcttcccaaagtggacctactgacggtgcctgcagtcgacacgcagatggagacgcggcccatgaccctggaggagatggaggaagtgggcaagcggtaccgcgagcggcagcgacagcacaagctcacgatcccctccatccagtacacggagcaatgtcacctggtgcgctgtgggaatcggcactttgatgagcactgcctcccgtccaccatccacggggatatgagggagctcattgactcggcccgcaggcacaactttctggtctacctgcaatgctggaagctctgtaagtcctatggcctcccgctgacagaggacatcctcatgaaagccttgctgtacccaggagacaagatcattttccagatggacaaagtgtgccccatccggcagccgggaggctactactctgactggaaggtcttttctccgaatctggctctgctccggtcccagggccctggcaagtctaagaggactgacaagaaaacgccaaagaaaagcaagaaaatgcgctttaaggagtttgaggaatttaccaggaagctgaaggtgaagaggtccagtggtctgcagcaaacacaccccaattccttctggccgggtcatcttctggataagctgcagctctacctgcccactgtggccacagaccggagcctggcgctcttcagttgtgttcaacaccagccccatgtctacccagccacctaccaccctgaccactggtggccccttaggaacaagaactacatgacccacgcccattatgatgccgccaaggtgtactacatcaactagagctagccaggtgttgccggacccagccttcctgggccaggggccagtgcagccagcggcccagagcccagacacaagaggagtgtcaaagagtcaaactaaagaaatcctttcaaagagggatggaccgggggccagttccctctggactcaaagtgtccagtgtctcagagggtagatgtgtccaaggaatgacgtgcagtttttgactatttccctcccctgacctctgccctttctacataaagcaggttggagtttttctcannnnannnn

SEQ ID NO: 228861 - DNA, 2164 bp, Homo sapiens
  misc_feature (2156)..(2159): n is a, c, g, or t
  misc_feature (2161)..(2164): n is a, c, g, or t
gagcgggtccgtagccacggcaacaggttgcttctgcagtctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcggactctgcccgtctaagactcccatcaatgaaaatgctcccgtctttgatcctgaaccggtcattgcccactgcttcaagcagttccagcagaaggacttccgcctgcctcagacccgccggcgaatcatcatggtgcctcgcaaggaggatcagacaccccttaatcctgcatcccaacctcaggctcccccaaagcccatccccagcttcaaagttctggaagctagagatatccaagagcagccagaggacaggaagacctggctgagccagaggtcgaagctgcggcaggagctagagtcctttggtgatgtaaagaggtggctggagaacaagcccagcatcacgccttcagaggccaaggtcttacacatgatccacgaggagcagagtgcccagccaaatgcctcccaggcaactaccaggaccaccaggaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcattatatcttggccaagcacagagattccctgaagggtccgctcaagaagcaggaggtggattcagccccacagcttcccaaagtggacctactgacggtgcctgcagtcgacacgcagatggagacgcggcccatgaccctggaggagatggaggaagtgggcaagcggtaccgcgagcggcagcgacagcacaagctcacgatcccctccatccagtacacggagcaatgtcacctggtgcgctgtgggaatcggcactttgatgagcactgcctcccgtccaccatccacggggatatgagggagctcattgactcggcccgcaggcacaactttctggtctacctgcaatgctggaagctctgtaagtcctatggcctcccgctgacagaggacatcctcatgaaagccttgctgtacccaggagacaagatcattttccagatggacaaagtgtgccccatccggcagccgggaggctactactctgactggaaggtcttttctccgaatctggctctgctccggtcccagggccctggcaagtctaagaggactgacaagaaaacgccaaagaaaagcaagaaaatgcgctttaaggagtttgaggaatttaccaggaagctgaaggtgaagaggtccagtggtctgcagcaaacacaccccaattccttctggccgggtcatcttctggataagctgcagctctacctgcccactgtggccacagaccggagcctggcgctcttcagttgtgttcaacaccagccccatgtctacccagccacctaccaccctgaccactggtggccccttaggaacaagaactacatgacccacgcccattatgatgccgccaaggtgtactacatcaactagagctagccaggtgttgccggacccagccttcctgggccaggggccagtgcagccagcggcccagagcccagacacaagaggagtgtcaaagagtcaaactaaagaaatcctttcaaagagggatggaccgggggccagttccctctggactcaaagtgtccagtgtctcagagggtagatgtgtccaaggaatgacgtgcagtttttgactatttccctcccctgacctctgccctttctacataaagcaggttggagtttttctcannnnannnn

SEQ ID NO: 228862 - DNA, 1727 bp, Homo sapiens
  misc_feature (1719)..(1722): n is a, c, g, or t
  misc_feature (1724)..(1727): n is a, c, g, or t
gagcgggtccgtagccacggcaacaggttgcttctgcagtctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcgaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcattatatcttggccaagcacagagattccctgaagggtccgctcaagaagcaggaggtggattcagccccacagcttcccaaagtggacctactgacggtgcctgcagtcgacacgcagatggagacgcggcccatgaccctggaggagatggaggaagtgggcaagcggtaccgcgagcggcagcgacagcacaagctcacgatcccctccatccagtacacggagcaatgtcacctggtgcgctgtgggaatcggcactttgatgagcactgcctcccgtccaccatccacggggatatgagggagctcattgactcggcccgcaggcacaactttctggtctacctgcaatgctggaagctctgtaagtcctatggcctcccgctgacagaggacatcctcatgaaagccttgctgtacccaggagacaagatcattttccagatggacaaagtgtgccccatccggcagccgggaggctactactctgactggaaggtcttttctccgaatctggctctgctccggtcccagggccctggcaagtctaagaggactgacaagaaaacgccaaagaaaagcaagaaaatgcgctttaaggagtttgaggaatttaccaggaagctgaaggtgaagaggtccagtggtctgcagcaaacacaccccaattccttctggccgggtcatcttctggataagctgcagctctacctgcccactgtggccacagaccggagcctggcgctcttcagttgtgttcaacaccagccccatgtctacccagccacctaccaccctgaccactggtggccccttaggaacaagaactacatgacccacgcccattatgatgccgccaaggtgtactacatcaactagagctagccaggtgttgccggacccagccttcctgggccaggggccagtgcagccagcggcccagagcccagacacaagaggagtgtcaaagagtcaaactaaagaaatcctttcaaagagggatggaccgggggccagttccctctggactcaaagtgtccagtgtctcagagggtagatgtgtccaaggaatgacgtgcagtttttgactatttccctcccctgacctctgccctttctacataaagcaggttggagtttttctcannnnannnn

SEQ ID NO: 228863 - DNA, 720 bp, Homo sapiens
accaaactgatattttaacaagaagagtatggaaatcatttgcctgatatacataattgatttatttatttattttagaggcagggtctcacttcatctcagcctccagagtagctgaaactacaggtaagtaccaccatgcccagataatttttttttttttggtagagatgacgccttgctgtgttgcccagggtggtctctaattcctggcctttagcaattctcccgccttggcctcctaaagcactggggttacaggcatgaaccactgtgcccagcctgcatgatgtaatctccaaattgagggtcacccaggcatggaatgcacagctctgccagacagaaagcgctttggatgcctgagaaacaacagcttgtccgggctactgatgcgaagagaggccatggtttcctttttctctgctctgaatggcagccttgacgtcacaacagctaggaaccactggagggacaaataacaaggcgcaagccagaagcgccctgctctgtcgcaggggcagggccattttcatccagttctgatgtcttctgtggccgctgcgagtcggcgggagtagagacaaatgactggagctttaggcgtaaaggcggtctctctctaggctgatcaaacagccctttgcccagtgctaattgccttcacggaacctggataaactacagttcccgaattaaacttgtttctgatgaactaga

SEQ ID NO: 228864 - DNA, 457 bp, Homo sapiens
agctacacatccgtccattcgtttaatcttcacagcagccctggaggtcacccaggcatggaatgcacagctctgccagacagaaagcgctttggatgcctgagaaacaacagcttgtccgggctactgatgcgaagagaggccatggtttcctttttctctgctctgaatggcagccttgacgtcacaacagctaggaaccactggagggacaaataacaaggcgcaagccagaagcgccctgctctgtcgcaggggcagggccattttcatccagttctgatgtcttctgtggccgctgcgagtcggcgggagtagagacaaatgactggagctttaggcgtaaaggcggtctctctctaggctgatcaaacagccctttgcccagtgctaattgccttcacggaacctggataaactacagttcccgaattaaacttgtttctgatgaactaga

SEQ ID NO: 228865 - DNA, 367 bp, Homo sapiens
ttatgatgtaattaaaactactgactattaagggtcataactgaagaccagaggtaatttgtgtttatgaagttattctgccacaaagatgaacaggcaagatgataaagaaccagtttaccaataaataaatcaatataataaaggcatgctaacactaagagtgccaagtctgaaaaaagcacaaacaaaaatgaattagcagtctcaatttgctaaataagaggttaatatataattaggtctcactctgtcgccaggctggagtgcagtggcatgatctgggctcactgcaacctccacctcccgggttcaagtgattctcctgcctcagcctcccaagtagctgggattgcaggcatgcgcc

SEQ ID NO: 228866 - DNA, 676 bp, Homo sapiens
aggaactcctcccagggtcctggatccagctgctgctcacggcaggaggcccgaaaccagaaggcctgagcacttgccccgtccccaagagatgcacagaggctggaaggggcagtgcaggggctgaccaacctgctcatgaaaggagggtccagctgggcttcctgggtcgagtaggggttcagaaagctgtgaaacactcatttcctgcatcaggacttacttcggtcctggatgaagagtactgaagatacatgcctaaaatattcctaacaccaggatttgtgcatgtgtttccttccccaagaaagctataaacagcaaaaattctgctgtaagcttccctgtgtcctctctccctctcttccttccccctcccctaaaactaaaaggaatgttaaaagaccctttttctgtgaccagcggaccttatctatgctcccaattccaattccttgtgaacatactttgtaaagtcctgtaaaatcctgtctcttttgccatgctgctgcaaggtcataaagtagataaaattagataaaacctaagttgcaattctgtttttcctcaaaatctaagacatgtcacaaaataatttactgcctttgtttctctctctggtaacatcttcccaccacatgtatttcccgccttaaagagattaaaaggcaatcac

SEQ ID NO: 228867 - DNA, 443 bp, Homo sapiens
gaagagctcacacagcagcagcagactatctaaaaatagaagatttgaacagctactacaatatccactttttgggatacctacccaagataataaaccttaaatgatgtttcaaaggttaatcatttagttaaaatttactccaaaagtgctacagtgctggctatgtttaaacttgatactcagttaataatgcccagttcatggcactgaatttacaacatgatacatctggaaattacattttattttgttctgccatctgttctattctaagaacaaacatattactaaaatacccacaagttatttttttacatagaactattggaatactttcaattcagattctttaagaaccaactagaaaacattttcttttccaactgctatttcttcctataactaataaaattttcagcctgattttaattaaccagaaa

SEQ ID NO: 228868 - DNA, 559 bp, Homo sapiens
gaaatgtgaatcatatccagcgtatcccagcagtgtatgctatctgtcttaggcacttagtagccatctgggttttagatcaaaaaataataataatatgtatatagagtttggttctatccatggttttatgcatcctctaggggtcttgaaacatatgtcccactgataagaggggtctactataccacatattggatttatggactcctcatcaatttgttttcaatctaaacaaaatgacttttctttgagggtccattctcacacaatatgtagatgatattttgcagtgccctcttgatctaagtatttcacagagactccatatttcttttcaagattagctgaaaaggggcataaggaatctagagaaaagtgattttgccaagaaactgaacaaattatttgagtcatgatctgtcagtacatgggtatttttcgtacaccaaaacaaagaaaattccattttactaaagctctaaattaaaagacaatgaaaaaatttttaggattgactggttattgcaagcaataaatacctatttttttaaaagtt

SEQ ID NO: 228869 - DNA, 466 bp, Homo sapiens
atgaaaagagaaagcaaacgacagaggcttcgagtcaatgcccaagttgttagtctgattgaacagtgttactgaattacgaaattgaattattgaattattattgaattatttttgctgctgttgttgttctcattgttgataaaatggtggagcctgaggctggcattggatgtgagtttttgagtgattcccgctctgctgcactggactgcatgaattatttacaagtttgttacccagttctacttgatggattgatttcttcactccataaatatgcagtgaatgtccactccataccgttccagacacagggggctctgaccctggcccagcaagcacatttctgaccccctggagcttgcattccaggtgggggaggcagttagtgaacaagatcatttcagacagcgctaagaagcatgaggagattttttatttttttttttgagacggagtctcg

SEQ ID NO: 228870 - DNA, 467 bp, Homo sapiens
ccaaggtatgagcagagggagagagggctggaaaaagagactctccctttgctaactgatgagggagaagtatggggtccaagtgggcctgccccttgcctaatttttgcccaattttttggcctctggagtccctggtagacttcttaacttcttgcacacaaggttaccatgtgtctaattgctcagctccagttagagtggtggagggaaactggtatcaatgaatgaatgaatgaatggatggatggtttaatgacagcttggagaaccgactggggtttgagcaagaaacaggaagagaaagccaacatcttttagctcaccaaatactttcatgccccttgggaggaagaaaaatggatatgggaaatgcagagcatggaagagcttaaattgagcataaaggacataaaactagataagtaagatcagaaataaaagatgagtcatcatcgaatccaaac

SEQ ID NO: 228871 - DNA, 553 bp, Homo sapiens
acaaggaatatagtgttttgcccacccaatgttgagctagcaacaacacatcagatagactaaataatactttcatggtttttaaaaaaatccataagtgatatccatgaaaatccatagtacagatggatccaaaaatttttctttatcattacatcgctttctaaaatgatagtctgatgtactacaaacattaataagtcaatatgtgaaattctgctctaaaatattctgaatcattaaaggtatttactattatttcatcattcgctgtgtggtcaggctttgccataggttaaaatataacatgagatgatagatatgttaattagcctgattggatcattccacaatgtatgcatatatcaacccatcacattgtacctaataaatatatacaattatttatcagtttaaaaaaggagccaagcacagtggctcacacctgtaatcccagcactttgggaggctggggcaggaggatcacttgaggccaggaattcaagaccagcctgggcaacatggtgagactttgtctctaaaaaaaaatagg

SEQ ID NO: 228872 - DNA, 576 bp, Homo sapiens
tgccctgtcacccaggctggagtgcaatggcacgatctcagctcactgcaaacttcgcctcctgggttcaaacgattctcctgcctaagcctcctgactagctgggattacaggagcccgccatcacacccagctaatttttgtatttttagcagagacggggtttcaccatgttggccaggctggtgtcaaactcctgacttcagattatccacccaccttggcctcccaaagtgttgggattacaggcatgagccactgtgcccagcctcatgacttcttattcctggtcccatacctggatttgtctccatccgttttccgatttttaatagtttgttttatcttttgggtttttcatctaactcctctcgtagacctcattgctcagagtgcactgttagggcaaggttctgccactgccaccctccatgagtagatttctccctcctgccctggggatatggagagtggcttgtttctttccctgtctatcctagaaagatgatttgtgggttttctataaggggtttcctgctggacaggggcgtgggattgaattaaaacagctgcgac

SEQ ID NO: 228873 - DNA, 638 bp, Homo sapiens
tgccctgtcacccaggctggagtgcaatggcacgatctcagctcactgcaaacttcgcctcctgggttcaaacgattctcctgcctaagcctcctgactagctgggattacaggagcccgccatcacacccagctaatttttgtatttttagcagagacggggtttcaccatgttggccaggctggtgtcaaactcctgacttcagattatccacccaccttggcctcccaaagtgttgggattacaggcatgagccactgtgcccagcctcatgacttcttattcctggtcccatacctggatttgtctccatccgttttccgatttttaatagtttgttttatcttttgggtttttcatctaactcctctcgtagacctcattgctcagagtgcactgttagggcaaggttctgccactgccaccctccatgagtagatttctccctcctgccctggggatatggagagtggcttgtttctttccctgtctatcctagaaagatgatttgtgggtttttgtttttgtttttggttttgttttttttttttgtcaccaaaatggcagctgggttggtgttgggggaatacagctggccttgggtggaagcactcctccaccgtttctccctggtttc

SEQ ID NO: 228874 - DNA, 600 bp, Homo sapiens
cgcttctggtcccaagcattttggataagggatacccaaccatttcagacagcttagttttaaagcagctgaaatgttatggtgattccataaccaagtttgtgaaacatttttctttgttgtgggactttggaagctttaatatgccaattttcattgtgactatagttggtgagggtggatgagtagcactttataaactgtttaggtggtgtggcctttttagccctagcacaacgccttactcaattcttaactccagctccctagagcattcactagatacgtttctgcagaatatactttgggaaacatggttcaatgaatcgccttcctctgcttttccctcccatcctgccccctagggtaaactaaaacctgaaaatgtcctcccctcttctgcccacaactacctttaaaagttttctttagtacaagctttagtacacagtttggacagtctttcccactgtcttgtgttagaagagcactaaattattctcagggcttgcgagtcagtcttgatctcaacttattagctggctgtggtatcatctgaagtcagtttcagtccatctagactggtgaaactaggaggag

SEQ ID NO: 228875 - DNA, 546 bp, Homo sapiens
ctcatatgatagtgaaatgatacttaaatgccagtgatgctttgtgtctgtctctcttaatacacgtaagctcccagagggcaagccccatccatgttttattcatatttgtatttaatactttgcaaattgtaataccatgaccttgggccatggacatcaccgctggctgctcagtgaatgtgggctgaattgctctatgtatcggtctttgtctcagtcagcttgggctgctatcatcaaatggcatagacagggtggctttaacaactcacatttatttctcacagttctggaggctgtgaagtataagatcagggtgccagcatggttctggtaaattgaagttcatgaaataatgagaccttttataaaagacagtggcataaatacaaaatataccacgaacatttcccttaagaaatgtttcacagagtagcatattggtgtaattacacataagactgattcagcattataattacaaaactgttttcataggattcagtgttaattcaggctctcaaattaaagccaaagtctgca

SEQ ID NO: 228876 - DNA, 401 bp, Homo sapiens
catagtccatagtgagatatatattttcaaaattttatttgtttaaactatttgttaaattctgtcttctccactagactataagccccacgaagacaggattcatgtctgtaaggttcacctatttccagtacatacatagtgtctggcgcattggatgtaccaaataaggatttgttgagtgaatgagaatagtcagtcaagactctggattgttgaattttaggtgctgctcattgtccctcttttatcttcagaaatctcgatgaaaatatacacatagaagacaaaaccgaagaaatattttattatttgttggggcttctctaatttttgtatagctttagtaagctgaattagatggcatggaaccgagaagtttccttctacctgaattgggt

SEQ ID NO: 228877 - DNA, 440 bp, Homo sapiens
cagcaaaactggagcaagttttgtaggaatggctccacgttgctgagtcaaccacagttctcatctcagtccttggctcaggctcggcacagtggcccagggctatgtgctcttccctggagcccattcttgccatcctgggcacccagcaacctggggtctcctgcctttccggctgttccttcttggctgcctctgctagttcatcctccctccccaaagctgaaacctgcggctcccagggttcctctgtccgtacctgtgctgtccagcacggtagccgctggccacaggtgagattttcacttaagttgaaataggccgggcgcagtggctcatcatgcctgtaatcccagcactttgggaggccgaggcaggcggatcacgaggtcaggagatcgggaccatcctggctaacacggtgaaactccgtctctact

SEQ ID NO: 228878 - DNA, 351 bp, Homo sapiens
aggagttcaggcaatgacactggacatgtcatcagccctgggcaacttcaggcgcagtgttgggaaaagaatagacaaggtcccaaggtcaattccagcgcctggatcctctgatcccagcctcgctctgcaggcaagcccaagaactccaagcacaatcgccaagatgctacccaaggagggaagcaagatacctgaaggacacccaaacctcagtcattctaattcttgggaccacacaagaagactgaaaggtattattttttcaaattaatttgaagtgtcagcagaaaacattttgtttcattaaagacagcaggcctcaagaaaaaataaatcaatgaacaaata

SEQ ID NO: 228879 - DNA, 683 bp, Homo sapiens
tccagagcaaggctgtaactctctttaattctctgaaggctaagagaggtggggaagctgtagaagaaaaatttgaacctagcacaggttggtttatgaggtttaaggaaggaagctgtctccataacattaaagtgcaaaagcagcaagtgctcatgtagaagccagtaagttatccagaagatctggctaaaatcactgatagaggtggccacacttagcaacagatttttcagtgtagatgtaacagccttctattggaagatgccacctacatctttcatagaggaaaagtcaattcctggcttcaaagaaagccagtgcccatttgccattctgaaaatcttagggcccttaaaaattatattactctactctgcctgttctctgtaagtggaacaacaaagcctgatgacagcatatcaacattgaggcaagacccttggccagcaaaaagatgatagctcactgaaggctcaaatgttagcatttttagcaataaagtgttttttaattaatatacttttttttagacataatgctattgcatacttaatatactatagtatagtgtaaatataactttttttttttttttttcgagacggactttcactcttgttgcccaggctggagtgcagtggagcgatctcggctcaccacaacctctgcctcacgggttc

SEQ ID NO: 228880 - DNA, 1180 bp, Homo sapiens
tgcaattttcagtttttgtttatagtaaataatacgcagtgaatatttttgtgcctataactgagtgtgcattttacattttttttagggaggagaaattgctggtaaagtcctaaaaggaaatttcctaagtaacaaggtattatttttacattaaagagtagtgtatttttattaccaaatctgtcgtgtttattattgagaaatttaaaagtataaataggaggccaggctagatggctgacacctgtaatcccagcacagtgggaggccaatgcagatgggttgcttgaggccaggagttggagaccagcctggtcaatatagcaagacccagtctcattaaaaagaaaaaaaaaaaaacttataaataaatgaaaagaattccccataaaatcacaaccccaaagataaccataactagttattttcagaccttttctataatagataacttgagttttcctcaacaccatatacctctcatattgcttagctaaagagcatgtaaatgtatagtctgtggaatcataaagatatttcatagaggttctaaaaatgaccttattaaaatggcatgtgggtgtcaggctgcttacttacccttaagagaacttggaatgcaaaactgataacaaggacattttgaaaactgtatttgtttgctaaaaagctttccatgtgcattttggggattttatagttaggcctaattctttaccaccttaaaatgtaagatttttaaaaggttttcagaattgttaaggtattaaaattgcatttttatagcaaagtcagaaacaagagaaaggcatattacaccctgattatgatgtttcttgaagagaactcattttaaaaatacatttgaattttctattttgctttaaaattttaagactcctttcagtagtcttggtattaatcttgtactgtgaaatattccagatttcaagaagcaactgtactatgtgcaacagaaggacttgttaccaaataactcaatcgctaatatttgtatctagtcttatgtatgatctttaattttgtattgaaataaaattgtatttgtcatggaatatatatactttcatagaatttttctgtagtttttggcaccccagacaaatagtatttgtcaaagtattctgctaactattgttcaaaatgatctgctctt

SEQ ID NO: 228881 - DNA, 518 bp, Homo sapiens
tgatgaggtactttgtaaggtttgacataccagattttttaacccagatcctgtttgaatatatctggaaatattctggggcaactaacctcatttttatttcaagtggggatatatttttaagggaaaccaggcaatcatctataatgaagtgattctcaactaggtgatttttgccctttgggggtatagcaatgtgtgaagacgttttgggttgtcacatggagggggaggtgatggccagggattctactaaagatcctgtagttcacaggacagtcccctgtctcccttagtaacaattaccagactcaaaatgtcattagtaataaggttgagaaatcttgctgtaaagaaataaggcttattccgatgctcactaaagtcggaaaaaaagcttttaagaaaaccctattttaaacttatttctaaaagtttagtatcatcctggtgatcatgtggaattgcagtagtagttgagagaggtcatcttcactcccaaaaccaaggcaaaaaaa

SEQ ID NO: 228882 - DNA, 890 bp, Homo sapiens
tgttaccaatccattctcttttaacttaaatgttactaacctctttgagcacctactctgtgtcaggcattgaagccaagttaaagaaaacacagcttctgccttcaaaaaaacttacagtctaatggcaacaccagacataaacttcagcaaggatctgagggaggaacaaataaagtgccaacaaagggaaaaaggtgctacctgcaactagcaggaatcaaggaaggctttgtggaggccatggtattagaacatgacccttaaaaccactgagcttgagatgcacagagaagaaagagaaacatgagcaatgaaggaaaaacctagggcacctagaagggtgagaggcagctcagttgggctaaaaggcggagcccagaatgggagatcaagctgggctgtaggaagctcattcttgtggcaggttaggctggattgcaggtgggaaagaccaaagaggcaagtgggaggctcctgccgttgggatcaaggatgactttatccagagcagatgctgtgagacaagaaagagggagagaagccccagcaacatccacgaggcggaactgacacgcaggcctgaaacaaggtgattctgaggctgtaggcctgggggcctgggagaagctgctggcaaacataggcagcaccagaggagagagacagatctgtgagatccatgaagaggtgggtgtttcccactggggggcctgctgaagagacagagcgctttcaggagagccacaggctgccgtcatatgacaaggctatcgtttactgaatgaaggggaagagaagtggggtagccagggtcatcttcctctcccatgagctttgacatgaaatctttagctagaaacatgttctcttctatgttatgtatagca

SEQ ID NO: 228883 - DNA, 420 bp, Homo sapiens
tccaaattcttccatagctatatatcatctacctaattttccttgttttatcagatggaaaacgtaccttgaatcatgaagttagtacaattgattcaatcaggttgtttttcttgaagtagttgaaagattggactgaagtattcactctactttggcctatttacaactgtaatacagaatggcccatgaaataactgggccatcctaaggattaaatgaattaaacacaaatgaccctgccttcatttgtttcatcataacttcccggccttactcagactcattaaaatgccatatcctttgtacagtatactatacaagaatgatagccacaggcccacaaaagtatctcacagggccaatactagacgtcaggtaggaggtctgtgaggcagcctgacccaggtgtttccggga

SEQ ID NO: 228884 - DNA, 423 bp, Homo sapiens
taataggtgtatctattttggtataggcatgcaaaacataataatcacaacttggaaaattgggtatccattgccccaagcatttatcctttgtgaaaatacagaacactttacaaatttccatgtcatccttgtgcagggaccatgctaacctttgtatagttctgatttgagtgtgtgtgctgctgaagcaagcactctcatctgggtttttttcccgtttctcctccacaaaggctgataccaaaaattccacatttcatctagaatcttccttctttatgtaatattttctggctgggcgtggtggcttatgcctgtaatcccagcactttgggaggccaaggcgggtggatcacctgagatcaggagcttgagagcagcctgaccgacatggtgaaaccccatctctacgaaaaatac

SEQ ID NO: 228885 - DNA, 339 bp, Homo sapiens
agccaaagaacttcttttcagtggttttatttggtattttcaccagagctttctcacataatcgtctcctttcttttgttccctgtcgtcaaatgcatggcctctgatgctgaacattccccgggggagagacatggatgatcacaatggcccagcatgggtcttggcactcgatgtgtgaggcaagttagcaccaagctgcagggctgcaagtggggcagagcttctccaggccttcctatggggcttcatcacactctgtagcttttcctcgagttcaaatcctgtccacagacaaacttctaacaaagcttttgttgttctgatgagtcacagctt

SEQ ID NO: 228886 - DNA, 534 bp, Homo sapiens
acgccagagatggaaagatgttagagaaacagaagaatgaactcggctgaactaagaaaggcagtccttggcaggatgtggggagggtagcgcctccggccaacacaataggattcacctgggagaggggccagctccggagatttctgagaggctcctcctccagaaggatcagccaggtcccggcagctcaaccgggccaaggtgccggagaccctcggactctgcagactgtccagtagggggcactgttgcctccacactggccgacctcaaacaccttctgctcctggtgtgcccctccccaaggtcctcccccaggagtggaaggccgtctccagccctgaagagactcaaggatcctacctgtctgcaagccaccccaggctggcctacctggcagagcctgggtgacatcctgcatcctcagggatgacacagcaatcactacagctgctgtttactgagcacctactatgtgccagatgctttcactgtgtgacctcattaaaactccaccggagccctctgaaa

SEQ ID NO: 228887 - DNA, 639 bp, Homo sapiens
gtttttctttaccatgacaacactctagttcattcctctcattaaacaagggcaattttgtgagagtgttagtaggaaatcattaggccctcacctgaaggttctgatttggctccttctaacttctttttgtttcctaatcttaaaatgtctttaaagggcacccattttttttctgcaaataacaatgtaaaaatgattgccttgacatggttgaattccttggatgctcagttcattagagatgaactaaatgactgtataatctcttatgaatatgttttaaccttcataaggcttacagtgagaaataaagagtttcttaaaaaatcttttaattccatttttccccaaacttttaaaagtcccctcttaaaatggatcaatctattttcttttcaacggttatattgatactttcttgctttttttttcatctatgatactaataccatgagcatccttgtgcatgccctttgaagtggcaaattttattgtttatttctttctccaaagaaacaactttcacttgtattcctatatgctatgtttctgtttcttattctgttttctttttctttctttaattctattaaacagtgtgctaaagaggcaattcagagcattaagaaaaacaaa

SEQ ID NO: 228888 - DNA, 451 bp, Homo sapiens
gacaactggatgtttttaagagagattcttgtcaagttgtgccagccgtaaggtaggaaacccttctgctcttgaggaatgtgactgctgactaggccttaataggcaggttattggagcttcctggacagtggtagagataagttaaccaagtttctcttcaaacccctttttaaacttactgtcaggctttcacctacagcatagccattccagtgctttagtaaactgcctctactaagcactggttattttcttatgtttataagaagtgtcctttccttgattctgccatacctttcttcccaaggaatacttccaaagatgggttttagctcttagctcccaatcaccaagattgcttggcctctggaaaattaggggtgtgaaacactaagaacctgaaatactttaaactcctgtcatctcaataaaaactgccattgtcacc

SEQ ID NO: 228889 - DNA, 775 bp, Homo sapiens
  misc_feature (757)..(758): n is a, c, g, or t
agtattccaggtgagtagcttacaggttcttttttatttttttgaaagagggtctcactctgttacccaggctggggtacagtggtgcaatcaccgttcactagactcgacctccctgggctcaggtgatcctcccacctcagcctcccaagtagctgggactacaggcacgtgtcatcaacccagctaatttttttattttttgtggagacaggctttcactatgttggccaagctggtctcaaactcctgacttcaagtaatccacccacttcagcctctgaagtctctcatatggtgtccaagaaatggtgacaaatctcacaaagggactaggctcagcagggctggaatattcagggaaggtgtcaagaagaaagatgaacttgagttggcttttgagagatgcataggactcccacaggcagagtgaaataagggcattttagatggacaaacacacagacaaaagcagaaatgtgggtggtgtgactggggtttggtgaggggctgctgtggctggaatggagggctgtcacaaataatggaaatggtgaatgaggcaagtcaggtcggactggtggcatagcgtcaaggtggcagcttattaatcactcttccatatgctagcctggctgtgggaaagtatactcatgtctcgacaaaacaaggagcccgtggccgtacagatgtcgcgatagctagtatgagcaggagcctacgggggagccccggcgcagggctccagtgcgggggnngcgcagacagccgccgc

SEQ ID NO: 228890 - DNA, 1072 bp, Homo sapiens
cgctcctgggtaggtatttgccccggtgggatgccttatcagagtggtgcatggcaggcccccgtggaggatcaacgcagtggctgaacactgggaaggaactggcacttggagtctggacaactggaatacggtgatcgggtatggatcacggattggaacatagcctccttgcagccacggtggagaggaccccagaccatcgtcttgaccactcccacagccataaaggtagaaggaatcccagcctggattcaccacagccatgtaaaacctaaagcatctgagacctgggaggtgagaccaagcttggacaacccatgcaagatgactttgaagaagatgacaagccctgctccagtcacacctggaagctgactggtccgtgcatggctgaaagcatgaggaaactcatcgtgggactcattttcctaaaattttggacttgtacagtaaggacttcaactgaccttcctcagactgaggtagggcaaaaagttaaaacagactttctgtttaaaagggacttgtgtgtataatgctacccagtacaagatatgcagcccaagaagtgaccagcttgatgtgtgctataacccattggaactagtttatccctgttggaaaacagagtatgtaactctaggaattgatggaactggactggaagacctgggtagtgaagatgacagtgagaactcccactagtgagtgagattctcaaaggggggaatgagaagtgaggccatttctcttactgtctcctgtctctgaagaggaggaggaagtaaaagttgaaaaacaacaggaatgaagtcattggcaagaccagccggtgccactgatgaccaggcctgaggttaaaagatcaaccccccactctaaccacatgtgctctcaatctatcatgaccctttcatgtggacccccttagagttgtaagcccttaaaagggccaggaactctgtcttcagggagctcggttcttgagacatgagtctgccaaagctcccagctgttgagatgcgagtctgccaaagctcctggccgaataaagccaaatccttcctta

SEQ ID NO: 228891 - DNA, 1121 bp, Homo sapiens
cgctcctgggtaggtatttgccccggtgggatgccttatcagagtggtgcatggcaggcccccgtggaggatcaacgcagtggctgaacactgggaaggaactggcacttggagtctggacaactggaatacggtgatcgggtatggatcacggattggaacatagcctccttgcagccacggtggagaggaccccagaccatcgtcttgaccactcccacagccataaaggtagaaggaatcccagcctggattcaccacagccatgtaaaacctaaagcatctgagacctgggaggtgagaccaagcttggacaacccatgcaagatgactttgaagaagatgacaagccctgctccagtcacacctggaagctgactggtccgtgcatggctgaaagcatgaggaaactcatcgtgggactcattttcctaaaattttggacttgtacagtaaggacttcaactgaccttcctcaggaacctgaggggtaagggggggccaaaaaaacacacagcgttcttaaaaaaacccaaggaaacacttttcttcgtggctttttaacacacgggggacttgtgtgtataatgctacccagtacaagatatgcagcccaagaagtgaccagcttgatgtgtgctataacccattggaactagtttatccctgttggaaaacagagtatgtaactctaggaattgatggaactggactggaagacctgggtagtgaagatgacagtgagaactcccactagtgagtgagattctcaaaggggggaatgagaagtgaggccatttctcttactgtctcctgtctctgaagaggaggaggaagtaaaagttgaaaaacaacaggaatgaagtcattggcaagaccagccggtgccactgatgaccaggcctgaggttaaaagatcaaccccccactctaaccacatgtgctctcaatctatcatgaccctttcatgtggacccccttagagttgtaagcccttaaaagggccaggaactctgtcttcagggagctcggttcttgagacatgagtctgccaaagctcccagctgttgagatgcgagtctgccaaagctcctggccgaataaagccaaatccttcctta

SEQ ID NO: 228892 - DNA, 407 bp, Homo sapiens
tcccctgggaatgtcatcttgttcctcctctctcttgcttacggacaggcagttgctgggtgcagggattttgccttccagggtccattccttcctggacccatttcatgccactgctggtctcagcctggatcccctcatcccagattctggccacggcctcctaactggtctcccggatttggcctttctcctctaatatagctttcactctgacaattgatagtctttcaagagcacaagctagaacagccagaagccttccgtggtttcccattccctagcaccagatacaatcctgtcttctttggtgcacagtttgtgaagcacaccaaatgtttgaccctggaggtgtccaagcaggagcagaacgagcactgagtgggacaggtgcccgcatgcagagg

SEQ ID NO: 228893 - DNA, 548 bp, Homo sapiens
ggttgatcattgtgtctgtttagtggaaaaattaataaaatgttttgtttataggataaaatacattaggagttcttattaatacttcctattcaaattcaggactatgagattattagtgaacctcgtgtactctgtttcacaccaagacttgtgatttttaagatcagtaaggatgacaggattagaatatcacttacttgttctctttattccacattaccccctagatctgtctcaaaacagtaatattaacatgaccaccaaaaatatgattagtactaacagttaacatctttttgtaatgcggtcctttttgtccttaagttgttctctagaggtgtgtgcaaattttgtattttaacaaaaatatattcttactggattattacgtaatctggcaatatgtattaagcttcttctaaaaagacctccatatccattaatccaggaattatacttctaaaactttaaagcaacaataaaaaaatctggacaaaactttattttcaacaaaaatttcctatttattagagggaaaaaataga

SEQ ID NO: 228894 - DNA, 444 bp, Homo sapiens
accgctcagctcaggacctgacagcgtcactcccaccctcaccaccacacacacaggatgggggactgctgctgctttccagcctgtgagcctggataggtattttgtgacccagctcctgctcagtcccatcgctgtccccggtctctccagggagtaagggattctccgtctgtggtaagttacctgtgactcttcagcagtttcctctgagcataattatatctgagagcacagggagctcctcattccatgtatttttcaaatattcaagatgtacaacgtgatgatttgctataggtattcattgtgaaatgtttgccacagtcaagcttgttgacatacccaccagctcacatttactgttttcgtgtgtgtggtgagaatactcacaatctactctctgagcaaactgcaaatatatgttattagtaactgtaaaat

SEQ ID NO: 228895 - DNA, 493 bp, Homo sapiens
ctcacatacagtgttagttgactttgccagccagccagtacccaggggacatcagcctatagtggattagtaacatgtaaatatccaaaaagtatttaattctgtaaacctaactttgtctcacacttactgtcttcatgacttttctgaagtcacttccagttttcaaaaatggtcagctacaagggaccacttgctttgttttacttaccccaacacattttgttcccaccaagatgtggattggattttctttcttaataacatttcatgtttgttaaaactgctattaacattattaacatttaaagttttaaactgctttaaatagctgctttgcatattttgaaccacaaataactctagtctggaggtggtttagaccacaaaatactatttgtgggtttaagctctgtatctttttaaatccattatatgtacagtgtaaacttgagtacctaataaaataaatgtcacaatgtttaaatagcat

SEQ ID NO: 228896 - DNA, 835 bp, Homo sapiens
gggaggccttccttcccggggacccagactcccaaagtggggagggcgtggctgcaggggaagtttggtgtctgccgtcttcttttgcacctgtacttttgcgcttggttggaaatcatcacgtaaactgtttacatcttgttcagccaggaaagctgtcctttgggagttctacttattcctttttttctggactcgaaaccggggccgtggtttcggaaatgggaggaaagatgggaaggatggacgcaggttttctgagcctctctacctagagcctgccaggataaacccaaattagaaccaacatgtccagtactctccgaacgtctgccacgtacatcgttctccttgttaacaccagtgtgtatccagtatcataaaggcaagtacacacttcggaatcagctacttgccctactaatctgtgaacctcagatttttgcctgcaatataagaggttttatgttcatgacaagttagggtaaacggaggtatgcagacttcgaaacattttggtcccagggagaaagaaacctgaacagtatccacgttaactgtttctctctgccatgctcattcagctcttaactcaaactcaagagaggccttccttgaccaccctagctatggtagtcctggtcattctctacccggctgtcctatatacttttcttcaaaacgcttatcactatttgagattttttttttctattttgtgtcctagaatagaaaataagcatcatgatgctggaatcttgtctattttgtacatggctgtataaagccgctaaaacaatgcctggcaaaaataaattgaatggaatgtatggtg

SEQ ID NO: 228897 - DNA, 663 bp, Homo sapiens
agacagaaaatgcacaagatacaccgccctttttgtttgtttgtgattcagggctcaggattgactgggtcctcgggaggggactcgagggcagaaggatctattaatcttacaactatgtgtttcattttccaagtggtcagttttttaggttactttatgaaaaactgaaatggaacacagaatatgaacaatttctcagggtaagagcagctagatgtaaaaataacataatgcaattaaagaagaaatcttccagcaaatagaaccccatttcggggattttcaccgtgggcgtgagggtcacacaagactgaagcccgcccaggagcaggcgaggtcactgcaggtggtcagttacagagctctgcgtcatagccctctggccccagacaaaattcactcatctatacatttgcttgaaaatgcattatttgatattcattttgtatacttaaatacaaaatgaaatgtaacctgatattgaaaataaaaactccaggcaacgtctacatttctatgtatttagtcttttcaaggtctacattttaaaagcaagaaatgaacaaagttaggaatacattattactctggcaggaaaattagacggattgatgaagtgggttctgtctattgttatttatcctactagaaattaaacta

SEQ ID NO: 228898 - DNA, 211 bp, Homo sapiens
actttttctcagaaaagccaagactgggtctggatcacaggccaaacatctctgggttccagagccagagcgggaagtccctttcctgcaagaagactaaagaaggtgctggtccaacccatgctgggtactcagaaagaagagaaaacaattgcagtttttatcagaagagaaggagcaggattctactcctggactcattccttgggca

SEQ ID NO: 228899 - DNA, 202 bp, Homo sapiens
gatgtaccattactatactctgggatcatcttcctgggttccgcatgttaacttcatgtaggtgtttacaaagcacttggcacatacctgtcacctcagctatcagttgttgaaagaataggacagacgtttgttatgctgcaaaggtgagagaactaaagcccagtgagtgctgatttgataacagcacggcagctacttg

SEQ ID NO: 228900 - DNA, 452 bp, Homo sapiens
tagttagattttgaccaactttagttggctaagattcacattaacctgtaatataaggcatagtctttttcacaccaagatagcagctcatcaggttattttagttggaaatatcttcattactttgaatatattaagttagttaaactaaaatgctattttgaatcacattttagtcatgtaaaaagtatctcctgtaatcccagcactttgggaggccgaggcaggtggatcacaaggtcaagagatcgagaccaccctggccaatatggtgaaaccccgtctctactaaaaatacaaaaattagctgggtgtggtggcacatgcctgtaatcccagctacttaggagcctgaggcaggagaattgcttgaaccccggaggcggaggttgcagtgagctgagatcgtgccactgcactccagcctggcaacagagcaagactcctctcaa

SEQ ID NO: 228901 - DNA, 627 bp, Homo sapiens
gcagaaattattaaggaaaaatgatgaataaatttgactatactaaattttaaattttgcatagcaaaagataccataaataaaaacataatatgcagatcagcagaaaacattttcaaacgtaactagcaatgaattaataaaatatcttatttaaaatttttattttaagttctggggtacatgttcagagtacgcagctttgttacataggtaaatgggtgccatggtgatttgctgcacctaccaacccctcatgtaggtattagggcaatacactttcaaggtagaatgctaacacattctttcataagcattaccaaggctgacatctaatgttagttctgatatatttattatacatggaaaactttaaaaatgttactccagtctgtcattgtatatcccacggtgttactcatcaaattttcatagctgctttaatgacaggaatggttaaaaaggattttgcagtagaagtttaaaattggaaaagtctggccaggtgcagtgcctcatgcgtgtaatctcagcactttgggaagccaaagtgggaggatcgtttgagcccaggagttcaagactagcctgggcaacatagcaagaccctgcgtctaaaaaaagaaa

SEQ ID NO: 228902 - DNA, 602 bp, Homo sapiens
gcagaaattattaaggaaaaatgatgaataaatttgactatactaaattttaaattttgcatagcaaaagataccataaataaaaacataatatgcagatcagcagaaaacattttcaaacgtaactagcaatgaattaataaaatatcttatttaaaataaaatagaaaagacaaagaaggatattacataatggcaaaggcttcaattcaacaagaagacctaactatcctaaatatatattcatccaacacaggagcacccagattcataagtaaagttcttagagacctacaaagtatgtttcacagtaatagtgggagactttcacactccaatgacagtattagatcattgaggcaaaaaaatgaacaaagatattcaggacctgaactcaacattggatcaaatggatctgatagacctttacagaactctgcactcaaaaacaacagaatatgcattcctcacatcatcatatgccacatactctaaaatcaaccacataattggacataaagcaatcctcagcaaatgcaaaacaactgaactcataccaaatacacactgagatcacagtgcagtaaaaatagaagacttag

SEQ ID NO: 228903 - DNA, 584 bp, Homo sapiens
gcagtggctcatgcctgtaatcccagcactttgggaggccaagggaggaggatcacaaggtcaggaaatcgagaccatcctggctaacacagtgaaaccccatctctactaaaaatacaaaaaattagccatgcatggtggcaggcgcctgtagtcccagctactagggaggctgaggcaggagaatggcgtgaacccgggaggcagagcttgcagtgagctaagaccatgccactgcactccaagcctgggcaacagagcgagactgtgtctcaacaacaacaataaaaaaattatttcactctttaaaaattgttagaaatgtggtatgcacctctcactgttagtgccccttcatctcctacagggctaatctgattctacaaatggaataaaagatagagtaagacttctttcaatgtttagagtggcccaaaaataacaaacacagcctatgagctaggaccatgagccaggaactttggggaacttacacacataaagcacatcaatggtcagtctatgtcttatgttaattatgaggactaaactctgatttttttttatcttgcccaaattcctat

SEQ ID NO: 228904 - DNA, 233 bp, Homo sapiens
acagagaaacaaagtgagtatgtgttattggaaaaatggtgctagtagacttcatcagtggccacaaaccttcaatttgtaataaccttcaatttgtaataaaaataaaaccccacacgttatctgcaaagcacaataaaatgaagtatgttacatgttgattttcaggaattagaagaaaatgagagtattgttgtcatcggaaataagaggattgttttgccaagctactg

SEQ ID NO: 228905 - DNA, 403 bp, Homo sapiens
tgtgtgtccgtgctcctgtcccacccccagttcatttctctgctcctcctgacttcctgttttctgcccctgaggctggtcacagcatcccgtgctgccttcattacttcactgtctgcctctacagcattctctttcttctgggcacagccttggtgcatgacttccttgacaatgggttagcctctaggttgacaatgcagacccagatggccttgacatacccttatggtataccctaaatatgatggtgcttacccaagagggatttgaagaccacttctatcaagattgcctcaagggagtgtgtttgtaaaatatctaagttgactgagtcaaaacccctgggaagcagagcccatgtaatctgcactttaacaagcattctacttgattatcatgt

SEQ ID NO: 228906 - DNA, 577 bp, Homo sapiens
tgttctgtcaatcactgagagaggggtgttgtttcagtatgtttttcattttttctttttagccagcagacatcaaggacttctgaggagcctggtaccttgcataggcactatggaccctgttttgcttaacccacccaacagccaattttagcagacatcctagttttgcaggtgagaagagctgaggtacgaagaagttttgttaatttttccagttcacgtaacaagtaaatgggaaaccaggatgaaaatcaaggtttatctgtcatcagactgttactcataatcaccattcggagagttcagatgtgggacaagattctaactccagccttctcccaaatggttaatttgccagttgccctagagttacatattgtcttatttgtttgttttactgaatctgtctgagtattaaaagccttgtatcttgtgaaatttctttcaggtctcataaaagcgatgaaagagaccaggataacattctaatatttaaataagatttttgaagtaaaatccttattttgtaaatttaacaattgaatcttgctagattaataacgcatctttcctg

SEQ ID NO: 228907 - DNA, 387 bp, Homo sapiens
cttataatgagtttatcaggacataaccccatcatcagtcaaggtgctcccatagtatggaatggctggaagtggggggtagttaaaaagagccatgtgggctgggcgcgatggctcacgcctatcatcccagcactttgggaggccgaggtgggcggatcatctgaggtcgggagttcgagaccaggctcaccaacatggagaaaccccgtctctactaaaaatacaaaaaaaaaaaaaaattagctgggcatggtggcacatgcctgtaattccagctacccagctacccagctacccggctgaggcagaagaactgcttgaacctgggaggcagaggctgcggtgagccaagatcgcgccattgcactccagcctgggcaacga

SEQ ID NO: 228908 - DNA, 207 bp, Homo sapiens
tctaatcatttaaacacatgaagtgaatgtgtgaatggacaattaagtgctggccaaatgtggaaaaatgttaagtgtaaatcaaaggcaactgaaacgttaaatacaccttccattcctccgccacatccatgctctttcccatactccacatctgctcactaaaattggaaataaactgtaatgaaccagaaatgtctgacttac

SEQ ID NO: 228909 - DNA, 450 bp, Homo sapiens
gaggctgagccacccatcggggatgagtggacttccctcagctgtggctggactcctaaccatctggaattgctgtaccagaggggccaagctgaggccaccgcctgcctctgacgggtacttggctgagggacatcttgtagggaccattgctgtgtccccctgtgctccttgctaatgaggggtgtgggaatccttggtgactcataaaggaccgtagaggagggctgatcacttcagccaggcccacattttgggatagcgcgttcggtttcttgactttccaagctgtgacaccgattcttggcactctacacttacttccagggatttgagaacgtgcctcatgagcgtgcgccccacacaggcctcctactgcaacttacaaacttggaccatctcccatgtgaacctttttcccagactgaagatcgttctgggaaaatgccc

SEQ ID NO: 228910 - DNA, 342 bp, Homo sapiens
agttggaaggggttacatcggattgctgttttcagctggggtttaggagagtgttttcttttggggaatactaagtagggttcaaggcccctgggaggaatggccacagcagaagcaagccctgtagttacaggcattcattcagtagatacacagggagtggcaagtgtgtaccagacactattctaatggacagaacacacccaagtctttttgcctttatgagtttatgttctagtgcaggggtgttcagtcttttagcttccctgggctacactggaagaagacgactgtcttaggccacacataaaatatagtaacactaacgatagctgatgagct

SEQ ID NO: 228911 - DNA, 451 bp, Homo sapiens
actgaaattactcagataatggcacaatttttatttttgtacatggagacatagttgcatttctctcatatgtctactgtcagtgagcatgagaaagaattcctgcctactttctctgaactcattatctttacccgagacctgctcccttttcctcttccttctcaggtatccaatggtaccaccatctacctactccaccaacttaaaagctagaactcatacttaactcttcagtttgcttcacctccaacattcatttggtcactaaatcttgccagctccacttctgactacctctttacctggtctttctgttcccagagcatccctcctttcctctgtgttccataatgccaccagagttctctttctaaaactcagatctgacttggatattctcttgcttggaaaatcttcctaagatttcttgtctcttctaagataaaat

SEQ ID NO: 228912 - DNA, 553 bp, Homo sapiens
agtgagacaggttgtaattttaaattaagcaatcaaaatagtattcagtgagatggtgacatgtgaagcaagacttaaaggaggtgagaactttagccatgtgaacacctgagggaagagcattcattccaggcagaagaaacagtcagaacaaaggccttcagatgggagcatgcctagaatttttgcaaaataacaagaaaattagtataaattagtcttcatgcctttaatcccagcactttgggagaccaaggcgggagggtcacttgagcccaagagtttgagaccagcctggtcaacatagggagactccatctctacaaaaaaatttttaaaaattcgccaggcatggtggtgcatgcctgtggtcctagccactcaggaggctgagatgggagtatcacttgagtccaggaggttgaggctgcagtaagccataatcacaccactgcattccagcctggacaacagagtgagaccctgtctaaaaaaataataataaatatatatataccttataatgaatgagcaaaaggaaagcgctaagaga

SEQ ID NO: 228913 - DNA, 341 bp, Homo sapiens
cactcaaggcccaccatagcccagagtgtgtctcacccagccgatggtctttctttccatatacactgtattctaggcaacttgtactgtagatgagtgctatgattaagtccagcctgaaagacctgggcatgaatcacccacctgccctttactgaatttggaagagttgcttagattccctcatcttccatgtcagtctctgtaaaattgtgataaaaatggatcccagccagagggattactgtgagcagtgatgaaggtgaagtgtgccaggctcctggcatagagcttggtacatggaataggtgctcagtaaaagctcctaatactgaccgtct

SEQ ID NO: 228914 - DNA, 428 bp, Homo sapiens
cctgtaggcaccaacctttttcaggttcactttgaggaatattataactatatttcatcccattattaagacttgaaaaattttacttgcagagaatgcaactaagttatatatcttgcaatgtaagatcacaagctacatttgcacctgaaaaaaacaagctcctctgctacttgtccatttgttttgaaatttgtgaccactcaggagcaggtaggaaagtttaaaaataaaaaaagtcacagtaaaaacaaaaatacataatagacaagattccattaccttatttttttctcaattttagaagcagttcaacttttggtcagctcacaggggcataatttgagaacctttggtctaatccaaccctctcattttacagatgaagaatcataaagaccttgatttaaatccgttttcatctctgg

SEQ ID NO: 228915 - DNA, 574 bp, Homo sapiens
gtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaac

SEQ ID NO: 228916 - DNA, 622 bp, Homo sapiens
ctccatcctgttgcaggtggcaggctggaattccaagccagtgggtcttatcttgtgaggtgctatggaagtggggccctcagaataacgctgcgcacctcactggattctgcctctttactatgggtatgtgcagacttcccactttgcttgagttgcagacatgtttttttgggatcccaggggctgaatgtgtaaagctcttggttccctgttcatgactgagcagctgatctgccaagactccacacagctttgtgtgtcgagcccttgtggtgtgggctcacaaggggatctcctgatccataggttgaaaagatccatgggagaagcctggtttcatagggtcataccacttcccttggctgagggtggggattctcttggcttcatgttgcttccaggtgggccattgcctcacttgcttttctttgtttccttgggtcaagttgttttcctaatcagttccaatgtgagaaactggatatttcagttgaaggtgctgtattcattcaccccttttgtttctctctgtgagtgccgtggatcacagctgcttctaataggccatcttggccccttataatttcaatctttaaaaattgtttgagacttgtggctt

SEQ ID NO: 228917 - DNA, 510 bp, Homo sapiens
gtaaggaaaccatggcacagagagggttagcaacatgtcccaaatcacatagaaaggcctccctctctgcacaccgagagaccaaatatacaaacggacaatggccaaaccgtatatgataatagaactctttcctacaacctccatcatgatcagccctggaaaccaaaccaccacctctgcagcaattggcccagaaggatcaggacttggtcaatgattgccagtgactgccagtttccttgtgtccccctgacaccctccccaccagtacaaccgccacatccaactcaggaccaatcaatcacgtaggatgtccagcttctagttagctgcctccagcacccccatgccagcagcctccggtgagggcacacctgaagccttccctttttctcactgcaaatctttctcactctgcctgactttgagtctttgccgaatatatgtagtggtggccaactcccttgctatggctctgaataaaaagcctctgtgtggtcttaaatg

SEQ ID NO: 228918 - DNA, 357 bp, Homo sapiens
attttatattaccttgtgatttcatatttaaaagtctcttattttcattgttttctgaactcagaaatcttggggttggtcttcaagacacaaagttgcatggtctcactgtgctgcagtcctgcaaaagagtgacatgacatgggacaactgaaactgtcatatattgcttttgaaaacgtaaaacgctacaagtactttggaaaatggcttagcagtttgttataaaattaagcatacacctgctctagaacccagcaattccactcttgtttgcccaagagaaatgaaaatctatgtctgtaaaaagacttgtggaagaatgctgctttattcttctccagtgtccccgaagtg

SEQ ID NO: 228919 - DNA, 378 bp, Homo sapiens
tatatttctttcgttgaatgaactcagaaaatgaagtgactgaatggattctgagctaaaaacatctccagatggtttagatttgtttttaaaggaatctcgcttttttaatgtaatgtatagatattataattaaaggaagtcatatcatctagagaaggcagatgtttttggtacagtctccatttagtatctggtccttagctttggtgaggccattcatgctaagtcaattcaaaagatagtggtttataaaaaatacaatgctgatttaaaaaaatagtgaaacaaatacgtaactgagcaggcaggctgttcatgcttgttgatctctatgggaaaactttacaagagttgaaatataagcaggaggtattt

SEQ ID NO: 228920 - DNA, 499 bp, Homo sapiens
aggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagc

SEQ ID NO: 228921 - DNA, 430 bp, Homo sapiens
agttgcctcccaccgagaacggccagaagaaccaagcggatcgccaggaccgtgcgcagagcctgcacgtagcgaacgctgtgattcccttcttcccctcccacggcaagcgacaccgaaggtctggggacacccttagggttgtgactgaggatggttgtcgagtgactacagagcccagtaaataacgcgcatctcctcggccgggcccgcagcccagccccctggctcccggcttcccgcttcgacaagggcatgccgcggccccccggagctcggggcgcgggagctggcaccggaagcggggagggccggcggagctgggcggccaggagtcgggtacttacccccggcgggcggcgggcggctgaggtcgcggccagccggctccaggcggcggcaaagtcgggcggcggggcgcgcgggctcc

SEQ ID NO: 228922 - DNA, 417 bp, Homo sapiens
tgagacgagtcttgctctgttgcccaggctggagtgcggtggtgcgacctcggctcactgcaagcttcgcctcccaggttcacgtcattctcctgcctcagcctcccgagtagctgggactacaggcgcctgccaccacgcccggccaatttttttgtatctttagtagagacggggtttcactgtgttagccaggatggtcttgatttcctgacctcgtgatccacccgccccggcctcccaaagtgctgggattacaggcgtgagccaccacgcccagccaaggagagctggtattttaagagataactggcttcaggttttacaaaaataatgagaaaccgattcacagatcccagaaggaaaacacatcccaagcagaataaacagaaattcacacctgcatgcatcataatt

SEQ ID NO: 228923 - DNA, 662 bp, Homo sapiens
aagggatttttctctagtattccctgtgaggacctgatcgagctccagaaagtataagtcacaaaagtgcaggaacccctcacccgccaatgactgagactccctgcagtttttaactctcagacttggccaccctgagcctccagcagttaatcagttccaggacagtgttttctgtcctcgccttggttcctgcaaaggtttctgctccatatgttgtgatcgcttctctatttatctgtctgtctgtccaatttggcagcagttgtttgccttgtgactttacgtaggatctaagaagagttgttaattgttctttttagattttttacttgtcagaccagagtgataacttgcaggcttctcacatgcagaacctgaagttgcagcatttttttgtaatgcatatatcttatttggtgttgtgcctgtttgtgcattttcttattgggttgttttattactcacttttgatagttatttatatgttttggatataagtccagatacgcaatgtactttgttctcccaagagtatttttgaaaagcagtttaaaatttcttgtgtaatcaagtttatcatttttttcttttatggctcttccttttggtttatattcctcctataagtttaattgctttagattttacatttctaggtc

SEQ ID NO: 228924 - DNA, 464 bp, Homo sapiens
catcatactgagagactggacgtgatcatgcagatttgaggtaaaaccttcacctacccaaaaaggaagtcaacagttcacagcaaagggaggggtgaaagatgaaagagggcgtgcggaggtcagcgagggaaggcgaggaaaagctgagctgaaagccgcaccctctggggaagggtcaggaagacagagagataagggactgctggcttttgttttaaactgttcactcggactttgtctttgcctaattatataataaaagtaactcacttaataacctgtgtatgacactagaatggctttaattttaaaagggaaaaacgacgagtctgggtgaggatgtggagaaatcagaacatcgtacgttgctggtgggactgtaaaatgatgccgctgctgtgaaacacagtctggcagatcctcaaaaagttaaacacagaactaccatactctccagcaag

SEQ ID NO: 228925 - DNA, 441 bp, Homo sapiens
cagcatgggaaaaagaggaagaccagaagactcagcaagtcacatgtaggatgtagggaaaggtatcaacatcatccttggcagagagaaggtcagagatcacccacctgttgtgcccatggagtgtctcaggagaactcaggccgaaggaagcccctccatccaaagacttggacttctcaactggaggttgcaggttctgccacagcaggagagacagcagaagcaaaaaacgaacaatgaatcccaagcccctgctgctgtgtagatggggttcaagagtcctgccctaccagacattagagaacacaggaagagcctggtgcctggaggggagagggtgtggctgccctgacgacgggaaggaggggccctctctgtgttttgagtgtagcccacatgacctgttttctgctttaaaataaaacattaaaagtccca

SEQ ID NO: 228926 - DNA, 508 bp, Homo sapiens
aaatgtaaggatcagtcatttctgatttgtatttttataaaccagttcttacgtgtaaaatattttcataaagtcacagtaagatgtttttatgaggctttggaggcttttttgcataagttaaaatagaaattttgagttcttgacccaggatcactatttatacatgaattaatgctgcttttttttttttaatgaagtcatctgtatccaaataacttatgataaaaattgattctgggctggccagatgctgtggctcatgcctgtaatcctagcactttgggatgcctaggtgagtggattgccggagctcaggagtacaagatcagcctggcaacatggaaaaaccccatctgtaccgaaaaatacaagaaaaaaaagtgttagcattatatggctcatgcctataatcctaacactttgggaggctgaagcaggtggatcacttgaggccaggagtttgggaccagcctgggctacatagcaagactctctctctaaaaga

SEQ ID NO: 228927 - DNA, 459 bp, Homo sapiens
gtgtcagactgaaggcaggtgggacagggaaggagagagcaggtctggtcccaggcaagcaggggagtgttcggagcagggggaaggagtggcaggggaaatgagaacagacccttgttcatgtttttgccatctttatcagcctggaggccgttactgtgacgaatgaactcccacaattttcagttttttcttcagtatattattaagtaaattccaaataattgtagattgtatcatgtatcttccccttggctagtggtggccagagcccctttagcagctgctccacccattttttttttattatcaccctttaagaagcctttttagacatttttatcctaattgtccttccccatgtagttttatttacacagatatactgtagatatctatttaataactatgtatatttgtgctttatacataaaaaataaaccttactctttttattca

SEQ ID NO: 228928 - DNA, 340 bp, Homo sapiens
gcagaaattgacaggctgattaaaattcttatggaaatgcaaaagacccagaatggccaaaacaatcgtgaaaagagagaatgatgttgaaattatgctttctgatttcaaaatttactacaaagctacattaattgaggcagtgtggaattggcataagaacatatgaagtaattattaatatcaccatgccacacatctttaaaacaactggaacttactgacacatttaaatacaaacaatgctcaaattcaagcaacccaggactttacttgaatatgagcttggggaagaagccaccttattgcttctgtttataagctgggctctttcttgcct

SEQ ID NO: 228929 - DNA, 316 bp, Homo sapiens
ggctgctctagatggatcccgggaggccacgaactccactcccacaaaatcacagaatttcaaaccagaaagggatcttaagccagatccaactcatctttcagacacagaaacggaggcctgggaggagcgactgtcttgctcaaggtcacaaaggctgctgctgggggcagaactggcttccaaacctggactcctgacagctagccaagggcatgctccacagcaatgacgggctagctggctctgggaaaccctccagctgggaggtgaggctgatgcatgtgcctgataattgaaacaggaggtgggggct

SEQ ID NO: 228930 - DNA, 467 bp, Homo sapiens
ggctgtaccacttttcttgtcctccagtggacccagtcagccttgaggaagggccctgcgactctgtcaagcccactacgcagggcacggtggtgcacacccagtgcccggatcacgctgtggtgcgcaggactatccactatgacagcagcccattgttttggtggtggtcgttcatgtgttcttgcggtctcttttgaacttaaaggggggggttcttatttctagcaaaacatgtctggttattcgtcccctttaatacaaacttaaataggctttcatttctttcttctacagtataagacatgtcattctttcatgacttggttcccatttgttatgaaaattttcctctcaagtgttttcctcaagtgagaggttgaaaatttggaagtctggagtctggtcctcagttctaatctggtaagattagcagtgatatttaaactctgtctgcgtttgtgcac

SEQ ID NO: 228931 - DNA, 492 bp, Homo sapiens
aaaaaaattcaagtgacagtataatgtatatagtataattccacttatattaagttccaaatagtcaaaatagtcaaaatatatttagggacaaatacctaagtgggaaaactataaggcaggagaatgaatatcactaatatcactgattgctaattatttaagaattaatattactaaccactaatgaacatcaaaaatgtagatagctgtgggttgggaagatataatcagggaggataatacaggggatttttaagctctcagtaatgttctatttttttaacctttttggtttataattatactgtaaaatgtacatatacattttatatgttcttatgtgtgcttaacaatataaaagtaaaatgtttaaaaagaaagctcccatgacatacagttaactgaaaaaaagcacgttacaaaacatgaacatgtactatgatgccattgtgaaaaaaaattaaacattggtctatctaacattttaaa

SEQ ID NO: 228932 - DNA, 278 bp, Homo sapiens
gtgcttgtgttcaaggaacctttattttacttaatactttattaataatagttattaatctctcaccacgcctaatttgtaagttaaactttatcatggtatgtatgtaatgtatatgtagggtttagtactatctgtgattcaggcatctactgggggtcttggaatggatccaaagtggggaccgttgtactcaacttaggaaactcatctgtagtttttagtcaattgcttctacttctgggtaggaaaaaactctggaatattttatgagtttg

SEQ ID NO: 228933 - DNA, 668 bp, Homo sapiens
ggagggagagaggaaagccaaagggctgaatgttacgtttattgaaactagggcaaaagctggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggagatgatctattagcttgacaagcacaaaaaaagtcagcgtcttcattatttatattttacaaaaagccaaactatttcagcgtattccagtgataactttaaaaattagatacattttcttaacattttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagat

SEQ ID NO: 228934 - DNA, 722 bp, Homo sapiens
cacatcaatttttaaaatatgttatttctgtcagtgtttaatacaaaaactcacccattctcactgtatgtataaggtacaccactgatgtcctagtacaaagtagcactgatatctcaggtgagtgttccgaaaataatgtctaaggaaccacaggctacttgtttttgacttatgagtcaaggcttcattcagaacttttttttttttttttttttttttgagacggagtcttcctctgtcaccaggctacagtgcagtggcatgatctcggcccactgcaacctctgcctcccaggttcaagcgattctcctgactcagtctcccaagtaactgggactacaggcacgtgctaccacgcccagctaatttttgtatttttagtagagacggggtttcaccatgttggccaggatggtctcgatctcttgacctcatgatccacccacttcggcctcccaaagtgctgggattacaggcgtgagccaccacacccagccagaacatttttactagaaactctgtccctgttttcaaatagattctgttttgagagtggacatccctgtcctttatatgcaaatgccctcaacacctgaaccatcaaacataaaggagcagatagcaattaaagcttgaaaaaggagtgtatctcagctgttagctcatctagttaaagaatgaaaacatcaatcaaattaattacaaagtatcacatggt

SEQ ID NO: 228935 - DNA, 796 bp, Homo sapiens
agcaatacaagcttgccagtttttgccccaacagataatccaatgaaggctgtgaaccaaaattttggctaaagcagtctccatggcagtttgatttttaaaggccaaacctcccacgacttcaaagcagggtgtcacatgttaaccaggccccctgcttagagctgcagcacaaaagcctggatacatgcaactctattccactttccaattcaacagtaaacttcagattccaaacaatgttggggccaaacagcattgcaactgcggagagaaaattctaaggagggctagacctcagaacctctgccaagagcatcctctttggagtggctggggtccgcaggacccacagagcatcctcctgtggggtccaatcttagggtcccagacgtctctggctttaggtgggcatcacatgcaggctttcccctctggagcatactatgaactttataagagtagccatgaactgtaatgtgaactggatgctgcgtgggctttttttgtccttagctagttgagcactataagggaagaatttagcataagaaagtaaggtttaagcccccagaaacatttatgagtttgctccgagcagcaccgcatgtagggatcaggaaccataggcaaaaaagatttttaaaaaaagtccctcccgctttggggcagcgcaattattccctttcattcgtagaccttcaggcagtactggtgaccccagcctcaatttccaaggagctactaggaaacagccgctgaaagactgaaatagaaagagacaaaaaaagagaaa

SEQ ID NO: 228936 - DNA, 742 bp, Homo sapiens
agcaatacaagcttgccagtttttgccccaacagataatccaatgaaggctgtgaaccaaaattttggctaaagcagtctccatggcagtttgatttttaaaggccaaacctcccacgacttcaaagcagggtgtcacatgttaaccaggccccctgcttagagctgcagcacaaaagcctggatacatgcaactctattccactttccaattcaacagtaaacttcagattccaaacaatgttggggccaaacagcattgcaactgcggagagaatggctggggtccgcaggacccacagagcatcctcctgtggggtccaatcttagggtcccagacgtctctggctttaggtgggcatcacatgcaggctttcccctctggagcatactatgaactttataagagtagccatgaactgtaatgtgaactggatgctgcgtgggctttttttgtccttagctagttgagcactataagggaagaatttagcataagaaagtaaggtttaagcccccagaaacatttatgagtttgctccgagcagcaccgcatgtagggatcaggaaccataggcaaaaaagatttttaaaaaaagtccctcccgctttggggcagcgcaattattccctttcattcgtagaccttcaggcagtactggtgaccccagcctcaatttccaaggagctactaggaaacagccgctgaaagactgaaatagaaagagacaaaaaaagagaaa

SEQ ID NO: 228937 - DNA, 361 bp, Homo sapiens
ggtcggcttgagtcccctgacccctactctcaggctgtcccggagcttttaaagactgaaatccatcatcattacagtacgtcgttgccaaacccgagcaagccacacagaaatactgaccactgagccccgctgcaacccacaaatatccggggacacagcgaggctgcctcattaacttttatctcaattttaaagaaactggcatcctacacaacccgagttcaaagttgtcatggggatactgcaacttacaacacatcacaaaggtttattcttctccgccctaaaagccactattgactacggtaatcagtaaaatgctcaggtcttcaaggacactgaagttaaacaaggtatt

SEQ ID NO: 228938 - DNA, 403 bp, Homo sapiens
aaaaaacaaaaaacaaaaacgaggccccagggagctgcctcatcctcttgaaccaagtgaggacacagcaagaagaccccaaggaaacagggtctcaccagacacccaatctcctagcaccttgatcctggatttcccagcctccagaaccgtaagaaataaatttatgttatttataagctacctagtttataatgttttgttacggcagcccaaatgctctaaacgagataatgttataagttttgttgaggtgatcttagaggaattgatacaaatctagaattattttgtgaatagttttcttgaaactgacttattgccgtgtttaaaaagagaaagagaaatttcggctgatgtgttaatagtatcgttttaaaaatggaaacattgctcattttca

SEQ ID NO: 228939 - DNA, 396 bp, Homo sapiens
ttaaaaccctatcacccatggcctctgagatgctaaatgttcctatttctctggcagcctctttccttcttagttcttcttcctaatcctacctgaaactggctattatccggatgtcccttcttaagcctctgtcttttctctcttctccagaaagaatgcagatcttatctactctccctcttttgactttttcttcctttttgagatagggtctctctctgtcccctaggctggagtgcaatggcgctttcacacctcactgcagcctcaaactcttgggctcaagtgatcctctcacctcaacttcccaaagtgctgggattataggtgtgagccaccatggctggcctcaacttttttttatgatttatttattttttattagggtaaaaa

SEQ ID NO: 228940 - DNA, 250 bp, Homo sapiens
cttcaagttcttggaattgttaagcaccatgtgaccatcaccatgtgtcagaccagtgaggaggtcaggagagagaagcgtcctcgtggcttgccctcaggagctcacaaggctctgctggttacaaggcctggcccctctccacgagatgtgctttgggatccacaaggagagtgcttacccagaacaagtgacagacaaggccaactcagggacaggacagtcaccatgtgtgtcccatggcatccca

SEQ ID NO: 228941 - DNA, 749 bp, Homo sapiens
gaagggcgaactgtgtatgtgtgcagttgagcttcacatcccatcataggtcccatgtataaaaaaatggcagtgttagcatgatccaagggtggaggttttggccctctgacatcaaaaggtgaagcagaggacacaaaaacccacatctttcggagactggccagaaccactccctgttctgtggtctcatcaggaaggaatgctggttgaccatttcaaagtggccaaagagaggggcagcagtcaggcagttgggttggatgacagcagcagtagtcttttgaaagggctggttgctgtttagcccttagggaagaacgcctacaggcagttagtgagcaagggttttgagaaggcatctgacctcccatcctgacgtggccaagaactcagttttcaaggtcactctggggtccccttggttcaggtggctggggagcttagaattttatttttagtctatagtagacttttgccgatacatttaaacttggggttaccatgaaagaattttcaacgactttctaaatgagtctttttagatgtccttaggtctctaatcttcagtcattctgtaaagaccttgagttagttgccaacatttcaaaaatagacttctcatgaaaaatctcgatttctagcttttcttggaaaaaactagaagacgtggtaacattaggccatgtaatattaccacgatttctacatgggaacaattaaatagtggctgcctcagttagaggagt

SEQ ID NO: 228942 - DNA, 508 bp, Homo sapiens
ttttatggttaaatccttgttgaaaaatgacacttgatcattaggcctttggatataattttattttctcccagtaatgagcagtcccactgtctttaacggacacctaaagagtgcagagcaaggagatggagcgctggacgccttcaaataccgggacaaccaggatccagagcagcgagggacccacagtgctccctcagaggcctctggaccccacgcccacacgtccctgtgaccacccacaccctcccccgactggcttctccatgctgctgtctccgggacatgagtcgcctgtctgtcccccacgtgtggccaggagggcatgagccacctgtctgtcccctacgtgtgcccaggagggcacgagccgcctgtctgtctgccatgtgtgcccaggagatacggtgcttttcctgccatgtcctcagagctgtgcatgtggcacacaggaagcagttgtcacaaataaacaggaatttggcctgtgtatgttagtcctgag

SEQ ID NO: 228943 - DNA, 274 bp, Homo sapiens
cggcaaccccagcttccggcttggctacagcctaagacaccctgagccagaaccatccagctaagcccctcgcagattccccacccacgaaaatgctgagatgacacgatttctttagctgtgtagctgggctggaaggctgcggttggctgaaggccgactcctgtgattgacggaaaggaaacagccattgaaagaggaggagcaagaaaattggcactagttgcctacttaaagctaaaaattagaaaaataaattaataagaactttcaa

SEQ ID NO: 228944 - DNA, 478 bp, Homo sapiens
cggggctaaagaaacctcattccctagagtttctctaagattttaaccactctacttaggtctatgggccttggataatgcctaacaaatgatgggtgtccaacaaatgtttgttttccttctctgaagggcaaattaggatctagaatggggaagagacttattccaggtctcacagaaagtaagtggtggactggccgggtgcggtaactcactccggtaatctcagcactttgggaggccaaggtgggaggatcacttgaggcccaggagttcaagatcagcctggccaacatggtgaaaccccgtctctactaaaaatacaaaaagtagccaggtatggtggcacacacctgtagtcccagctactcgggaggctgaggcaggagagtcgcttgagctcgggaggcggagattgcagggagtcaagatcctgccattgcgctccagcctgggcgacaaagcaagactctgtctc

SEQ ID NO: 228945 - DNA, 184 bp, Homo sapiens
actataaacatgtttgaatatgtatcctgactaaagcttgtaattaggagtggctggaattgctagtgacagagcatatgaacaatcaactgtttgagacaatgccaaattattttccaaaatggttataccaatttacactcccaccagcaacgtacgtggttttttttttttttttttttag

SEQ ID NO: 228946 - DNA, 1340 bp, Homo sapiens
cagaatagagacctatacagatatcctcagtaaatttttaaattgagatataacttacatacctgtaaaattcagtggttttttattatattcacaaagttgtataacattcaccatcatttaattccagaacatgatcatcacttaaaaaataaatgctggcctggtgcggtggctcacgcctgtaatcccagcactttgggaggcctagtgggtggatcacctgaggtcaggcattcgaaaccagcctgaccaacatggtgaaaccccgtctctactaaatatacaaaaaaaaaaaaaaaaaaaaaaaaaaattagccgggtgtggtggtacatgccagtaatcccagctacttgggagggtgaggcagagaatcccttgaacctgtgcagtggaggttgcagtgagccaagatcgcgccattgcactccagcctgggaaacaagagcaaaactctgtctcaaataaataaataaaataaaaataaaataaaataaaataaaatgctgtattcattggccattgcccaactgatttttgataaagatgcagaagcaattcagtgcaggaaggatagccttttaaataaatggtgctggagcaactggacagctataagacaaaaaaaaaaaaaggaaaaaaggaaaaatctgacctaaacttcacaccttataaaaaaattaactgagagtggatcatggacttaaatgtaaaacataaaactaaaaaaaattttagaaaataacaggagaaaatgtttaggatatagagctaggcaaagagttctgagacttgacaccaaaagtatgatctagaaaaggaaaaattggtaagttggacttcataagaactaaaacattttggtctgctaaagaccatgttaaaaggctgaaaaggcaaactacagactgggagaaaatatttttgaaccacatatccaataaagactactgtctagaatatataaataactccaaactcagtattaaaaaaccccaagtaatccaattagaaaacagcaaaagatgttaaggaacatttcactgaagaggatatacagatggcatgtaaccccatgaagagatgttcaacatcattagccgttagggaactgcaaattaaaaccacagtgagatatctcaaaatagagtttaatttttaaaaagcctgggtgcactggcacacacctgtaatcctagtactttgcgaggttgaggtgggaggatcacctgagcctggaaagtcgaggctgcagtgagctgtagtcctgccactgcacaccagcctgggcaacgggaatgagactgtgtcttaaaacaaattgttttaaaggaaaaaa

SEQ ID NO: 228947 - DNA, 1238 bp, Homo sapiens
aagcaaaggcactggtataataaagtaggcaatgaagagataagtttgcaatatttaaagcaaaataatattaataatatattttaaagcactttcagatttttccagatcttttcatacatttttatggagtctaataataatcagaagtagtcccctttatggacttcatttttaaagagtgataattgtccctaattttttgtaatacatgttgaatggagaagtactcaaaattttcattcattgttttgaaactattatattttctgatcagtcaactctaaatgttacttagtatatcgtcttccaatacttctcctaaacaataagtctagatggatttctgggcgtagattgtaacagtgatttataatccaggattttacacatgcttttggagttaaactagaagctttagtatgcagcagactctaatggctttgcagcattcctgggagatttctgcaaaagaggtggagggctaaattgaaccagcaatatatcaagagcactttccttttgatcagcatactcatagcaggatttgttttaattagagatatatttaggtttgatgattattacatgtgtttcagaagtgcattacaacttcggtggctcaacaattactagcagtttgtgtcagaattccttcatttggggaaaaatatttttaatgtggttatgcacaaacatttatggtttgtactaatttaagctatcattatcaacgaaaatacattcctgatgtttattgttttgctcttacaatttcttgctttttaaaattataattgatatgagaatggccatgggtaaaatcagaatgttcactatattatgttaatagtaaaactctatgtgtgtacctatggtttaatatgtaatgatatatagagtatacatgtgctttgggtcaaatggggatggttactattatctataaactgataatagtttgggggcatgaggaattaacaattttggagtatttaaatgattcaaaagagttgaaaaaataaagacactgctattttatcaattagaagctcttaccccttggatgtagactgtttcagggaagaatggggtcttgaaaaacacaaaatatacataaattttgcttccccaaccgactggttagctttcaagaatgagaagtatgttagcagtcccacacgggtcaagaaaatagatcaactgagctgtggcgtggggaattcatggttagtttt

SEQ ID NO: 228948 - DNA, 306 bp, Homo sapiens
tggtctcttgtccattttctatgctacagacaggctccgtgagggcaaaaacttcgtgtggtccacgccgaacagtgcctagaactatgcctttatctccaggggctcagtgagtatttactgaataaatatgaacgccttagtagcatatctcataagccagtttgacactagagctgggacttaccaaaaaggccagccttcatcagaactccaagggcacaaaggaattctcaaaatgtactccacagattacctgagactcaggtagacgcgcccgcgaatttagtagtagtaggcggccgc

SEQ ID NO: 228949 - DNA, 390 bp, Homo sapiens
caccgttccacatgcctgtcctttgcttggtgggtactgaactgacctgctcctgtgtggacattctttgggcctgagttgccccttctgcccacgtataggagatgtgtcagggtggcgggagaaattataaggaaagacgcaaaccttcttagaaggtcaggacgttttgcaaaacttcggaagggcaaagggtagataacaagggaatgtaaaggaatttatttggatgaatttgtttacttatgtctccagatatcaacctttgatcatttgcacacaggactgctctctactcggggggtcgacaatgttaattacccacaaattgtgtttgctccaagcctttgtcattaaatctgtactaaataaatacaaacatctctggct

SEQ ID NO: 228950 - DNA, 773 bp, Homo sapiens
tttgtgcgttgttggccaggtgggccacagggtggaaagccaattcgaaaaaaaaaaaaaaaaataaaaaaataaaaaaaaagaaaagaaaagatttttgttttaggaagctcatattttaagaaactaaaatatattctcatggttgaggacataagacattgttatagaaactaggtcaacttctcaatacctttatcaaagcacctgcagttcccatttcattgcaagtgaagtaaatctcattgaaataaagtagctggtgtatattcagtacacttttaaaatagcctattttaaaagagaaattggtgccaatctgatttatttcctgctttgttggaatgggggaagttctgtaacctcattgctgttctgctctctattgactactttgttaactggggcacagttggcctcttggatgtctaccgtgctgaaggtcagccaaataggcaggtaagactacctaggcctcttcataggcctaactaagatcacagttggaaaaaaaaaagtatagaaaaagaaaagaaagttgttttttttttctaaaatttaactttttgtattcaataaagaaggaagtaaaacatctccattcaaaagaaatttgagagtctgtttatgccatacactgaagtacaacaataaacaaaatagacctactgtttgttctcaaagagcttacattctagttgtgagagacaaataataagcgagtaaatatgtagtatgtcagagtgtggtaatattattgagaaaaaagtaaa

SEQ ID NO: 228951 - DNA, 463 bp, Homo sapiens
ctgtagtcccagctcctcaggaggctgaggcagaagaatcccttgaacccaggaggcagaggttgcaatgagccgaaatcgcgccactgcactctagcctggcgagagagtgagactccatctcaaaaaaaataaaaaaataaaaaaaaagaaaagaaaagatttttgttttaggaagctcatattttaagaaactaaaatatattctcatggttgaggacataagacattgttatagaaactaggtcaacttctcaatacctttatcaaagcacctgcagttcccatttcattgcaagtgaagtaaatctcattgaaataaagtagctggtgtatattcagtacacttttaaaatagcctattttaaaagagaaattggtgccaatctgatttatttcctgctttgttggaatgggggaagttctgtaacctcattgcaacacattgcaacacggtctctca

SEQ ID NO: 228952 - DNA, 841 bp, Homo sapiens
ctgtagtcccagctcctcaggaggctgaggcagaagaatcccttgaacccaggaggcagaggttgcaatgagccgaaatcgcgccactgcactctagcctggcgagagagtgagactccatctcaaaaaaaataaaaaaataaaaaaaaagaaaagaaaagatttttgttttaggaagctcatattttaagaaactaaaatatattctcatggttgaggacataagacattgttatagaaactaggtcaacttctcaatacctttatcaaagcacctgcagttcccatttcattgcaagtgaagtaaatctcattgaaataaagtagctggtgtatattcagtacacttttaaaatagcctattttaaaagagaaattggtgccaatctgatttatttcctgctttgttggaatgggggaagttctgtaacctcattgctgttctgctctctattgactactttgttaactggggcacagttggcctcttggatgtctaccgtgctgaaggtcagccaaataggcaggtaagactacctaggcctcttcataggcctaactaagatcacagttggaaaaaaaaaagtatagaaaaagaaaagaaagttgttttttttttctaaaatttaactttttgtattcaataaagaaggaagtaaaacatctccattcaaaagaaatttgagagtctgtttatgccatacactgaagtacaacaataaacaaaatagacctactgtttgttctcaaagagcttacattctagttgtgagagacaaataataagcgagtaaatatgtagtatgtcagagtgtggtaatattattgagaaaaaagtaaa

SEQ ID NO: 228953 - DNA, 381 bp, Homo sapiens
tgcgtgtttggctgtgggcatggggaatgcagtgactacacctggttggcatcccataccacacccaggggaatggggaagccaagaggtggactggaagcaggctcaggcctctctctccttgcccccaagggcatcctctccagcaggtggccactacaatgctgatgtcaaactggtcagtgggttcagtggaaggtttggctaccgcgggaacaccccagctctccgtcagagcacgtctgtctttggagaggtcacccacttccctctgttctaacagcatctcttcccttcatagccctcaacctgaatttctaagacagatgtttaggtgaactctcaatgttattttacattaaaaaaatttgtgtctccaag

SEQ ID NO: 228954 - DNA, 584 bp, Homo sapiens
aagtaatggagataaacccagaaaggtggacttggagtaatcatggggacccttgagctttatttggcaagtaaaggctaaacttactgaaggtttatatgcaggaagtttgcatgatcattgctgagctttataaataatttagtagaagtatataaaattaaataaaatatataaatactaacaatggggagtaaaattaggaagaccattttcataaccttctcaaacatgtgaaaaaagaaaaaatgtgccactccacacactggagtgaaatgaatggaatgaacagcagtagagaaaagacattctgagtgtccaaatcttagtgtctgagacatagtattatcattagaaatgggcaacacagaagatgattggatttgcttaggtttttaaaggaggatgatgaaattttgctggaaactgagaattggagttgacagcatgctatacacatgacacttccctagcggcatttggaaatgcctagagaagttaaagcttgaaatagagatttgtgtggtggcttcgcaggtgtggtggctgtaaccctggaggagatccccttgagaaagaacagg

SEQ ID NO: 228955 - DNA, 480 bp, Homo sapiens
ttaaggctgtatttctggattttcctttgcaatgggcttccatgttagatcttcactacatccaatttcagaaaaaaaaaaaagttttgagaaaagttctccatgtgagagcacttctgtgctgtttttgaaacttccttctcatttttctggtatcttccagcaggcaatggggaaacctgcttaagctcacccctctttcactttgagctttatggtgacacttttctggcacatatgtcagcagagcccactttttagctgagttgaaaggaacatgggaagcactgcttcatttctgcctggaaaagccagggacacgatgaaatgtgattttgtttcctgaaacgtggaaggatggttggcgaaaaatgaaacatagcacagccatcgctcttcactaagggccaactccttgagaaatgtgctactttaactctcagtagtttctggacaaggcctaaaatcaatcataatcct

SEQ ID NO: 228956 - DNA, 370 bp, Homo sapiens
ttatgtggtcatcccataaattgcatgttccatgtacaagatttttgcaattccagttgggagaactacactcagaactaagttttgggctgggtgcagtggctcatgcctataatcctagcacttcgggaggctgaggtgggaagatcacttgaggtcaggagtttgaaaccagcctggccaacatggtgaaaccccacctctactaaaaatacaaaaaaattagctgtgcatagtggagggcacctgtaatcccaactacttgggaggctgaagcaggagaattgcttgaacccgaggcagagattgcagtgaaccgagatcgcacccctgcactctagcctgggcgacagagcaagaatctgtctca

SEQ ID NO: 228957 - DNA, 415 bp, Homo sapiens
gcggccgtggttgccgcccggcgcttgcacaatcgcgatgccgggcgggcgaggtccccgagtgcgggcccagaaaagctgccggcgtctgccagggccccggggagcccgggcgcctcccggggagccagatacccccagcctggactgaagtgattttttttttttttttgcctttttttttttggaggaagtttggctttctgcgcctcccagggtggggaggatttgagtcttactgaaatgcaccagaagaggagactttcttaacttgagcaagaaggggagtttgtagaatttccttcctgctgtttcatgtttggttgttttgcagattaaatgaattaatgcacgtaaagcggcaacaacgaagccttgtctatagtcaacagtcaataaaagttagttgctgttg

SEQ ID NO: 228958 - DNA, 479 bp, Homo sapiens
gctgggcctggtagctcacgcctgtaatcctagcactttgggaggccgaggtgggcagatcacctgaggtggggagttcgagaccagcctggccaacatggcaaaaccctgtctctactaaaaatgcacaagttagcatggtggctcatgcctgtaatcccagccacttggaaggctgaagcaggagaattgcttgaacctaggaggcagagattgaagtgagccgagatggtgccactgcactccagcctggatgacagagcgagactctgtctcaaaaaaaaaagaggaagaaaaagaaatacaccccattcctggtgccagtcagtgtctgtctgtctctgtatacatacttatgtataaatatgtgtttgtatatatgtttatatacatatatatttgttcatgttattttggtttgacacttttaaaataaggctaagaaacaaatctacgtaagaaataaaacaacttgttac

SEQ ID NO: 228959 - DNA, 464 bp, Homo sapiens
tacaagccaatgatcatttagcaatcaccatggactaggagagaagcatggaacagattttccctctgtgccctaaagaggaagcaacactgccaacactttgattttggacttctgacctccagaactcattctaaaagctgagccttggaattctgtttgaaatcacctacggaaaacacacctgagaaaattcctaaactctctctgggaaagaaaaaggcaggattgaaacatgttggaattttcgtggctcctgccgtgacgaatgcctgaagaatgaaagggtctatgttttctgcgtgagtggtaaactgtgctgtttgaagcccaaggaccagccacatttaccacagcatataaagaattagtgctttaaagtctgaggccacaaaaatgaagataaacttgccttaagtctgatgtcagtagattcctgggctttattaaaacatctttggctg

SEQ ID NO: 228960 - DNA, 394 bp, Homo sapiens
caggcagttcttgcagtgcggagcgtggaagggctgcccagttctcaccagtcgtgcttctgaagcgctaggcgtctgatcacgcacaggacgtctgattgcctgaactgcccgtcaaggaggtggcatgtgttcatcattcatttattatttaatcaacatcgactatcatgtgtcagacactccgctgggccctgggggttctagaagtaagacttgttccgtgccctccagtgattcacgataagatcaaactgttcttgttcggtttacctagtgataaattgatttagtccctgaaatccctttcttactgcctgtgacctgtaggccaaaattgggaacctctgaatagtagtaaattaaaatcaccaaagacgtcattgtggcagtg

SEQ ID NO: 228961 - DNA, 492 bp, Homo sapiens
caaagtatgctctgcatttagctcaacctatggtaactgtgtagtccacggaaactgctcttgaggccagcgacattttgcgaaacattcatttccagggaagagtccttgaggatgtagtataaaaatataatttaatttggcagacttagaaatttatcctacatcccacagtaaccatgctttgtgtcttctgaagccaagtgagaaagcaggcatttgtctggttttccattggcatcctgctcagtgtgtgtgtgtgtgtttgagaagataatttgcagcttagttactgggctgaaaatgaagctcacttgaaagacatgctccacctggaggtgaagaacagccttgttgagttctgggtgccttgagatctcataggcagaatttctctgcgaatactgcggatctctaaattgttggatcttccccttttgggtgttatttgtattatgtaactgattattaaagaaaaactattagctatta

SEQ ID NO: 228962 - DNA, 230 bp, Homo sapiens
ggagaatcccttgaacccaggaggtggaggttgcagtgagctgaaattgcgtcattgcactgcagcctggacaacaagaatgaaactctgtctcaaataaataaataaagagaaataatgctgctccaaggacaatttcccttcagaagtagaaactggaaactactaaatagcttgagctgaaggaagaaagtagattatttgtggaagatttgtggtcttagaagcgg

SEQ ID NO: 228963 - DNA, 271 bp, Homo sapiens
tacttaattctgctttattgctagacagtattccatcatctgaatatttcatggtttatccattcatcagttgatggacatttagattgtttccgtttttttggctattgtgaatgatgctgctatgaatatttgtgtacaagtttttgtgggaacttaagtttttatttctcttgtatatatacctaggagtggaatgtagtgtgtgagggttccaatttcaccacatccccaccaacacttgttattgtctgtccctttgattatagcc

SEQ ID NO: 228964 - DNA, 366 bp, Homo sapiens
gtgtccagtatgactggtgtccttacaagaagaagaaatttgaatacagacatatacagggaaaataccatgtgacaatacaaggaaaagacagccatatacaagccaaggaaagaggcctcagaaaaacctaaccctgctgacattgatcttctgtgcttccagaacagtgagaaaataaatttcctttgtttaaaccacccagaatgtggtagtttgttatgacagtcctcacaaactaatacaataacttacctaaactttcagaattcaacaacattttctctttccaatgtccattaaacatatttctgttaagggaaagtgaggaatcgatcaaatatttaacaaaagttataatactag

SEQ ID NO: 228965 - DNA, 631 bp, Homo sapiens
gtcatgctagtttagatgaattaaaacctggtaatttagtttactggatcttgtgttgtaaattcagattcctaaataacaatgacaaactgtctagagtagggattgacaaattttttctgtaaattttgtaggctttgcaggccttatggtctctcaggttgcagctgctgaactcttgtaacatgaaagcaactataggcaatacataaccgaatgagcatggttgtgtgccggtaaaacattgtggatactgatgtttgaattttgtgtagttttcatatattacaaaatatattcctttgatattttttaaccattacaaaatgtaaaaatgatgcttaactcatagaccttatcagaataaatggtgggccagattcggactgtgggctatagtttgcagacttctggtctagaatctagaacaaaagataggtccttctaaagcctcaaagtaagacctttgccttactaacgtgagttctttttagttcactgtgtttaaaagtattccaggtccaaacccagatatacaaggattatttgtttgcatgcttgcattcttgctcttttttgtttgagttggggtttagctatgttgcctaggctggacttgaacttctgggct

SEQ ID NO: 228966 - DNA, 302 bp, Homo sapiens
gtcatgtgtttctattatagtttataataaaactgggagttttatagaatgctgtcattgtagttatgatgtacttaaaaactgaactcctgagtcctatttatgctgcattaactctggcaaactgcatttttcctatgggatcaggagtgtagtttaatttgaacatattgctcggatgtcagactaaataattttttcctagctttgccagggacctgttgtttaatgggtttaatatctgatacctttgacttcagtatctttcaaaagtgaaatacaactgcataccaggtaccaga

SEQ ID NO: 228967 - DNA, 448 bp, Homo sapiens
gcacattaagtatcccagtgctggcagtgggtcacggacatgagtcaccgtcaagggcacgcctttcctgcttcagacgggcaacccttgatgtccaggccggacagtgccctttgtgctcttttattcgttaaaaagaagtcccttgccaaagaatgtaggggtggcagtcctctcctgcgaaaagcgggtatgtgcggggtggacagcctttccagagggcagtctggcaagtggatcaaaagccttaaaggttttcttaagacccaagattctcacctttggaaattttgtcccagggaactagtgggaggtatattcaggaattagaagagtaaaatcaactctgcagaagggggtcagtaagttacttgtcatatccatatgttataattctgttccattatttaaagtcatttaaaaagagtattgaataggaaacattaaa

SEQ ID NO: 228968 - DNA, 540 bp, Homo sapiens
tctttcaactttctccaccaacagggtcaggctgttgattggcctcgactgcagttagcctgacacggctagcagcctcaaaacaaattaaacgaggcagggatgccgtgcagtgatcgttccattatgtcccctctgcttccacacgtgactcacactatcacttttagaaggtgaagcatcttattgaatcaacacctaatctgcacacagtgtcacggaggaggggcgaggggacagcgggagcattttctctgatccttttctttcctgaagacttcgctggagacaggctgggtgggggcgaagatgaattgtgaggaaccctgaccctatttcagtactgctgctactgtcagctccgacagatttatagcccattcattcatgggaacaaaaaccctgccacggctggtcatgggacacgcaatagcagttagttcaaaagataacagctgcaatacctcacctctccattcagcactacagagccagcactacttcggaggtaataaatgcttcttgttagtgtaaaaaaag

SEQ ID NO: 228969 - DNA, 756 bp, Homo sapiens
tctttcaactttctccaccaacagggtcaggctgttgattggcctcgactgcagttagcctgacacggctagcagcctcaaaacaaattaaacgaggcagggatgccgtgcagtgatcgttccattatgtcccctctgcttccacacgtgactcacactatcacttttagaaggtgaagcatcttattgaatcaacacctaatctgcacacagtgtcacggaggaggggcgaggggacagcgggagcattttctctgatccttttctttcctgaagacttcgctggagacaggctgggtgggggcgaagatgaattgtgaggaaccctgaccctatttcagtactgctgctactgtcagctccgacagatttatagcccattcattcatgggaacaaaaaccctgccacggctggtcatgggacacgcaatagcagttagttcaaaagataacagctgcaatacctcacctctccattcagcactacagagccagcactacttcggagtccacccaacacaagctgggttgctgaacctttgcaactcaagcacttaggcaacgctgaaaagccgagcttcctcgtggtaagtggcaatgtgggtatatacattctccttgcaaactgatcagaaacagagctcgggcatgagtcctgtcccgacaagaagaggcagctggtctgactagtccaccaccatcctcagagcctggacacacacaacaagcatgtattaaaagaatccatggattttt

SEQ ID NO: 228970 - DNA, 480 bp, Homo sapiens
cataggatgcttcctccacaccatactgaactgtcactcagttatcagtcactactgcagacattgggagagaagatgaagaactgagaatgtccagcgtgaccatcgcgcgtctctgtacccatggcttttgcctcccaacccctgtagcaggtgtccttagtcccaactgctcctccccagccctgtgtaaaatcaatgacagacaatgagtactaatcccctagagtgttccttctcccacctgtacttgaccaattacttctgaaactggctgaatctggctgagccctcctataaagcccataaacatcctattctcctgcttaggtcaaacctgctcacacgtgtatttccaggttgtgctggggtatgaaccagttccctcatcagtacatcatctagtatgcagtgatgtgtgtagggagtagtagtatcacatcaggttgtgcctgcctcatcacaattgccccacaaaga

SEQ ID NO: 228971 - DNA, 498 bp, Homo sapiens
ccaggacgtaggattcaagaatactatgctctggcctgaggtatttgggtgggctctgggcagctcaaggaaggggctggggactctaatcacttgtgaaaaagtcaaggcattcctctaacacccatttagcaaaaagttcctacagtgtgccaggcatgtggtttataggttggggattcagtagggatcaaaacagatgacgttcaagggagacagagacacagcattttcagatgctaacaggtaccacggagaagattctaacatggtgatctaggaggcgatctaacagggctagggcctaggaggagactttagggcgtggggccagagaaggctgcaatgatgtttaagccaagatctgagtgatccaaaggtcagggggaagagcattccaggcagaaggagtaggcagtgtagaggccctgaggcctgtgaggtcctgaagggcagcccacgtcaatggggcaaggagaagggaaaggaggtggatgg

SEQ ID NO: 228972 - DNA, 384 bp, Homo sapiens
gttttggtctttgacctcccacgcccacggctggggctgccgaaagtgaagaaactagatttgcagacgccactgctagttggttatgaagctccgggcaacagctttttggatgtttaaatatgtagtgcccatctaacacagcctcccttttcctgctccctgcccgcctctcatcaccttggctttctccttttctttgcactttgaaacgtacagttaatgcagatttcacttcagcaggctccaggtaacctcctgatcaccaaatccagaaacgctgtgattccggacagacaatgtaagggtgtcgttgagaggggactcagtgccagggttggaatcccagccttatctgtttctcttaatagtgtgctgggatac

SEQ ID NO: 228973 - DNA, 318 bp, Homo sapiens
gagctacaattcaagatgagatttgggtggggacacagccagaccatatcagctttaatccaatatgactgtggatccttataaaaatgggatatttggacacagagacagacatgtgctgtgagaagatgacgtgacaacataaggagaatgccatctacgagccaaggaatgcttgcagccaccacgagctaggcgagaggcctgggacagattctccctcacagcccttggaagaaccaaccctgctgacaccttgaatgtagacttctgggctgccaaactgtgtggcaataaatttctgttatttaagccacc

SEQ ID NO: 228974 - DNA, 262 bp, Homo sapiens
agtgcggccatttccggtcgctcctggaggcgcccgagcccgacgtggaggccgagttgtcccggctttctgaagaccggctggcgcggcctgagccgctcaacaccacgtcggggtctccgagccggcggcggcggcgagaggcggccgaggacccggcgggcagggtagccgggcctggagaggtgtccgacggctgccgggaggcgctggcggcctggctggccccccaggccgcgtccctgtcctgggaccgcctggc

SEQ ID NO: 228975 - DNA, 354 bp, Homo sapiens
aattaagttcagaacaaatctgctctaatagtttatgctttcctcttctttttttaaaaaagggttattttctttctatagtatacttattttttaaatatattatggatgtattgaagtacagtagtaatttagatatttttaaaaatttttatatgggaaaagaatagatttacttttgtattcttgtaaattattgaagttttaatctgaatggattaattgacttgattatattctaattcagaggaaatttatgtctccctagtctacattttttttttttgagtcaaagtctcgttcttgtaccccaggctggagtgcaatggcgcgatctcagctcacggcaacctc

SEQ ID NO: 228976 - DNA, 438 bp, Homo sapiens
ccatgtctttctgggaggaatgactaagaatccgcagccgcctccaatccaccatgcccacgcaagagacaggagtgataattgcaaccaagatggtgcatggtagcagattggtcactgtttccagttattcactgtcctcccagtgagaggactattcatcctgccccattgctacacgacgtgcagggcctccagtgttgggtacacctcccctccccaccaaatcaggtttggccatgtgacttgctttagccagtgaatccggagcccaagtcctagcaggccattcaaaagagaagcttcaagagccatcacgtgggttggccagcctgcttttccctttgaacagagctgtgttttttagagagagaccttagataagcctccctgttccacagaatacaaatccaattggtaagacttctatccatctta

SEQ ID NO: 228977 - DNA, 177 bp, Homo sapiens
caaacatgtgcatactatggagcagaatggaaactgtgcacatgtgctccaggtaaaacacaagactccgcaggaatttcaagcctgcagcgagcctctgggcacacccctggttagtgcagacccttggtggcacactctcaagagcaatgccatgagaagtcactcacggtatcc

SEQ ID NO: 228978 - DNA, 731 bp, Homo sapiens
  misc_feature (644)..(644): n is a, c, g, or t
cagtggcatgatctcggctcactgcaacctccacctctcgggttcaagcgattctcctgcctcagcctcctgagtagctgggactacaagtgcatgtcaccacgcctggcttattttttgtagagacagtgtctcactgtgttgctcaggctggtctcggaagtcctgggttcaagccatccgcttgcctcagcctcctgcgtagctgggattacaggcacacgccactacactcagctaatttttaaattttgtgtagagttggggtcttctatattgcccagactggtctcaaactcctgggcttaagtgatcctcctgccttggcctcccaaagtgctgggattacaggcgtgagccactgtgcttggccttcccattttcactgaaggttttctttgtggttacattggtttgcctttccctgcattagttgtttgtctaacttaatggcctcctcattttatgttctgcctgccttctgtcttaaagtcttaaatccgttcaggcctttatcagtgagcagatagtgtccacatgtgtatatgtgagggggtggtctgggtgtctctataggtgtgtgtgtgtgtgtgtgttgggggctgtgtatggggggatatgtaggagtgttggtgggtgttttnttgggttggcttggggggtcgggcttgtgggccttcggggtcgggtttttcttttttcccttggtctccgtggcgccttgtttcccc

SEQ ID NO: 228979 - DNA, 410 bp, Homo sapiens
cgcatttgttcttaggtgggggagaggtgctgggaggccaggccttcctccccagggtggagtttcgcatttggaaaggaagggcgcagcgtggtggcctccacaattcagtgcacgtggctgagagcctcttgtctcactgtgaggtacaggtttgttcttggaaaacagggagttaacatttgttcattgggaagtaatgcattttcattctgtcttacatgttttttaatgatcaaaaagttctaacaacatataattttttattttagagatagggtctcaccctcgcccaggctggagagcagtggtgcagtcacagctcactgcagccttgacctcccaggttcaagggatccttccacctcagcctccctagtagctgggactacaggcacacagcacatcca

SEQ ID NO: 228980 - DNA, 662 bp, Homo sapiens
agagtttccagcaggattaaatggcagttgcccaagtgatcacttacttgatcactctttttgactgttttcccttccctatcatcatttctctggtttacttacacaaacctagatggtacagcctagactatatggtatagcacatggctcctacaaccctatacagcaagttactgtactgaatgctgtaggcaattgtaacacaatggtaggtatttgtgtatctaaacataggaaaggtacagtaaaaatacagtgtaaaagataaaaaatggtgcaccggtctagggcacttacagtgaatggagcttgcagaaccgaaagttgctctcggaatctgcgagtgagtgtgagtgaatgtgatggcacaggacattactatgcactactgtagactttataaacacggtgtacttaggctacactaaatttattttttaaaactgtatttctttagtaatagattaaccttagcttactgtaatgtttttactttataaactttttttaaagcttgttgatgcttttgtataatacttagcttaaaacacatgtgcattgtacaactgtacaaaaatattttctttctttatacccttattctataagctttccatttctaaagatttttattttttattttttttactttttaaacg

SEQ ID NO: 228981 - DNA, 442 bp, Homo sapiens
aacaaagattctctgtcatgaaaataccgtaggccaccttttgacaactgagttttgcagatctgctttcacattgataaaccgaatttgtatatgttaagacagatacagcactgattattttcattttaattattccaggtcagcgcctatgattgcatacagagacatgcataaactatttaggggaatctgatcaaagctcttaggaaaatttcgtggtgcataacgatagtatcactgtctcggtttacatccatagttggttgttaaattacaggcagatacctccagagagctccctgcaattattgaaattacttctgaccttgagtttttatatgcttgtacattactgtgtaattttccaaagtctggatttatttttgagagagtgtaaagaatcatttgctttaatctctgatcctgggtgtgggtgagg

SEQ ID NO: 228982 - DNA, 941 bp, Homo sapiens
ccgggctcagacactgtctggcacacaggcccttccagacccaggcaagtctcctttaaggctacctgtgggtcatgggcacattgagggcatgctggagagtccctgggtaaagcaggtgactctctggggtggacaccccctccctgcccactgctgcccataccctccatccactggctgtcagggcaggtgcccagtggagggtgggaggtggtttatacccatcagcctcctaagggaggacactcagacttgtgccgtcatcacagtagaacattttcatcaccccagaaagacaccctgtacccatcggccgtcacttccgtgccccttcctcccagccaccagcaaccaccgactggttggtgctttctgtttccacggatttgccaattctggatatttcgtataaatggaatcacatgacgtgtggccttttgtgtcaggcttctttcactcctcttgttctcagggtccagccacaggtaccctgtattggtcttcattgcttttcatggctgaatactattccattgtgtgggtggaacacatgattccttcatttgttgctgtacatttggatcgtttccatgtttgggctcacatgaatggtgttgctctgagcgtttggcgacaggtattttgtggatgtctattttcagttctctctggtgcacactggtatcctcactttgggcaccagctcaggagtcccacagacttgggtttggcgcccagccccattgtttacaagctgtttggtcttgggcaagccattctcttagcctcactctccttgtctgtaaagtgggcatgtaggccaggctcagtggctcacgcctataatcccatcactttgggaggccaagacaggaggattgcttgagtccaggagttcaagaccagcctgggcaacatgatgaaaccccatctctacc

SEQ ID NO: 228983 - DNA, 890 bp, Homo sapiens
ccgggctcagacactgtctggcacacaggcccttccagacccaggcaagtctcctttaaggctacctgtgggtcatgggcacattgagggcatgctggagagtccctgggtaaagcaggtgactctctggggtggacaccccctccctgcccactgctgcccataccctccatccactggctgtcagggcaggtgcccagtggagggtgggaggtggtttatacccatcagcctcctaagggaggacactcagacttgtgccgtcatcacagtagaacattttcatcaccccagaaagacaccctgtacccatcggccgtcacttccgtgccccttcctcccagccaccagcaaccaccgactggttggtgctttctgtttccacggatttgccaattctggatatttcgtataaatggaatcacatgacgtgtggccttttgtgtcaggcttctttcactccttcatggctgaatactattccattgtgtgggtggaacacatgattccttcatttgttgctgtacatttggatcgtttccatgtttgggctcacatgaatggtgttgctctgagcgtttggcgacaggtattttgtggatgtctattttcagttctctctggtgcacactggtatcctcactttgggcaccagctcaggagtcccacagacttgggtttggcgcccagccccattgtttacaagctgtttggtcttgggcaagccattctcttagcctcactctccttgtctgtaaagtgggcatgtaggccaggctcagtggctcacgcctataatcccatcactttgggaggccaagacaggaggattgcttgagtccaggagttcaagaccagcctgggcaacatgatgaaaccccatctctacc

SEQ ID NO: 228984 - DNA, 631 bp, Homo sapiens
gtttgtaacataccatgttaaaaaatataaacataataacaataagaccaatataaataagctgctattatatactggttaacctcataatgatcatgtgtcaaccaataaattaccacaaatcatccctgcacaaagcttttaatctactacatatgcaggttcaggtgtattcagttatgttagcatttttgtacactaaaacaacaaaccaaagtttaaaaattgcttgataagaacaaaagagtaatttcaaagttttctcataagattatattttaaaggttaaaataatgtttaaaaatcaaattggtattttttattatcagattataatttcaggttgtactcttgagaccaaagaaaatcaatcaatggcaagaacatttgtaccataccaattttcaaattcaactgcagaaccactctaagaaagatctgttcagtttattaattccatccaataaaaaccacattaacgccaaccttaaaactgcttattagtattttgtaggtacttttaatcaaagtacctataccacatcataaatttttatacctaaatcctatttaagtaattcaatataacaatcagaagagccagcaattatttattcctccacctatattc

SEQ ID NO: 228985 - DNA, 251 bp, Homo sapiens
aaggacttcatttattatttggggtgcttctctttctctacacacacatatacacatgtgtgaatatattatctatcatacttagcatgtgatttacaggtcaattctatagaaagaaatagggttggctgggcacagtggctcacgcctgtaatcccagcactttgggaggccaaggcgggtggatcacgaggtcaggagttcgagaccagcatgaccaacatggtgaaaccctgtttctactaaaaata

SEQ ID NO: 228986 - DNA, 330 bp, Homo sapiens
aggcggctgcgggagcggagtggtcgcccagcgcgcggggggacgcgggctgcactcccgggcaggcgctctgcaatgagacagtaaatgcatcccccggtaaggcgcacggctcactcgggttttcctcttcctccagctgcatgcacgttgcatgaatttctcgtgtcttttccctcccctctccagaaggaaaatgtggggttttttttcctcccttttgcttctcgtgagtgatgccaatgcaggaaaaacccgtaaagctcccagatttgatggtctaggagggcttcttgcaggaaaataaaaataaaatgaaattaatgcacc

SEQ ID NO: 228987 - DNA, 361 bp, Homo sapiens
gggattacagcatcacgggtctagaccaagcttctccttaaccaagatgccgtgcctaaaactcgggggtcgggggtggtccatgacatttcatggggaaaattacatatgtgtttcctccagttgaaatttggcatttcctttgcttctgatgatagatgataaaccatcttggggtccctagtacctgtggctttgccaacaatagaaatcacagatgttttccatatcataggaaagttttgcaggtttaaacatatcgcttatgcccacatgcctacttcaaaatttcaggagttctaagacctgctactgaatcttcttatttatgtattaataaagcagcacatttatatccgta

SEQ ID NO: 228988 - DNA, 374 bp, Homo sapiens
caggagaggccagcctccctttcttacagacatgcccaatcttcaccaaaccaaggctctctgggcggaagcaatcatggtgattgctgctatctgtgaggggctctcctcgggtggctgctcaagggacaatgacaaggccctggactgccacactccctccttcccatctcatgcgggattcgagctgggccaggaggcaagcccggaggaagagggcaggactcaccaggacagttctcttctgaacacacaggcctcagcactggtacccaccctcacctccacaggccactcagttctctctgcttgtctgtgtcctactgaaccgccagccccccagcataagactcttgtctgatctttgtatcccc

SEQ ID NO: 228989 - DNA, 803 bp, Homo sapiens
gaaggcaagataatgtctctgagggcttcattgtgtcacttctctttggatggcggacaccgtggccctctgctggcggaggggtgccattgctgcctgccccatctctatccccagggcccatgcagtcactgggttcgccctctggggcacggggttccctctgctcttttcctagataagcccattctctgcaggtctctaccctccacacctgtgttcaggaattcagcccgcttcctgcagccccatccctaccctcctcccaacctgcttttcttctggtgtccctcactcagcatggctaacagatccaccacccaacggagctgagaactgcagtcccctctgcctgttacctctcctgccattagtgaacctgcttaactcatctgactgtgcgtctcggtgcttgctgtgacatgtctccagcccttgctgctctgtcccccagacccacgtcccacacccggatggtgactcagccgactctgggtcttctggacccagtgcttctccctgatacaattccttcctctgtgttttaggatcctgatgctttgataagaccgtgggctctaatcacagccagggacatttgcagcagcctggcctgcagctctgcacactgggtgcactcagtctaaagcaccagctccccatgagagagaaagaaggggtgaggggaagtacagagaaagctcctgaggccacagggctgacaaagccctcggctttgggggcactttgtttcttcaagactaaaatgcaggcaatggaataaatcatttgttcctaaaaca

SEQ ID NO: 228990 - DNA, 451 bp, Homo sapiens
tcaactggtggggtttgaagtaaggagggtcactgactgaagctttctgaagtaatctagccaataaaccagatggatctcacagcagggcaggaatatctaaaggagactgagaagaggatttataggggtagaatcgaaggctaatgagatgttggaggtaagcaaggcccagatgtctaacttcagtgaactgcaatgctataagctggaggatgaccagttttggggaatgtggtggggaaagtgatgaggttagtttgaacatggagaatgtgtggtattagagtagatgttgtatctgtggggggtagggggaaaaaagacagaatggcagacaggcaatgacagagcagctgccctggaagtcaggcagaaagccaaaaaaagggaagaagacagctctatgagtgacaaaagcagcaatgagctagccaggcagcagacatct

SEQ ID NO: 228991 - DNA, 457 bp, Homo sapiens
cagcagaggaccggcccccttctgcagactccatcctgcctctcacccgcctggggctgcaggagctgtatcctgaggcagactcagtccagtttaatagggatcaaggggaatagctcccaaattttaaacatgagaggcagtttctcttactgtgggtgagggtggctgtgatgctgctgaagatgcagaaaccctactggccaagttggagacagtccaggctctgagttattctaaggtcaaggtgggttcacccaagcagaacacagctcattaacctccatcccccaactctctgttcaggctgggtgatacagccatgtggggctatgggcatctagggggaaagagaggagagagggatgggggagtgatctgggaaagcagcttttaagagatggccaataagttgtatctaatttgtaaagattaaactacttttttttggtgtttg

SEQ ID NO: 228992 - DNA, 502 bp, Homo sapiens
tcttggaattgcagtaattttaaaggcagaactgagctgagtgctcagtggaaagatggccacaaaagcagcagtgactaaacgttcaattctggccattcagccacactggttgtaatttgaaagtaccaaacctcttattggactaactaggccatatgctctgccagtttatcctggtgtcatgtcattatccttcagcttcccacttgagggctagagagaaacatagtattggctaagcagatgtaggatagcttctagttagccaagagactatcctgagtggtctcactagaggtctgaaattcatagtcaagcttgaatcccaaagttgaatcaccgaagttgccttttaaaaacttaaatttcggccgggcctggtggctcacgcctgtaatcccagcactttgggatgccaaggcgggcggatcacaaggtcaggagatctagaccatcctggctaacacagtgaaaccctgtctctactaaaaatacaaaa

SEQ ID NO: 228993 - DNA, 317 bp, Homo sapiens
tttcaaaaagaggctgtgtaaaatgtcaggctgtgggttttaaaaacaccatagtccaacagcaccttgtagggcacacacaaggcaagtcattcccgtgaattcattcacgctgtcttttcagattcctaaggaagccttttgaacattaaaaaaaagaaaagagaagtaaaaacgggtagctattgaaatgggctttggatttagatgaccttacattgaggttttaagccgggtgaacaatttatatgtaaatttagaaattaaaaaagcagaaatttatacttaaattaatcgaccttatagaaggcatggaa

SEQ ID NO: 228994 - DNA, 397 bp, Homo sapiens
ctcttgaggtacaggctctgagcttccctccttcatctctaccacattcattctggacaaaacaagttgcaagtccagtccagattttaggagcaggcaaatagactccctatcatgatgggagaaactgcaaaggagagagggagaattgcaaccatatttgcaaccagtcaaccacaaaatttattgtaggagccagagaagagagtcttgggatctgaggtgaggaaaggaggtggaggaggatcaggggtcaggaaatcatgtgtctccaccagaaatgctggtggaaaatgctcatgaaatggtaagttatggaatggaaaagagtaagttacgctatatattactaggattatcactatgggaagatcaaagcacttaccaatagaaaaaa

SEQ ID NO: 228995 - DNA, 300 bp, Homo sapiens
agcatgctcttagccttcctgagcaccttcccttttttcagccaactgctcgctcgctcacctccctccttggcacgatgagcacctgcagccaccagttcacctcctccagatccatgaagggctcctgcagcatcgggggcagcatcaggggcggctccagccgcatctcctctgtcctggccggagggtcctgccatgcccccagcacctacgggggggcctgtgtgtctccttctctcgcttctcctttgggggagcctgcgggctggggggcggctatggcggtggcttcggcag

SEQ ID NO: 228996 - DNA, 513 bp, Homo sapiens
tatgtcccagacattgttctaaatgttttacaaatattaacccttttaatccttatactaacccaatgacataggtaccatcttattttatagatgaggaaaatgagacccagagaagtcaagtaatttgcctggcgtcacacagctcatcatagatggttgggcaaggatttgcaccaaacagtattgctccagtgggagctctcttaacttccaagcttactaataaaggggaaacaagtcaaatgaattttttaaaagtaacctgttattaagaggaaattaaagacgtatagtttaaatgcaaatggacgatgaaaactaaatatcctctctaaataggtgagaattaggagggtccttaaacatattgcctcatcaggtgactgagaagcagtacaaggaaattacaaagaaatggtcttccatttccaggcctattatcgttactgataaagctactattttatggttgttactattttcactttttttaatgttagtgttaaagag

SEQ ID NO: 228997 - DNA, 371 bp, Homo sapiens
ccccacagtgtatgtctgtatgcatgtaccggtgggtacacaattcctgtacatgtgtacaagcaatgcatgtacaattcctttgcatgcatgcaaactggcatagtgcatgtctgtaagcatataattggagcacacctttctagaaaagtgtacaagcataattcccgtacacatgtgcctgctgtacaatgtacatctgttagcaggtacacatacacgtgtaatttctgtgcgtatgaacaatgcctaccagtgtcttgatgcttttgtgtatctagctgcccgtccttatgcatacatgcacctgtatgagtgtgcttcatttattcacctttcttcttcattcgataaatatgaggacccaactt

SEQ ID NO: 228998 - DNA, 492 bp, Homo sapiens
acatagcaaggctgtctcagaaatatatatatttttgtgtatatatatatgcttacattttaataaaattaagtttcttcctttcttttgccttggagaaaaaatatacacataaagctgggcgcggtggctcacgcctgtaatcccacactttgggaggctgagcaaccgcacctggcctgtcaactgattttctaccaaggtgccaagacaattcaatggaggaaacaaaagtattttcaacaaatagggctacaaaaatagaatatccatatgaaaaaaaaatcatgacacttacttctcacagcatattaaaaaattaacttgaaaataagtttaaatgtatgagttaaaattataaataatgcagaagaaaacacagagaaaatctttagaactctgggttagaaaaagacttaggactcaaaaaacatgaaccacaaaagaaaaacactgataaacaggtttcatcagcattcaaaacttcttctc

SEQ ID NO: 228999 - DNA, 214 bp, Homo sapiens
aatttcaaccctggtctgtctgacacaaatgcccaggttccaactactctgctatgctgctatctctcttggatttctattcttcagtgagctccctcattggggaaactgaaaagtaactactgtaatgagaagtttacatcagcaactgtgtaagtgattgttgatatcaatttataaatgcagacctaaccaataaagattttctgtttat

SEQ ID NO: 229000 - DNA, 557 bp, Homo sapiens
ggtgaaggttcagcatcttcagaactctacatgatgcattccctgaggctgcctttcaataactgaggtgatattctttgagcagtgtgacctgttagaggtgcccagtcaggtccgatgaaaagccctctgatttgttgaaatagtgcattagtaaagtattatagtttattttcacaaagctagattagttgttacatgttggtttttgttttgcctagccctaacaagtatggaggtgaccttgatgtgtctatagaatatcaggaatatctggctgggtgggtggctcacacctgtaatcccaacaatttgggaggccgaggtgggcggatcacctgaggtcaggagtttgagagaggcctggccaacatggtgaacccccgtctctactaaaaatacaaaaattagccaggtgtggtggcaggtgcctgcaatctcagctactccggaggctgatgcaggggaatcacttgaacccgggaggtagaggttgcagtgagccaagattgtgccactgcactccagcctgggcaacagagcgagattctgcctca

SEQ ID NO: 229001 - DNA, 500 bp, Homo sapiens
ggtatatacccagtaatgggatggccgggtcaaatggtatttctagttctagatccttgaggaatagccacactgtcttccacaatggttgaactagtttacagtcccaccaacagtgtaaaagtgtagaatcaatttcatttgtgtaaatattggcctgtagctgatgctgcttttaaaaatcaagtattcctaggaaataatgtttttattgtgactttgttactttgcttttctttttgatagatgtttctttgggcaggagagatctcttttcaacacaactatatatggaacccttatatgtgattgataaaagtggtattttaaaatttatttttgctttatttttctttaaagtcaggtcagttgaggaataaattacataaagttaaaattcttctcttttaggtgtacagtttgatgaattttgacaaacttagtcataaaatcatcaccacaatcaaaatacagaatttccctttttggtagttttattt

SEQ ID NO: 229002 - DNA, 435 bp, Homo sapiens
ctcacaaaaataatgttcagcaaatgaagacagacacaaaaaaagcacatactggataaattatagttatttaaggttcaaacacaagcaaaacaaatcttgtaaatattttttttaattctcaggaagatatttttcccctttcacagtatcaaagacctgtataacaagtgttgagctcgtgcctgtaatcctagcactttgggaggccaaggagagcggatcacgaggtcaggagtttgagaacagcctggccaatatggtgaaaccccgtctctattaaaaatacaaaaattaggctgggcgtggtagctcacgcctgtaaccccaacactttgggaggcggaggcaggcagatcacaaggtcaggagatcgagaccatcctggctaacacagtgaaaccccgtctctactaaaaatacaaaaaaaaaaaa

SEQ ID NO: 229003 - DNA, 510 bp, Homo sapiens
taaactcttagcccagtgcttctttgaatataactttatgcttaattaatgcttgatgaattgaattagaacttgattcttgaaaaaagaaattgtgatttttttagacttctttttatgcaaaagtaacgtaacttccattcaacacattttatcccaaattgaataaactagggaaaaggcagacggtgaatgccttgagaaattgttcagattcaaggacaagcatttgttgcctttactgcatatgactgtactgtggttccatacatccgagctgatagaaaacttgcagcaagggtctagtggtgatgcatggcaggtggaggtgagataaatttagtcacaggaaccaaattggttctgctagggcaatataggcattgttgggccatctgggtgtggttgacttctgggaggtctttttagtttttctttctcacttcattccataaatatttattggatgccctgttctagttgtttaagatcaatgaacaaaatagacca

SEQ ID NO: 229004 - DNA, 293 bp, Homo sapiens
gagcccggctgccaagccccagccggctatcctgcgtcccgccttgcagccgcctcctcaaagcctcctcacctggcgccgccgcccgccgcccgcccagccccgcaccggcgctgcctcccctgaaagtttccccagcgtagacaccttcgcgctgcagcagcccagggagacggtgttccgaagctgtgccttggagtggctcttcttacacctttccgcctcatccccacctaattcgggcagggagtagaaatttttccaaattaaggggagaaaggggggaggggcat

SEQ ID NO: 229005 - DNA, 361 bp, Homo sapiens
cttgtgaaactgggaagcacagcacaggctgaacagagcactggattccatagaaaatgttttccctccaactctgacaaactccaccctttggtttctggtgcctagttaacaaaacaacctgcaattccaactccacgtcagcacttgggcgaaggaataggcccctataaatgaggagctttgtgtttttcgctggcttcctctcacctcttcaagccatgtgtgtggtaggacctcaacacacttgtcgattggctaaagaatcacacacctgcagtcaaattttcacttttaattttttacttaaaaagaaaaaagagcagcctgggctacatggcgaaaccccatctccacaaaa

SEQ ID NO: 229006 - DNA, 223 bp, Homo sapiens
atcactaaatcgtccttatcctagaaaattggagttccacagagacattttaaaaaaggaagtgacagaacttgatgatagatttgatgctagggacaaaggaaagacagacaggtcaaatttgcctcctagagatgctgtgagaagagtgatagttttattggcagaaatgggataattagggaaggaagtcagtttgtaaagaagctgactaagtgacttg

SEQ ID NO: 229007 - DNA, 142 bp, Homo sapiens
aacaggccaaggaccactcctaaagttctacctcctagcagcggcaggctgtggggaggggggcagctagaagcccaatgctcagacagagcagggccctgggcagagcgcaagcagactcaggcttcatggtgcggccaga

SEQ ID NO: 229008 - DNA, 390 bp, Homo sapiens
gagagagagagagagcaagcgagcgcagccatttgaagacagaggcagagactggagttatgctatcacaaaccaaggaacatcaggagccacaagaaggtgaaagagggctgggcacggtggctcacgcctgtaatcccagcactttgggaggccgaggcggggagatcacctgaggtcaggagttcgagaccagcctggccaacatggcgaaactccatctctactaaaaatagaaaaattagccaggagtggtggaacacacctatagtcccagctacttgagagactgaggcaggagaatcacttgaacccaggaggcggaggttgcagtgagctgagatcatgccactgcactctattctgggtgacagagtgagactccgtctc

SEQ ID NO: 229009 - DNA, 633 bp, Homo sapiens
aaaggatttgcttgcgtcattgctcctcatgctgtagtgttggtgagaatctcttgtttcaaatgaagctttcctggaccttcctccagagatgtggttcagcagtcggccccacttggagaagtcctggcctgaccatcactaaaatcttctctattccagatatagattaaggtgattgctatgattgatggggaaaaaaatgttctgttcagcaaatatagataagaaccccataaaccatgaggggtattctggaaatgaagttttaaagcttcatttagaatatctcgtaactggtaagcatggcacgtgacaaaaagagaggatcacatgcagtgactcttgtgagcactttccagattttcactcagatgacagcattaaaatcctcaaggctttatgacttatggcttatggtgcttcatcagctctcatttgcctcagattaatttttatctcactggaatgaaatcaactcagagtatcccaagcacacgtggagcactgctgttaggtatgggaatgttttcacgctaacaactcgtagttggttctagaaaaagttggggtggagagaagacttccaaaattcagtatgtggtctgaatttaaaccaagctgctacagatg

SEQ ID NO: 229010 - DNA, 484 bp, Homo sapiens
ggagggattcagagtagaagattactctttcttagtagtgaggtcagagattgctgtttgcactacactgcatttttaaaagggtatttgaagaagaggtcaaatttgaatacgcagaattgggcatgtgggagctgggaaggagcccagggaaggcaattcaagcaaaaaagaaaacaaaacaaaatgaaactcatataatttttcttacaaataatggggaagtagctgtaaacacactagctattatccttatcatcatcatcattatgtggacactatgtgacacacggaccactttgcccgccatgttaatttgctcccaaccttacttattgtactagccattgtgttcttccagcagaatcttcagtgttagcccaaaagttcttggggtctaaccacctgaaacatgattttgttgactctatcgctaaacgttaaaatgtgtgattattcagtaaaaaatatatatcttctgtca

SEQ ID NO: 229011 - DNA, 372 bp, Homo sapiens
agatagaaaatgaataaaacatgagtgagaaatatctaagaaattgtatttacagaattcaacactgaatatagaacatagaatttcaataggtttaatagttcttctgactaggaattcttaactttttctaagtgaagttaccttacttcctgtgtttaattcttgtttaaaattatatcattattaactgctggtagttatctccaattttgtccatctgagtccattgctcattatatttatgaagataatatttaatattgagaaatcatttaaacttaaataaaaggatagaaccactgagtatgtggaagattccttctcataagacataatttccaaatagtaatattagaagatacagtaaat

SEQ ID NO: 229012 - DNA, 671 bp, Homo sapiens
caagggaagaacatctccttcaccgggggtgagggagggcatcctgaaattctgctgctattccgacaggtgttttttacaatgtggctaacacaaaccattttttgagcacctactgtgagcatgagctggtaaaataaaataacttcatcttaggggctggacacactttatctgtaattcatccttgcattttccaggtgtaaaagttgaggttttgctaagttaagaaatttgccctgtatcacgtaacttggaaagcggcgaaagccaggcttctgactccaaagccagtgctcttctttctaacagtgtggtgtttctgttcatacatggataccatctacgcgcagcttgtgaattgcacttattggattgaattttgggtactttaagagctgagttctgaaaaggagaaaggccaggtgagcgaggacagaaggctaacttagactgatatcttcattttctggcacttggccactgtagggatacatggagtagggtgaagtctttgtatacacagctgaccctcgaacaacatgggtttgaactgtgtgggtccacttatacatggattttttcttcaataaatgtcttagaagattttttggagatttgtgacaatttttaaaaaatcacacatcaaccatgtagctgagaaatattga

SEQ ID NO: 229013 - DNA, 688 bp, Homo sapiens
gtttggaggaaggagcatacttaatgggtagtattgaggatgaaagggaatttctctctctgccattttatttgataatattaaagaaataaagactggaaagggggattccttgttaaaggtcagattttaaattgcatataaaatgaagtgagttgtgtttttttgaaccctcaaaagaaagcctgagaggtgatttatgcctctggcaaggtattatcatgataacttcagttcttctccataaatgccttcagcaaatacccagtgcttatgtgctgtgtgtatgtcttaaaccttaactttcatgaaatctcattccatcttagttcttcatcaagtccatagataaaatcctctctaagcgtttctgaagtatgtatccctgaacaaatttagtgaaataaaatcattaatctgtgttgatcccattttgccatacctttcactttacctcactgtctccttttgtgaaatattttaagaaagcaacgtccctcacaggactgttttgaggaatgcctcatggctgtgaaggagtttgtacaatgcaacattttgcttagcccttcagtacattttacttggattgttttcaagaactttattttttttgagaagaagtcttgctctatcacctaggctggagtgcagtggtgcgatctcagctcactgcaacctccacctc

SEQ ID NO: 229014 - DNA, 432 bp, Homo sapiens
tagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtggggga

SEQ ID NO: 229015 - DNA, 484 bp, Homo sapiens
cagcttactacttcagaaaaatatctctgtccctcttggacttccttagtttagaaagacataataagttcctataaggatactaataatccagagaatagtagctatattaattggtaggaattggacttttgtccctctaaaacaaaatctctatattctgcttggtctaatatcctatagaacactagaagtctaaggtggactgcttccagaggtctttgtccttaaaaccatatatccatttcaccaaaagagttgttctttctagctgtcaacataaccagtgtaatcctatacagcttactattactattgcaacatctgaaaactcctccccttcattaagtcataatatgggaactgacatttcagaaaaggatcctaaaggaatttttaaaataagctttattgctccttcaacctctccatcaatcactcctcccaaacatagtgtcaaaaccaaagtctctgtagtagaagt

SEQ ID NO: 229016 - DNA, 426 bp, Homo sapiens
atgaatttttcattttctaataccattacatatatatattataatttaaggtatagtcgataatataatgttttaataatggaatagttcatggtttttaaacttcacagtgtgtgagaatcacctggaggacttgttaaaagagattcctgggccccacccccaagtttccaattcagaaggtttgaattgggacgttttaaacctccatttttggcaagttctcagatactgctgatgccagtggtttgaggaccataccttgagaaccactgccttctaatagtacaataataggtttttgaggtgggagaatcacctgagcccatggaggtcgaggttgcaatgagctgtgatcacaccactgcactccaccctgagcaacagagagtgagaccctgtctcaaaaaaataaaaatagatttt

SEQ ID NO: 229017 - DNA, 542 bp, Homo sapiens
atggccagagttaaattcaaaggtgacattaacacatttcagtgcccaataagtgatttttctgctgggtaggagtagatacagatgtgatctcagatacgtgaagctgcatacagaggggcccatccactcctaaacgggtctccaggaggcttggtttgatctactagatttggtgcctcttaaagggaagcaatacagcttttctgctgtgggttgtttgccactaggggaagattcatttctattccagccataaattagaccaaagagagggatttggtttattgctagtgcagaagttaaaaaccatcttcctttcctgagtggtctcttaattagattctttagtttttaaatgttaactggaattgctgaagtttaattcctgaaagggtttagtttttaaaaggagtacctcatttaccatattactgtgttctgagaaatctacagtaatttttgtgtaacttttttattcaaagaatggattgttaattgtaaagccatttagaaaggcgaataaagtcagatctacttta

SEQ ID NO: 229018 - DNA, 448 bp, Homo sapiens
  misc_feature (412)..(412): n is a, c, g, or t
aggaaaatcatttttagcaacaaagtactaagagggtgcatggacaaggaaaacttttccctccctaagcccatacctctagttgataatctgttcccatccccaggtcccagcaaacattctaagacccaagaacaggtttactgggaggaattcgaggcactgcagttcatgtgctgagttaaataagctctggaaatagaagctgaagaatcacaatacccaatctaatttaaccaaagtctaattagagaatttaccagaaattgagagacttgctagacataatttcctgttaggaagtagtatttttctcctttcaaatttttaaatgtttggtataatcagcaaaatagaagtaaattatcaatttaagcttaacagagatattttgttaagtaatatcacagtnccttataaataaaaaatattaattatttccagttaa

SEQ ID NO: 229019 - DNA, 470 bp, Homo sapiens
ctaagttataataaactagtaaacataagtaaagtgtttccctgagttctgtaagccattctagcaaactgttgaacatgaggaggggcgtcatgggaacctaccatttgtagttggttggtcagaattaccgatggcctgggacttgcaattggcatctgaagtggttactgaacccatttatctgtggaatgtgatgcaatttcaggcagtgtcagaattgacttgaattgttggacatccaaattggtgtctgaagaattggagaactggttgttagttttggaaaacaccccagaactttacacccattaggatggctattttaaaaataaaaggaaaataacaagtgttctcaaagatgtggaaaattgaaagccttatgcatagctggtggggatacaaaatggtacaaccgttgcactgaatagtttggtggttacttaaaaaagtaaataactttttaaaaa

SEQ ID NO: 229020 - DNA, 655 bp, Homo sapiens
gagacagggtttcactgtgttagccaggatggtcttgatctcctgacctcgtgatctgcccacctcggcctcccaaagtgctgggattacaggcgtgagccaccgtgcctggcctatgaaactttttaagttgataaatttgtattttttagatatgttctagttgaggaatgagaaccactcctggtctgaattttcatgtgttgctatataaatttgcttttaataaattcttttaaatcaccagattgttaattgacagctattcttgcagacattgttaccttattatttcttcttactatattgggcattaagtcgtttatttcaatgtgataaacatttgactatcaaggatgggggtagatagcacatgacatgagcaaaatctggttccagtatttaagacacagccttaaaaatgtatattccttttatagaagttaaaatatagttttctttgaactcggttattccttgtttaaactcaaaaggagaggatcctattttctgtacataaaattctgaagataggtattttctgtaagagctgagttttttccccatttgctaatcccttctaatttagaggaaaaaccatattatcacactgaatgttagtgatgattgcctatttgtccatatgaacacagta

SEQ ID NO: 229021 - DNA, 286 bp, Homo sapiens
tgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagatgaaaatgcccaagatcagcac

SEQ ID NO: 229022 - DNA, 156 bp, Homo sapiens
tggtggttggtgatagtgctgatgttactctgagcctgtggtgtatgtattgtggcaaacccatgatgttggtggtcttattgggaagagggaccttgggagaaaggagatatagatgatgagattgaaagaggttacagaaaaatactatcacct

SEQ ID NO: 229023 - DNA, 363 bp, Homo sapiens
ccagggaggaacaaaatgagcttttggaagttaatgtaataaaacttctttgtaaataataccttaaaaaaatctcggccaagtgtggtggctcatgcctgtaatcctagcactttgggaggctgaggcaggaggattgcttgagcccatgagtttgagaccagcctgagctacatagcaagactccgtctatataaaaaataaaaataagttagctgggtgtagtggcggacatctgtagtttcagctacccaggaggctgaggtgggaggatggcttgagcccacaaggttgaggttacagtgaactgtgatcgtgccacttcattcaggcctgggtgatagagcaagacccagtctctta

SEQ ID NO: 229024 - DNA, 1139 bp, Homo sapiens
tggggataaaaatgttttcctgataacagtacctttacgtgtaatggttcatgtatcgtatttattacagtgcctgttttatggtaaatattcaatacatattagctgtttttataattaattcctcccactacatcatgatccaaactgactcttttcttaagtgatggggaagggaactgaatattttaaggaagtagctataaaatatgatttcaagttgttctgtagtaattttggtgttccataaggacattttaatgtgaaaaagatactgacagaatctatacatggtttgaatttattagtttctaaactatgaccagtattagcagatttaaaattcataattatagcaagaaaacgtcaaagttgtttaacagtgttaaaatttgaaactgtaatgatccagaaaaatgaaataccaaaccgataattttgggaaaaaaacaaaacttgagtggcattatgcaggccatttactttttaaatgtactcaatataaacaggaatcccttctctccaaatttcagtttttcagaatttgggctgtcatttgaaacacttactttgggcactttgactgttaaagaagcaaagggtatgctaagaacttcaatgagtcttgatgttagtgtttttgtaattaggtggaatctcctaccttttcatgaaaactgggtttaaagcagtagctgctgggtccattctaatgataatctcaaaaatgtgactgacttgtaaaaatctacaattatttattaatgtgagactaggtaaagtatgagttgaaaaactaggaagaaaggcagagtggtgatttttaagcttgtataaaggaaggcccgctttgggtactatgaggtacctttctcactcagaggcatgctgtgaggatttgtgacttttaaatcatttagctctttttataactttgtggaattaaatctaccacgtatttcaagtgtattcaggatatgaattttcctggtagagagttttaacagatttttttctcttaacccttcattgatgaccaaacaattttgttgtctgtaataagaaagtactcggttttgtagggtgtcagtccttaagaaaatgttaggtagtcatcaataaaatagcaacaatctctg

SEQ ID NO: 229025 - DNA, 756 bp, Homo sapiens
tggggtggcatgggcctgtaattccaattacttgggaggctgaggcaggagaatctcttgaacctaggagggagagagaggttgcagtgagccgagttcgcaccattgcactctagcctgggcaatagagctagactccatctcaaaaaatatatatatatacacacacatacacacacacacacactaataattgttaaacaaatgatagagtaaatgatcccagatccttttttatttttctctgaaaacataccctttccccagagttcatccaaaggcgcaactctggtgttcaagctgatctgtttctgttcttactcttctggcttcctattcccagagcctttaaattctggaagaaatcagcctacattctttctagcaattttatgaccccagtttcattaaatcattctcttagcacttcaaaactccatctgttccccaacatgactttccactgagcctagctcaactgcatgcatttcatcatcatccactcctttcaacagcttcacagtgcataaaccacatatgtacctgtaagaccaccaccatatttttcttaccttttcttacattaaaaacaaaaaacaaaaaacaaaaaaaacaaggctgggcatggtggctcacatctgtaatcccagcactttgggaggctgagatgggagaatcacttgagctcaggagttcaagaccagcccgggcaacagagtgagactctgtctccacaaaaaattttaaaaattagtt

SEQ ID NO: 229026 - DNA, 419 bp, Homo sapiens
tccctccgtcctggccatggctcggcttctccgccgcccttcccgctgcttttcggccctgctcggctcctcccgcctggcctcggctcctcccattggccttggcttttccggttcctctcggccgacctcggctcccaccacccgtctttggctcccctcgcccagccttggcttctccgccgctcctcggctcagttcgttcagttcggctttctccgcccggcttcagttttctccgatttcgccgcttcagttcggctctttccgcgtctccccatggcaccctgggctcggcgtggctctgggtctggttgggtccttgtcttagtccgggggagttgcactaattgagttcccgtcattatgatatggaggtgccagtgtctccacatcctggtcaatctgttatcttttta

SEQ ID NO: 229027 - DNA, 281 bp, Homo sapiens
agaccattttatattggaattgagaaaaaaaaaacatcatagtgagggtcaaaattagacgttaagttccagatgtttttaaatttgctttagaaaatcatctttcttattttactgataattgagaatttatcatccaagacatctgcaatttcagattttaaaatttctacaaatgctataattgtgactaaaagaactttctgcatacaatcgatggcaatagctttttggcttccacacacagagtcattaagaataaatgtcagtatttgtaatgg

SEQ ID NO: 229028 - DNA, 511 bp, Homo sapiens
aaaaatagatgaaagtactacggacgtaaaatagtttcatgatatttaaaaccacggccgtattttcaaccagcattcattggaaccggaatctgtatcttggaactgaaaagcgctgatctgaaactaaaccgtgggtggggccctgacgccgtcccctccgtggcacccttccctccgggccagcagagggcgctcaacgggcagtcaaaggggctctcgcaggagtcctgcctatacaaacattttattttagcagggaactgagttgtctatttactcaccagtgtttttatttagccaatgcctttctttgaatatagatgtgctgattagagtgctgtattgttccctctctttatgagccacacatataatgcatcctccatgttgtctcatttgagtttcctttgtgaaatgagaatttagagacagtgtaaaacatcttgactaaagaatcttagattctgtactcataaccatcaaatataattcaacaacacatttaaag

SEQ ID NO: 229029 - DNA, 421 bp, Homo sapiens
tacccaggataaattctctgcatagcactttatactttctaatattttcttgccttttacgtttatttattttctgtctcctcccatttggggaaaggggagggagagcattaggacaaatacctaatgcatgcggggcttaaaaccttggtgacaggttcataagtgcagcaaaccaccatagcacatgtatacctatgtaacaaacctgcacgttctgcacatgtatcacagaacttaaagtaaaaaaaaataataataatttaacgtgtagatcaatatgaaacaatggtcaaatacatcatgtgaagtgagccattttcaatatgaagaatttgatacaatttttgtaaaaacagattctatgtgtgtttatatatatttgtattcatagagaataaattacaaatgtcttcatctc

SEQ ID NO: 229030 - DNA, 155 bp, Homo sapiens
ttccatggagccatggcattgatccaggagctttcaccttttatgtgaactttggtactgtcaagacagagacaattttgtttacatttacccagatacgtttcattcctaagaaaagcctcttggcaatacgtttattcagttctgagaaatgg

SEQ ID NO: 229031 - DNA, 485 bp, Homo sapiens
tcagaaggtggtatactagaaatcactgtactatttttacatcttttctgtaaatctaaagtaatcatacaatttaaaagtttattagagaagaagaataagaattggacttgtaactaaggggtgtgttgcccagtaagtgacagaaaaaaaaaatcaatttgtttattcttctttttcttacccatactgagaataagggctctcaggcactgaaggctgcacatcttatgattgcatctgcatgaaggtcaataataagcagagctaaagtgcagtgctggaagccaggagggcaggcacccttaaagggcatgacagtgacaggggtgggggcacgaggaggagaatgctaaggttatagacatgccctgtttcttgctctggattctggttacatagatgtggtcacctcgtcgaaattcatcttactggaaaattaatatttcttcacttttccatttttgtgttatacttaaatttac

SEQ ID NO: 229032 - DNA, 101 bp, Homo sapiens
ctgacatagggtcagaacctttattgctgagataggtgacaagctcattatgcataatgaacatgtaggaatcaaggcctcaaagcattatgcccatgtgg

SEQ ID NO: 229033 - DNA, 484 bp, Homo sapiens
taaataaagtccagacaagcaacttcaaagaccaaaaggacctaagtgtcagtgttcgacgtctggctattttgaaggaagacatggaaatgaagcgtcaaacattggatcagctgagtgagattggccagtatgtggggcgggaaggggtggcctgctaagaatccagtcaagacacttacattctcagaggtggagccctgaggacatgctcaggggaacaaaaagggtgttttccctgctgttccagcaagagaaagagtaagaaagggctaagtcggccaggcacagtggctcacgcctgtaatcccagcattttgggaggccgaggcgggcggatcacctgaggttaggagttcgagaccagtctggccaacatggcgaaaccccgtttgtaataaaaatacaaaaattagccaggtgtagtggcacatgcctgtaatcccagccacttgggaggctgaagcaggagaatcgcttgtac

SEQ ID NO: 229034 - DNA, 524 bp, Homo sapiens
ccacaggccagcattcatcttcccagtctgaccctctcggaggctattacgctgctgtcgcaagatcgacgaggggagaaaaatgaaaacagtgcacagggaacaatggagggcaaatgggactcttttagaaccggatccactgatacgtcaggccaaggagaaatgaccacaagctctgaaaagtggagagctcccccagacggcaaagccagctgccccggcacctctgcacagtccttttctgaatctgcccctcaccgtgctccccacctgcacgccgtcctcagaacagattgccttgcctgacctcctgaggccgacggagatggtgatgtgacctcctttgccctccatcactgtgcctcccacacctctgcgcagctcgttcattctctctccctccactctgacttaagggaagaggaattttaaaaccaacctcatcccttcccacctcctcaggaaactcactcctttgcttaccctctctccacttttaaaaataacgatataaatgcccc

SEQ ID NO: 229035 - DNA, 478 bp, Homo sapiens
ccacaggccagcattcatcttcccagtctgaccctctcggaggctattacgctgctgtcgcaagatcgacgaggggagaaaaatgaaaacagtgcacagggaacaatggagggcaaatgggactcttttagaaccggatccactgatacgtcaggccaaggagaaatgaccacaagctctgaaaagtggagagctcccccagacggcaaagccaggtgagtgggcttccccactgggctgcccacagtaagaggccaggctggtggggatagaagggtgtctgtctgcagaaggctgggcagcctaggccccacaaaatgagaggaaggttactgaggtcattgctgcccctgcctcagttaaaaaattagaaatcctccccacccagctctgtttgtctccccacaaagcattgcagaagaaaacacggaagccgccagcactattatgcattcatgattccagcttcaaccagtcc

SEQ ID NO: 229036 - DNA, 482 bp, Homo sapiens
caggtcttcccgtgttctctgtcataatgcatttccattttacatgccatgaggacagcatttaggccaggcacagtatccatgtgattgatacccagagatgaccttggtccccacgaggctgagaagctgtggagaacaagaccagaccttctcacatggcgataaggagagattggtttgccgggcacagtggctcacgcctgtaaccccagcactttggaaggctcaggcagaaggatcacttgagcccagcagttcaagactagcttgggcaacatagcaagaccccatctctacaaaaaactttttaaaaattagctgggcatggtggtgcatacctgtaatgccagctacttgggaggctgaagctagaggatctcttgagcctaggaggttgaggctgcagtgagccataatcacctcactgcactccagtctaggtgatagtgataccctgtccctcccctcccccaaccgcc

SEQ ID NO: 229037 - DNA, 512 bp, Homo sapiens
cccaatcagcgttacttggtcgaacggcgcgtcaagttgttccctgggaaacgcagaccttctagagaagggcgaaggctgtggttgttctgggtttagctgttcacgccgaagatccccggcctgatggccaaaatggaggctatttttcgcgggcattatcactcagacaccacgcactgaattattcgtcctcacccgagactcagtttgcccaccagagcgtagtatcgcccccatctgtcaccatagcgactagtggattggagctgactcgttgccatggttgccatagtgatattctctggtagtcccgctgtgttgtgcccaggactcccactggggactgaccccaatcccgttgccatggaaactgggcctaatattgcctggcgattgggccgagattttcccctcccctctttcctcaaagacactgcagctccttccctgtcttcccaagcaaggtttgttatgcccggtcttaaatagagtccagcaaacagcctcaa

SEQ ID NO: 229038 - DNA, 540 bp, Homo sapiens
ctcagaaaccaaacctattcctgaatagcccctttctcttcagccaatttaagcaatcagtagactgttttgtatatgcaacattaactcatttggaagatttatgcttatgctgttgctctgactgagctggtcagaggattttagaagtttccaggcgaatgggtaaaatgtagggagtaagcacactttgaagtgaactgtgccatcataggatcaatgtattcaaatagacactggagaagacatttccactgtttcccatactagttacatttcattgacaatcccatggcttcaataggtgagactctactgtgtcagaaggtagaacaatgagcttcagtcttcttgaacttctcttgtgaaacctgtttccttcctggctttattaaaaaattatgtcttctgtttttggaaaagtagctgtcagaggattagagacaattcattgaattggattacttgttgtcacaaatattataatagtattgtagagcacagaccaacggagagctgttcccatttgctaggatgttg

SEQ ID NO: 229039 - DNA, 552 bp, Homo sapiens
cagttctccgtcttttggctttagcagatctgcttcatttctcctccccacaaagcctggactttgttctgggggtatccctgtttgcagtgaagctttttcactcagtgctcaatctgagcccaactccaccccacatctctgattcatagacttttgtgactgccttgaccagtagagtatggcagaagatgctctgtaacttcccaggctagatctagaaaatgccacgcatttctgccttgctctcctgcgacatccactcttagaacccagttgctgtgctaaaaagaactcacagaccacgtggagtggagcagatgggtcagtgtcccaggtggcagcccgtgtcggcctcagacctgcacgtgaggatgcccaccagagggttcctgccaccaccgtcaagtcaccccagccttaatcttccagccggcgcctcaggcattatgggcagaggtaaactgtctccatgatgccctttccaaatttctgacccacagaatccatggctataataaaatggctgtcttatgtgctcaattatggggt

SEQ ID NO: 229040 - DNA, 663 bp, Homo sapiens
ctttcaggccattgtctctcaagcagaaccttaactgagtgttcacatggccattccacccttcagttgggccagctgcttccagatgagagagagtccatgataagactagcgatttccacgggcccaaggattgtaagaaagataaatcttcatcttccatcacagtgagaaagtggagttcgaagatgtcatcagcccaggtcacacagatggtggagaccagtgtggagcccgggagtgggctgagcagagcatctggactttgagcttccatcagaccctgagatagtcacctgtcctggctgcctggtgaccctggtgtgctaacgtggcacttatcttgctctatggaggcccctgggccccctaaacaccagaacccagttgctgtgctaaaaagaactcacagaccacgtggagtggagcagatgggtcagtgtcccaggtggcagcccgtgtcggcctcagacctgcacgtgaggatgcccaccagagggttcctgccaccaccgtcaagtcaccccagccttaatcttccagccggcgcctcaggcattatgggcagaggtaaactgtctccatgatgccctttccaaatttctgacccacagaatccatggctataataaaatggctgtcttatgtgctcaattatggggt

SEQ ID NO: 229041 - DNA, 592 bp, Homo sapiens
agaggatcaactatgaagacttggttaatgtttacatcaggcacagttcttagagaaggtacaaagtacaggactgtcagctgcattttctgcaaccttaaataaatgagagacttcaaataaacttgttatatcacttgattactaaaaaataagtttatgcctttcatctgataattgtttttggttaatctaggtttaagcatgtagaacttatatttttaatatttaaaaattttcatgattttcttatataagtgtcaaatgcagcatcaatcgtgtgaaactaatgaatctctgtaagtagtgtctgatggcataaaaaaggaaactcttgattgtcttgaactacatgcattgaataacagatgtaagaagatgtgctcttgccctcctatgtgtattagtgtgtatgagctttatatttcatatacacaaacaaatatgtatcgttgtactgattataaaactgtagtacaatattcccagccagtcacaatcctgaatataccttgattttctgccctcttacataggtcccacttaacattaattttgagttttattagcaatataactgaagctgattgtc

SEQ ID NO: 229042 - DNA, 578 bp, Homo sapiens
caatacaagggacttatatgggcctgttcatgtctgtaaagttggcatgtctggaatctgattctgacatgccgagaattggtgttacatgaaagggcacactaaccaaaataaattagagcttaggaaaagagatatatgtagacaaagtgtggactttatcttgactttgtggatcaagtcctggaataaattactccacttctttcccagaagaactttacaaataagagaattcaccagaatttgtggaaatctctctctcataacctcacttaagagcagaattgaaacttgggccaagaataaattacacattgtaagactttattcagggtcttacagcaaaatagtaggacttcaatacactgtttagctcaaagctgtgatatgtcggcctgacttcatccaaaaggctatagaccagattttattttgccttgaaaagctttcaccttcaggaactgtggaaaattctgtgtaatcttctgaaatgactcagaccccaggtaatccttaagagagtagttctctgtcacccttggctgtgctaatcaagaaataaaatgtgggatgtg

SEQ ID NO: 229043 - DNA, 759 bp, Homo sapiens
tcagagagaactgagaactcttctaattggattcattgggtttctcttcactaatcctcacccaacagtgctcattaagaagcttaaagccatcaacttttttccccctagcctcatgtagcgtgatacctgattctgaaatggtctttaaagaccctcacaccagctaatggcatcaccctcgaggggctcagttttcccacgctgaccagtgggggttttccagcttagagcatcatgtttacctgctcgcggggacatggaatgagatggaatgtcctctcctcccaaggccgtttggattcctgactgtggtgctgtagtagcaggagacagggctttagccagctgtgtcctggttaagttacattccccatctggtaatcctttcgtattttatttggagttactcctagccagtttttgtcaggcgtgggagagacaggcagggtgtgaagagggtatttggggtgaggcttacccggtacatctaaatcagtgagcctcaaccctggctgtatattaaagtctctcatgtgattctaatgcacagccaagacggaggagaagtgctctgaattgggagaagcaatagcaagcagggctgagagcagcaggggagccaggtcgggtggcggtggagagccttgcctcgggaggctggggcgtggagttcccgtcccacccatcactcctgcatgaccttcggcaactctgttaccccaccagtgaagtggacagtaaggggccgtaactttc

SEQ ID NO: 229044 - DNA, 305 bp, Homo sapiens
ctcacggcagtttagggtctctggtatctcccgctgagctgctctgttcccggcttagaggaccaggagaagagggagctggaggctggagcctgtaacaccgtggctcgtctcgctctggatggtggtggcaacagagatggcagtgcggctggagtgttaggagggtggcctgagcagtaggattggggctggagcagtaagatggcagccggagcggtttttctggcattgtctgcccagctgctccaagccagactgatgaaggaggagtcccctgtggtgagctggaggttggagcctga

SEQ ID NO: 229045 - DNA, 314 bp, Homo sapiens
catctcacatgaccaagcaatgggacatgtctcttcttacctcatgaaacaccctgccgcaccccgcccccttctgccaccaccaagtgatcatccagctgacacttgaggaactttgatgatgaggagttcatcagtcattggtcagactattaaatctttccacagcttagtgagtttattatagttttcttgatgcataattctgcctgctacagagatagaattacttaaggatgtttgaaatacaggtatacctcagagatactgcaggtttggttccagaccaccataataaagtgaatataacaata

SEQ ID NO: 229046 - DNA, 436 bp, Homo sapiens
cgcagtatgggctccaggatcactttaaactagaacatcactgtcccatgttgaccatgatcaccttaaactagagtgtcaccgcctcatgttgaccgtaaccaccttaaactagagcgtcactgccccacgttgaccatgaccgccttagaatgtcaaaacgccatgttgaccgtgactgccttaaactagagcatcgccgccccaggttgaccataaccaccttaaactagagtgtcactccccatgttgaccataaccaccttaaactagaacatcactgtcccatgttgaccatgacgcccttagagtgtcaaaaccccacgttgaccatgacgtccttagagtgtcaaaaccccacgttgaccatgactgccttaaactagagcatcgccaccccaggttgaccataaccaccttttcttcttgactttta

SEQ ID NO: 229047 - DNA, 467 bp, Homo sapiens
ggggcctaatgatgtcaaagggcaccatctctcttagtttcattctcaagtaggcactctatgtaagagtggagtaggcagctccagacttaggttcttactagtttagtatctctacaggaagagtgttcctcttccttgttcttataaatgtctgagaggctgaccttcactttcatggtggggaaagggattagccttgcttgaagctttgcactaagagtagggaaaatccagggggttaccagaaaaggggagattgctgccggaccagcaaaaatgatatttttatgtcacccagaagggcggaaacatgtaacaagggtgatgggcctgcttcaggcctgggtcagctgagtccagcctccacatgggactggagaactgggtcagctgtctttgtttgggtctcaactcgaatttgaagaaaatgtaattgtaggatttctgaaacaagtttttctcac

SEQ ID NO: 229048 - DNA, 1207 bp, Homo sapiens
cttctcaccaacaaccaattctacagcaaactgtctatcctacaatttaactcaagtctgatacatcctggagtttagggcagaccccacaggttaagggcttagtcccacaagactgccccctacttcacatgccagttgcaaattccaggttgtgatctatcttctgaccagctacctataaatcagtgttatcacagcctccttcttgggttcaaaaatttgctaggatggctcacaaaactcagggatacatttaagtttatcattttactataaaggatattacaaaggatacagataaatagctggatggaaggaatacatagggaaaatatgtgaaaaggggcacagagcttccatgacctcagtgattgcatcaccctccaaacattttcatgtgttcagctttccacaagctcttcaaaccatgtcgttttgggtttttatgggggctttattacgtaggtgtgattgattatgtcagtgaccattggtgagcagctcaactttcagcctgtcctgtcctcagaggtctaggaaggggcctgctggttccaatcctttaatcacatggttggtttcccaggcagacaggtcccatcttgaggctatccaggagcccaccaggattctccccattagaacaaaagatgctcctatcacccaggaaatttcagggatttaggaattctgtttaagacacttgtagtacttaggagattacagaaagttttaggagctcaatgtcaggaaccagggttaaagaccaaatattagaatagaagattcttttagtgtctttttacaaggattttaggagttctatgtcaggaaccagggacacagaccaataagtatttctttttaattcacaattacgaaaatatatttgtagataattttcagaaaagtatgaggcagccttattttgagtacaccttgtgtgtaggagactgtttcaggcactggaatgaaacagagtatgggaaatttagtttcccaggtggaagatagaaaataagcaaacatgaaattgaagaatacttttataaggaaacaggccgacaaggacaagttatacagtacaaactaaacatgttttgtggtggccccaagtgaatagacacagatgaatttggtcttgaatgactgcctcaaggaagtgaatttgaagcagtattttcaaagtgaggtccatggcttt

SEQ ID NO: 229049 - DNA, 465 bp, Homo sapiens
cacacacacacacacacacacacacaccccactctgctacaaccacaacaaacactttgttgttcttcaaatgcaccaagctctcttcagcagtgttttgtagtgcgtataggacatctttgaaatattctggatatttaacctttgtcttcttggcatgttaaaaatatcttctggcggctgggcgcggtggctcacgcctgtaatcccagcactttgggaggccgaggcgggcagatcacgaggtcaggagatcgagaccatcctggctaacacggtgaatccccgtctctactaaaaatacaaaaaattagccgggcatggtggcgggcgcctgtagtcccagctacttgggagactgaggcaggagaatggcgtgaacctgggaggcggagctggcagtgagccgagattgcaccactgcactctagcctgggtgacagagtgagactgtctcaaaaaaag

SEQ ID NO: 229050 - DNA, 320 bp, Homo sapiens
cctcattaatcaaaatatgtataactggatgttatgcaggttctctgaaaaagttaccagaagcttttagtagaaaaatgctaacaatagaatttcatgacacaaaaattagtcagacatcttctggctttgaaaacgatatgtggcatttttaactgccatgagtcataagacgtggcgatcttttgtatactccaccaactttccatttcagcactgcatttcactatataatcatttttaagaaatgttaggtaacaattcacagtcaaatttaaattaaaatccaactatgtcactacaaaagcaaataacaaagg

SEQ ID NO: 229051 - DNA, 969 bp, Homo sapiens
tcaaaatggaattttttttattatataagtcgtatgtgctcactgcaaaaacctcaaacaatagaagcacagtttaaagcagtaagtgaaagtagctgaaaataaccctcttagcagttcatttcctcccagatcccttctgagcttgtgagaccattctctgcgctgtttaatatttgcagtttagaagacaattcctgtgagagaatgaattagagaatcaagtgtatctgagtttctttggcttctggctcctctgagtgggggcactacacatcatctgagaaacacccccaaatcagggcacacttggtataaattccattgaatcatgactctgaagagatcctggccacggtgaaaactgagggcagaaaatgcatcagccagtcatcatccaggcagcccatccctcacccatctttctgctactcaggacatcatgctgggccccacgggacatggccaaggaaacacagtctctccctgcagcttgtcctaacaacaggacagccacgcacccagctcccatgggcgagggcccaggagccctcagactcctccctcacacatcagtctccaagcctcaagggaataaatgaagtaatgaaataaggtagctatcacatgtcacacagtacaactcgagagttttaagtgatcaacacatgttagagtttaataatgataagtgaggctgggtgcagtggctcacgcctgtaatcccagcactttgggaggctgaggcgggtggatcacttgaagtcaggaatttgggaccagcctggccaacacagtgaaaccccggctctactaaaagtacaaaaattagctaggcgtggtggcaggcacctgtaatcccagctacttgggaggctgaggcaggagaattgcttgaacccaggaggtggaggttgcagcgagctgagattgcactccagcctgggtgacagagcaagactctgtctc

SEQ ID NO: 229052 - DNA, 419 bp, Homo sapiens
acaaacataagctcagcttacaaaagcatgaaatttgagctggtgaaactattgcagatttgccaaggtgaaaccactaaatttactaaatttaaatttggggaatttaactttgatgggttcctatataagccagtactgtttaaatcaggaaatggggggaaacacaggtatattcttagtaaattaaaactttcaagctgagtgtgatggcgcatgcctgtagtcccagctgccagggtggctgaggcaggaggtggcttaagccaggagtctggggctgtagccagctaccagcccacttgtgagtagccaatgtactctggcccaaggaacaaagcaagaccccatctcaaaaacaaaaacgccaacaaaaactttcatggccttacctgatcattcttaccggcacaaacagt

SEQ ID NO: 229053 - DNA, 522 bp, Homo sapiens
taaacatacacagtttaaaaataataaaatgaaaaatagacaccatgatgaaaccagtggaaagaaagctacgatcaaaacaattgattttagaacaacaaatattaccaaagataaagctgatcatttcacagtgctaaagtggtttgttgtttaagagaatatgacgatctggttcaagagcttcaaaatgcatagagcaaaaactgatagaattacaataaaaaagagagaaatctgcaactatagttagagattttaatttctttctgtccatgactgataaaagtagacagaaatcattaagtatatagaatacttggatgacactatcaactaaactgacctggttgacatttatagcacactttacccataaacaaaaatcacacttttttttcccaaatgtatgtaggacacttatcaatataaatcataatccaagccataaaacaagtctcaatacttaaaagaagtcaattcttataaagcataatttccgaataccataaaactaaactg

SEQ ID NO: 229054 - DNA, 190 bp, Homo sapiens
actaaaaaataaaaatgctggggttgcatgttaagaaataactggaactaacctgcttaatggactcctcatagatcccttggcagaaagtcatgttctctttagcttgagaagggtactagtcactgattggtgacataagtttatgccacattgatggaatattttagctgctctttatgaactgatc

SEQ ID NO: 229055 - DNA, 354 bp, Homo sapiens
aggtatacttgacccagtctccaagcctcagattggatcaagacacagcctgggctgcaaggaaggtgtgtgcactaaagaagcgtgagccgctgtgcccggccagccctgggattttaaaacaagtacctactatgcgtcaggcactgggctctggagataccatggtaaaccagggggacaacttctttgcttttgtggtgcttatcttctcattggaaagacagaaaataaatgagtaacagaatgttgggtagtgatgagtgctgcaaaaggaaaagcccagctagggggctggggcatgtgtgtgtagtgtgtgtgcatgcgtgtgcatgcatatgtgcattaagaaaa

SEQ ID NO: 229056 - DNA, 520 bp, Homo sapiens
cccatgggaattatcctcatatccctggctgcaaccacagtcactgttgtgctctttgttggattgggcttcattgtgaaagagtgtttcctgcctccattaaatccatccaccagggttatttatcatccccatgtcatggactacagtacaccataaagaggaccccagcagtgactacagttggttctagaaaaaggagacccctcatccgcctctgcaagactatacagcatgatgtgtatcctcaggcctccactcctccgccctagtctggagccctgggaccaccacatgaggaaggcagctggcccctggaataagcatgtggaggacactcagaaggatgcccatctgctctgagtgtctcctaattctgcctgaccttggttacttcctctggacaatcgcctttacctatctaccaggttttgaggaattacacacagctcaggtataagagatattcggtaagtctgatcaaatcaataaagcaaattttatctgtttttgtctggga

SEQ ID NO: 229057 - DNA, 417 bp, Homo sapiens
ctcgtgtttctcgtcacttctctggaggaaagagcagagtgagggagctacaaacaagctttagatgtagacagtctaggttcaaatcccagattagagatctgatcttgaacaagttgtttaactttatctcctttggtttccactctgtatcacagtggttacgatgctcggaactcagacttaccttgttttagttttagccccaccacttctaacttgtagaagttacttgtttgtgtttcactttttaatctacaaaatggggataattgcactatcctcataaaatgaaatgcgttaacatatgtaaagcttttagaaacatacctgtcacacagtctgtgctcaataaatggtggctatcattactattattttcacaattgccatcaataaaattgaggttataataaa

SEQ ID NO: 229058 - DNA, 652 bp, Homo sapiens
atccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttatt

SEQ ID NO: 229059 - DNA, 432 bp, Homo sapiens
cctgggtgacagagcaagactccatctcaaaaaaaaaaaaaaaaaaaaaaggcagagtgcaaattcccctggacttgagtgggcatgagtctccccaacagtgtggagggcccacagctgctccccctgctcccttggatctgcacctctgggtaggttctgtaccaagtgggctgagcccttgagccagggccagctccctccaacctccacatctccagggaggatgcggtctggctcttccaccttcagtgatgctccagatgtaatcccaggagggtgtccacacctagttacaggagtctgagagcctggtgcttcctcagggcccctgagcctcctgggctccaagtgcttgctcctgtgcgcgaagttgcagcagccgcaggtcctgtgctctgggagcacacaggatgattgaggtgagactga

SEQ ID NO: 229060 - DNA, 393 bp, Homo sapiens
ttggctctctctcctgtagcacactggccaggccctggagctcaggctgtcgctgatcacacccagctcttgagagcaaactgaccaccctctccaagggacccacctggaaacttctgcgatccattctattcgttcagactgtaggctgagagtccctttaaactgcactgggctgctatctcttagcatgtatgatttgagtgttcctttaagtgctctacaaaagccagaaagcaggcaggggaaatcctaggtctaagaaattaggaaagctttctatttttgttgggtaagtttgattctgcaaatcattttataaaaatacactgagaaagtagtctagcacacttgctacatttttaacattcctaaagttgcccacagtactta

SEQ ID NO: 229061 - DNA, 944 bp, Homo sapiens
catttctcaaactccccacctcaggtgatccacccgcctcgacctcacaaagtgctgggattacaggcgtgagccacctcacccggccccaaaccctcatttctactagggccctgcactctaggatacggtgctgcagccaacatttagaatgggaggtgacaaggtatctcccaagaggagaagggagcgaggcaagggcaggaagaagaggcaaagcttgaaagttgatagaaactcctcacaaaagctccaaagccagggaaacccaactcagagagcgggagatgtgggggtgtgcttgtgtctagcccccttcattccctctgggtggcccccgctgccctcagagcccttcgggtcttcatgccctcctgaaggacttccttccccgaccaccacagtcctcactgtctgtcctcggattctggatccccctactttcctgggtttgctcctggtgcaggttatttccacgggggccatctcaggttccccagggtagccccctcaccaccccacccggcccccagacctgcccacacttgttgaaccaaaccaagcaccgaggtctccccacacaagcagagctgggggcctgatcctcctggtacctgcacttcctcttgcccatcgggtcctcgaccaaagcccagcccctttcctacctctgctgccacgcgggacagcccagaccccatccaatcccagggatgggtgtccctacctacctgccggcagcagaagacagccgagcagcccaccggggctccttctgcagatgagggaaagcccggataaggcccccaaggtcacaaagcgggctcctggggcgacgggccgagcgcctcccgccccccagggggcgtccggagccgcctcctcctgcagagacctagacgatgacagcccctcctggatgggtgtgtcctgggggcggccgc

SEQ ID NO: 229062 - DNA, 530 bp, Homo sapiens
  misc_feature (488)..(488): n is a, c, g, or t
  misc_feature (516)..(516): n is a, c, g, or t
  misc_feature (523)..(523): n is a, c, g, or t
attgacattatttccttttattttttcctaaatccattttgggaattctgaatacaatctaaatgatctgcaggtttccatttcaagatactgggcagctccacaaaccacaaacactaaacccctccttaccagtcttgtgctgggtgctaagcacatggtaaagaatgggacatagttcctgcaacaaagtaacatgcagcctaagggagaaacagatcagatctaaaagaccctgagtaggccggactctgtggctcacgcctgtaatcccagatgctgtttctctcttggaatccactttccactctacatgtccagccatagtggattacttgtactcctacaaaaagcctctaattctttgtattttggtgttccttctgtcataacctgctactcttttccctcctgggtgacggtcttcatccatagcttaaatattccctgctctaataagacttactggtgggttcttggccttgtangactaataaaagtagtgtgtagtagctnatattancaggcct

SEQ ID NO: 229063 - DNA, 528 bp, Homo sapiens
tgggagagaggggagtctttttatgttgcccaaactggggtgcagggactagtcacaggggcaattatagggtactacagcttcaaactggtggtctaaagggatccttttgcctcaggctccccaaaagctgggattacaggtacatgccagggcgtttggctccaatcctttaatttcaaatgggaaggattacatataattctctcaaaggttatactgcttttatcttaaataaacataaaaagagcgcaaagccaccgttttttttacaaatatccattatgaactcaaatggggactttgcaaacttcaaaaatgtatcaaaccctaacctgggatctttagggccattgatcaattttgggcatacagtaagcactcaataaaagttgttgaatgcatgaaggaatgcataaatgttctttttggatatttagccttactttcccgtcattcagcttagatgacctgagaagcacttcctcaaaataaccctttggctcaccatgagaagaatgcctggca

SEQ ID NO: 229064 - DNA, 517 bp, Homo sapiens
ctaagtgagaaaccatgttgtacatcctgatttaatcatagtgagtcaccaaaagttcttgatacaataaccatttatgagtaccttctgtgtacaaagcactttactaaggataccaaggggtaaattttcagtaaataaatatccaataagtagtacctatcagtaaatatgatcttgcctcctaatttaccttcgcttcctagtcacagtcactgttttggaggctacttgccatggcataaatttatataaatattgccaggaattcattgtatcagagttgaagttttaaaactaaggattctgatacttgtctaagctcatgattcatcagaaagtcatcctgtctattcaacttgcacttttcttgaagattatcacttgaatctcaagaaaaatatttcaaggcctcagcatatctgaaaatgccagccattgagttcaatgtcctgattggagtgatttgggtacaacttggccaaaaaacaagagtacaatttggcaaaaaaaaaaa

SEQ ID NO: 229065 - DNA, 189 bp, Homo sapiens
aaatgtttattaagcctgacaaaattcaaaagagagaagacacaactcactaatatcaaaaataaaatgagggtcatcactaaaggtattacagtgataataagagaatactatgaacaatttacactcatacatttgaaaacttagaagaaatggaccactcacaaactaataaaattcaactaaggt

SEQ ID NO: 229066 - DNA, 393 bp, Homo sapiens
ttggaaatggaggcatggtgggtgtgttgggggagggcttatggaatgcaggcaatattctatttcttgacatgggtgatggtttaggtgagaattgcttaattcgtatcaaaactgtaaataatgttttacatatttttctatatattatattgcacagtaaaattgctaaacatctatctatctatctatctatctatctatctatctatctatctagttatctatctatcttatagtaaatctactaaaaggacatgtcaaaatgttagtagtagctatttggaggtgacatgactatgggtgatattgttctttattttttctctatatgtcctaaatattcttgtatgtgcatataataatttcataattaaaaaaaaacacgtttta

SEQ ID NO: 229067 - DNA, 420 bp, Homo sapiens
aggcggaggagagcccccaggttttttgcgacgtgaccgtgagccacgtagctgcttatcttgcatgagttagaatctcttcagtctacacaccgcttgggccagcccatctactcgtctggttggaattataaatgactcccagatctttatttccgacccagaatctctcctgagcgggcgactcgctatccagccgccccctttgctgtcgatttggaagtcactcgttcaacagctgttcattgcgcctccctgtgccaggcattttgatcggtgctagtggtaaaggggatgggcaaggttcctgcctttagggcactcacagtctagcggggagactaactgtaatcaaataagcatactaagacatgtacaacctcaaacttaaataaaggaactgaagttataggaacttca

SEQ ID NO: 229068 - DNA, 353 bp, Homo sapiens
actttatcttttataaattaaaattttgatttctatatactttttcctgttttatgactatttcacatcatctcttcgatttatgggtggactcttctttaatatatctaggagaatattaactagagcttctttttacatgttcttctactgcccacattaccaagtccagtaattgttttctttcttattatggcctattttgcctttcctcaaatgttggcaattttttgtttggttatttgcgtttatcgaggaatggctggctgactaggtagctggtgagggttttctttgcattggataggtttcttgactatagctcctcacctatgaatatgagggctaagtga

SEQ ID NO: 229069 - DNA, 412 bp, Homo sapiens
aacttcatccaagccacatttcatccagtgcttcgggaaacctgtgaatcgtgcatgcttttgtgtgctgctgttacttttctcccctctggctctctgtctggcactttttccttgggaatcctttgaaataaatctttattgattctactgattacattcactcctggcatttttgacagccaggattgttaagtttctgaacagtaccaacattctcctctcatccttacctccgtctccctttctgagtaacaaataataaatagcacaaagtttttaagaacggtccaggccgggcgcggtggctcacgcctgtaatcccagcactttgggaggccgaggcgggtggatcatgaggtcaggagatcgagaccatcctggctaacaaggtgaaacaccgtctctacta

SEQ ID NO: 229070 - DNA, 433 bp, Homo sapiens
caggtctctcttgaggtcagaatgaatgttattgacattattgtttgtattgtggtaaggtatacataatggaaaatgtaccattttggctggacatggtggctcacgcctgtaatcccagcactttgggaggccaaggtgggcgcatcacctgaggtcaggagttcgagaccagcctgccaacatggtgaaacctcatctctactaaaaatacaaaaattagccgggcgtggtggtgggtgcctgtagtcccagctacttgggagactgaggcaggagaatcacctgaacccaggaagcagaagttgcagggagccgagatggccccactacaccccagcctgggtgacagagcgagactccgtctcagtaaataaataaataaataaaaataataaaataaaatgtaccattttaaccatttttaagtgta

SEQ ID NO: 229071 - DNA, 446 bp, Homo sapiens
catgataaagaggacatctccagatgggggacatgacagactacccagcaaatgattttggagaaaacgcctatacatttgaaaattaattatggttctatttcacactctacccaaagacaaatttcagatggaccgaagatctaaacataacagccaaaacaaagtattgggtaaaatctatgtgaatatttttgaatctcaggaagaggaggtgatcctagtgcatagcacaaaaccccaaaggcataaagaaaaagatggacaagaaggaaatccaatgtttttcagtttttaaaggaaaaataactaaccactgaagaaaagccaatatatatacagggagaaaaactttaagatatatcaacaattaataccctaaaatgtgaagtattccaatgaatttgtaaaaaaattaaacactctattaaaactttaacagtgta

SEQ ID NO: 229072 - DNA, 287 bp, Homo sapiens
tgaatattttcctgaatattctgaatatcatcctgaattgctgaatcctgaatcatccatcaatcctgaatatcattcatgaattgtgcttcatctgacttcctaaagataatggtttatagttcaaagtttaaaaagcagtttatctaaaagaatgcttgaaaattactgaagctaaaattaatcatcctacatttaagcaagcaatttaaaaacttgttttcaatttccaggttatttttaagatgtaaaatgacaatttccattgtatgtttctcttctactaa

SEQ ID NO: 229073 - DNA, 450 bp, Homo sapiens
tatctctaaaaaaaaaaaaaaaaaaaggaaatccagcctggatatggaggtctgttctatggacacattacttaatattaaagggtaagtattaatagtaataataacagcagctgacacatagtgctttctgtatgcaaagcactgttctaaatgttttatgtgtatttatatatatttgattctcataacaactctatgaggtaaatactattattatctccattttatagatgacgaagctagggcactgagagctccagtgatttgcctgaggtttccccatcattaagtggtggagccaggtttcaaactcaggcagtttgcctttcagtccatgctgttaatcactgtgccatgttgctgctcattcactccaagaagattaatgactagagtccctatcagcaggaccaaaataaaatgactctcccaaggagctcagaaatg

SEQ ID NO: 229074 - DNA, 392 bp, Homo sapiens
caccctccttgcaagaaaaatgaattccttggctatactcactaggagttgtacaccttttgccaacctctggaattgactgcatttttaggggaagtttccttttctctgttggtttacttctacagggtatacttctgatttagtggtatcactttcagagtgatgccttgatattacccatgcttggaacgtgttgtttggagtaaaagtgattttttttctcttcattctgaaaatcttttaaggtgattcaaaaattaatagtttgggaatagacacagtggctcatatctgtaatcttagtgctttgggaggctgaggtcgggggatcacttcaggccaggagttcaagaccggcctgtgcagcattgggaggcatcgtctctaca

SEQ ID NO: 229075 - DNA, 363 bp, Homo sapiens
accttcttttccaattttaataataaatgggcaagtgcaacagccacagcctgaagagggcatggtgacctggagtttggagctctcaagagtgagagtctgggtcacctcaccagataagccacctagatgaggaaaggagcagaccaaggctgaggggcatctacaatgggtggtagaaaaaggagacaatgagcacctctgcaggtgtgagaccagccacagcttcagggcatgttgtttgtccttttaaccctcttatcataattttccccaaaaaaagagattaaacaggttcctggatgaactttcccagatggagcagacttactatgcagagcaaacggatccaaaaaaccaaaa

SEQ ID NO: 229076 - DNA, 448 bp, Homo sapiens
caaacttatgctgagaaaaattccaccttcctgtttttaattgctctacattttaccccaattacaaacatcaaactgtgttcattatggaatgtatggaaaatatgtaagtatttaaagcagaaataacaacaacaatattaattctgctttctacaaaacaccatcagtttttagtgtatttccttagtcttttctatttagacatgctaacagatgggaagtatagtcatatttttatatacttaagattatatgcagtattgtatcctgatttttttccacttccttcataagtgtttctccacatcatcaaaaccttttatgtagtttctttatgctatgtatacagtataatttaggtatactttcctttatatttaaacattgatattgcttttacttcctgccattgtaaaaactgttgtgataaacatctttctgcata

SEQ ID NO: 229077 - DNA, 347 bp, Homo sapiens
tgaggggagttcgagcttttgctttcatcaggcagaacaaatttccgaggaatcaaactgacttcaaacattagcaattagaaaccaagaatccgctggcttgaagaacttttaatccctaaccatttccaaatgggtaaatctagggtcagtatatatcgtagctagtctgttaaaaaggaaagtcatcctgtgggatcgtgacgtggaggatccctgggtgcctaagaggcagggacgctgacgcccagaaagcgggcattgcccaccgagacaaagaaaagcaaatgattgtccttcccgctgctcttggggattaaaaaacaatgaacgaattcttttattaa

SEQ ID NO: 229078 - DNA, 506 bp, Homo sapiens
ggcaccctccacttttaaagtattctatcctaccactgccagactccaccttaagtcccaatctggtgtgatttccacatgactgaacaccattccagagagctcatctctagctggcacccctggttggcctcctctgttctaacattcctaagcatggaccactcatacctgcatgtttcacatttccctgagggctggcatctcgtacctcctccaccaggtttttgagcaagagcttctttcacttcaaccccctctggggagactctgtaagcaggcctatgggaacaaacagcatctttgtcctcaccctttacatccaagtacatctgaagatatctgttataaagagagtggatttctaaactttggaaattggaaatttccttagtccaataatcctttaggggcactatgggtcatcctggctgtatccccatctcttcagattgcccactaacctagatcaatgggcctactaaagcagcttttgttctaataac

SEQ ID NO: 229079 - DNA, 451 bp, Homo sapiens
catgtgttttttcattttcatcattttctagctgtttttagttgtagtttctatcttgtcataaaatcaagaagttgggccaggcatggtggctcacgcctgtaatcccagcactttgggaggccgaggtgggcggatcacgaggtcaggagatcgagaccatggtgaaaccccgtctctactaaaaaaaattagccaggcgcagtggtgggtgcctgtagtcccagctactggggaggctgaggcaggagaatggcgtgaacccgggaggcggagcttgcagtgagccgggatcgcaccacagcactccagcctgggccacagagcaagactccatctcaaaaaaaaaatcgaggttggtgttcttgttttcattttcaagtgtttgttttctattcttgtagtctattatacagccaataatgtaaaaaataaacttacattaagtata

SEQ ID NO: 229080 - DNA, 296 bp, Homo sapiens
ataggagatactgcatccatattggtataaataaataaatgaataaatggaaaggatgaggattggaatgcacatatcatttctacttaactccctcattaaacacttattaattacaaacggaaaagactaactttcagcagagaatcctgacaccatctcgatgaagataaaatgagcatcattagaaatgaaacaaatcaattagttgggtgtgctggtgtgtaagttccagatattcaggaggcggaggcaagaggatcacttgagcccaggagtttaagaccagcctggac

SEQ ID NO: 229081 - DNA, 382 bp, Homo sapiens
ttggggccagttctccccctcagcctggaagcctcagtggcatgtcggatctgggaggcaaggcagccggtgtggtggctgcaacccagggctgcaagtcagcaggccatcatcaagctgctcccttttggtggtgggcttctctgagcccagtttcttcacatgtaaatggaaaatggggtgctcacatgtgttttgtcagtgtctgggggctgttttggggctccagtgacagcctgtgcatggagagctgtgaaaggctgagggcagcggagagggcccttccctgaggctcaagtctggttcctcagactctgaagtttcttgcatctgtccttttgccacagagcacttaggggtggctgaggggagcacagaacct

SEQ ID NO: 229082 - DNA, 370 bp, Homo sapiens
cccgggttcacgtgattctcctgtctcagcctcccgagttcccgagtagctgggattacaggcacacgccaccatgcctggctaatttttggtatttttactagaggcggggtttcacggtgttggccagactggcctcgaactcctgacgttgtgatccgcccacctccacctcccaaagtgctgggaccacaggcgtgagccactgcaccggccacccttcaacttctttaaaaagtcatgttggtttggtttcatttcaaactattctatccctctttaaaggtatttgaatgtagaacattgttaagaaaatgaacgaggatcttttctacatgagcgccatattctaacaaacttatcaaactgc

SEQ ID NO: 229083 - DNA, 211 bp, Homo sapiens
ataaggactggaagtttgacagcagggagaaagtactaggaattcaaagcagtactctcttccaactcaagggaagtaacattttaagagaaaaaggagtctggatgtgcctatattttatccaaacaagtgtgtttctcaaagatataatttgggagccctgctttgtactataacacattacaataaaaagccaaagataagagtataa

SEQ ID NO: 229084 - DNA, 516 bp, Homo sapiens
ctcatctctacaaaaaaaattaaaaagttattcggcatgcccttgtattcccagctactcaggaggctgaggtaggaggatcacttgagtctggaaggttgaagctgccgtgagctgtgatcacaccactgtactccagcctgggtggcagaatgagaccctgtctcaaataaataaataaataataaaatttttaaaaatcataaaatttgaagcagttgagcattttaatatgaaatgtgagaccattgcacattttaatattagtttaaggaattaatgtcatcttttcaggtgtgatgatgctgtggttacacagtgctttaaagtgtttagcctttaatcctacatactgaaatgctgctggaggaaatcacatcatgtctgggatttgcttttccacaggggtgggtatagtatgtgtggatcaggcgaaatgagattagccctgagctgaagctggtaatgagaactcattgtatgcttttgtctgctttggtaaatgttaaaaactct

SEQ ID NO: 229085 - DNA, 263 bp, Homo sapiens
actggctttgaagtctggctgtatcattgtttaaccagtaaccttgagtaaaccacttaaccagcctagacctgtttgctcgtctgtaacgtgaacatgtctgtgcacatggtaaggattaaatgaagtggctgtgatacagtcttatgggcgtatagtaggtatcagataaatggccattccatccttattcttttccaattctgctaatataaaaatgatgtcaagcgattctcctgcctcagcctcctgagtagctggga

SEQ ID NO: 229086 - DNA, 603 bp, Homo sapiens
ctcagtccgaagacttagctctttggggaagccattctgacatccctgacttccccaggctgagtgaggtgcccttatgctgcattccaaagacactttgaataccttttggtactcacgcttcactcagatcccccaccagattgagctccttgaacccaggaactatatcttccttttctttacatccccagggcctagcctgggacatggcacaccacagccaccccataaatctgtcttctcagcagtttcagcccatgagtcagctatcctcaagcagaaaaaggaaatcagcaaagagctattagggtgtggcacttccatttaattctacacatttattaagtatctactgttgtgccaagcactgctggtgtttattcagagataaaaaagacgaggtccctgatctcagagctcacagtctggcaaggtaaagaccctatggacaggtaactgacaggtagcatcagatgctctgaaggtacagaggagggaggggtccattcttcctgcaactggagttagtggtgcagtggtgccagtgcagttggagttagtggtgccagggaaatccttgcagagagggggttcatttca

SEQ ID NO: 229087 - DNA, 251 bp, Homo sapiens
taattccaaagcagagtccacagtgggtcttgacatcaatgtaaggggtcaaggccatcttttttactaaaggaagacagagcagaccagagcacagcagatggcgagtacgaggatgatctgagaaacttcaatttcagggtttgagtttgacgtgtgtgtttgtgtacatgcacacgcaggccacatcccattgtaaaatgtatttaatgaacgctgaggattaaataagactctgaaagcccctagag

SEQ ID NO: 229088 - DNA, 381 bp, Homo sapiens
agctgaggagaggagtatcggagatgagcccagctggaagatgcttcctgggagggcctgggggggccatcaggaggcccccagctagaaggaagctctccccactgtagatgaaaatggcttccagctcttctcactagggctctgtgggtgggggctacaccgatggggccaagaagggaaggtcacagaaactcaggacggaccccggcccctctctcctccccacaccaacctggaccttgctgtcagagcccctggtgtgaccatcccacagcaaaaacatccagaccagcccagtggcaagggacccccaccacccctcttctgaggagaccgcttttcccaccaacggaaataaaagcaccgcaaaccagggaa

SEQ ID NO: 229089 - DNA, 425 bp, Homo sapiens
cttgaccctttctgttactgcaacttttctttgaaagcagaccaaagtaaactgccttaagaagagccaaatcattgtgataatgacacatggcaggaaggatcattttgagggttatttgacataatatgtgctgtcagcacagtgcctcacacagggtaagccctcaataatgtccttgttattgatcagtagtagccaagatgtcacagcttactccctgtgatctcaaatcaggactcaatcctgagaatctggcaattgcttaaattgtagccttcgtctgccccatgtaaatagttgctgtgtatgttattctgttggtactttgcacaaaaatattttctcaattttttaaaaaattgttttccaaactgagaatggtattaatatggatttatgtaaataaagggctcagagataaa

SEQ ID NO: 229090 - DNA, 479 bp, Homo sapiens
ataattagcacatttacgaatcaatgtgtaatggtcacatgtagattatttgcttatataatctccttcatatttgtttacataaaatctccttcctaccttaattaaaaatgtatgcattgaaaatgatggtcatgaagactaacaggaagaaacaagcttataaaaaaagtatagttttatttacctaattattataactattaaaatatgtatttgaaataagatcggaagggggatattcagaagtgatagttatgtttcagtattatagatgatagttataatgtttactctaagtgaattataacactgttatattaccataaataaaaagtgagtacatgatgaaatctggctccttgtccaaaatggaagacttatggatatgtaaacatattttcattaatttataaccataatgaaggcaaagtctctttactaagtatttgagctacatataagtttacagaggatta

SEQ ID NO: 229091 - DNA, 363 bp, Homo sapiens
agttctagtgccctctccttccccattctgtgcggaggcccagcctgccccaggcctgcccacaggggctgccagggaccaaggcctggctctggattagaggtcaccagaccacagatgatttgcacaccatttttttcaggacttgtattatgtggaaaagtgtccacggtcaggggctacagacatgtttctcaggctgtctttgattttctgctctctctctctctctctctctatctctctcgcctacaaataaatgaggacctgatttcccaagagatctgggtctctttcttcttcccgcggctctgtcaacagtggcctggggcctgtgaaagcgggcccttctccctgtctaat

SEQ ID NO: 229092 - DNA, 376 bp, Homo sapiens
tctaaagatatgattagactttgttaataatgttcaacttttcacaaagatggtgagtgccatcttaaaacttattggagagtggttttatatttagatttatataactggttatgtgaatatatttaaatactggggaaattccttcactgtctcaaaaccatgcaagattcacatatattttgtgtttatttgcttcttaaaggccagggttgaagataaggtagcaatgtttactttatatttttggccttaactatgccaatctaattagaattccctgtatttaaaatggttccttttacttattgaatggtattttagtgtggtttatgtgtaatatcaaataaagattatttaacacttaaaaaaataa

SEQ ID NO: 229093 - DNA, 478 bp, Homo sapiens
agttgccttttgattgagttcttgcaaatctcacaacgactttattttgaacaatactgtttggggatgatgcattagtttgaaacaacttcagttgtagctgtcatctgataaaattgcttcacagggaaggaaatttaacacggatctagtcattattcttgttagattgaatgtgtgaattgtaattgtaaacaggcatgataattattactttaaaaactaaaaacagtgaatagttagttgtggaggttactaaaggatggtttttttttaaataaaactttcagcattatgcaaatgggcatatggcttaggataaaacttccagaagtagcatcacatttaaattctcaagcaacttaataatatggggctctgaaaaactggttaaggttactccaaaaatggccctgggtctgacaaagattctaacttaaagatgcttatgaagactttgagtaaaatcatttcataa

SEQ ID NO: 229094 - DNA, 898 bp, Homo sapiens
gcatgagccagcacccctggcctaaatcctcttcatgtctccaaagtccttgcctttctttcctgtcctataaccacctttcctgtcctatatcctgtccttgcccttctttcctatcctatatccacttggctattagtgctcatgtgactttgtgtaaagcagagataattggaaggcaatcattggacctctttttcgtcattatcctccccatccagtttaggttctcattctttcatttggttctccttcttccattgtgggcattataaatgatgcctataatccacccacaccaacactgtacatgtttctactgatccatgtcacctgcttgaagaccctggctccttgctgggcacaggaccaagtctgtaccttgacattcaaagattttcaggctgtgcttccactttcccggaactcttcctccaccggtcctgcctctgcagcatcgtgagtctctcctggggtccaaacccaccaatccctgcctccagccttgcccaccaccctatcccttacccctccccaccatcagcctcccaaccacccttccaggctttagacccacttcatccactgacaacagagctcacatgggctgggctggtatcttcctttagttttgtctgaagatcaaactgtgggagaaatgttatgtatgaaggcctagctgtagtctcaatgcagtgccaggaaataaacttcaattcataactctgccataagggatttgttctttccatttgtcatcacggctatgatcctgagagggatcctcttatagcaaagaatggtgccagaagagaaccagggtgaattgtccggtcgacagttctaatttcttaccggcatacctttgggcttcctgagcaagcctgccctccccagc

SEQ ID NO: 229095 - DNA, 496 bp, Homo sapiens
tttggattctagaattatggccctatgcccaacttcaactgaaatgaaatgatacaaagaactccacaaataactgtcaatccttggatacagtttatatatttcataattccaattagatatcatcgctttgagtccctgccttaccctatttcagtattacccaaataaatagacacaactatctgacagctatagcgtttgacttatggcttataaatcagctttattatttcattttcagctctgtttgattgaaaccctttttggtcaatttatataattctttttggagcaatttttcctcctttgttatataatcattttagagcacgttccaaacattaccaaatccagattttaggtatcaaaagtcaatactcttgatattagtatctgtgtctcattatgttgactcttcatgtacatctcactactttttaaaaaatatttttatttgtaatttttttggtatgttgtaagtgtatatatttat

SEQ ID NO: 229096 - DNA, 90 bp, Homo sapiens
aaataatctttaggtttaatgagacctcaagaactagaccagcttgaagcatgccatcttacctagttacttaagaagctagtttttcct

SEQ ID NO: 229097 - DNA, 207 bp, Homo sapiens
cataggaaatcaggtatacctggtctcacaggaagaggctgtttataatctagattcaaggccagccaatatatatgctggtgactgaccagtcaaaattttgatggctcaccttgaaacacaactataaatagatggttataggtttcagaccttcaaggtcatatggactgggagacaaaacagtggctaatttggaccagtggc

SEQ ID NO: 229098 - DNA, 417 bp, Homo sapiens
attatagaattagtaagttaacattgatgatgtgttatctagtctatatatcttactacattttcaccagttataccactaatgttctacatagcaaaagaaagcttttcttggtccagcagacaagctgggtttatgagttgtatttatttctcatgtgtttttagtctcctttaaaatggaatgatttgtcaatctttgtcttttcataactttgacattgaaagagtactgggcaattttttgtagaatgaccttaaatttacctaatgtttcctcatgactagattcacattaggcatttttgcagcaaactccacagaagtaatgttgtatcctactcagtgtgtcatatcaggaggcaaatgatttgtatatatcctagcttgtgatattaaattttttcacttggttaaa

SEQ ID NO: 229099 - DNA, 947 bp, Homo sapiens
caagatcaaacaaatcatgggtctgattgagattagtgaacagccatccttgttcttaattcaagtggagaattacttgaacatctcagagatgactagtgcttttatttttttaaatatgtttaaattttaattaaatatatagggacggggtcttgtcatcttgcccaggctggtttggaactcctgggctcaagtgattctcctgtttcagcctcccaaagtgctgagattacagacggagccaccatgcctggcctagagtacttttagagtttagtctcatttcagttactatctacatttatcatcttttgccagtgagtattaaaacatcaagaactaaatggtttgaccctaaaacctccacttaatcccagttacctatgaggaatacactattagaacagagagcagaagcatgattagtttcttttagagccccctctgatttttattgaacttgctcctactcctcttgagcttggcgtatgcataggaatgtttattttacctgttttaagtgacgtttacttggaagcatttgagtagtttataaatacatggtgtcatagtattggcttgtgtcaggaagacttgcttaccacaaagcagtgaagtctcagtggaaagctggcccctggtctacagagtgacccagagctgggtcatggctggttcaagagcgtctcacattcgctgtctatcttatactgtctggatcttgagtttttgcatgtgataagccatccactttttgggaatatatatgctgtctctgtcactgctatctgggattcagtttctagtttctgaccatagctcctcactcctaccttgtaggctcctagctcagtccctttctctccttctggatatttagttaaaagccttgccatcagatcaaaccggaaacaaaacttgatttgagcaaggtctgcatgtgt

SEQ ID NO: 229100 - DNA, 892 bp, Homo sapiens
caagatcaaacaaatcatgggtctgattgagattagtgaacagccatccttgttcttaattcaagtggagaattacttgaacatctcagagatgactagtgcttttatttttttaaatatgtttaaattttaattaaatatatagggacggggtcttgtcatcttgcccaggctggtttggaactcctgggctcaagtgattctcctgtttcagcctcccaaagtgctgagattacagacggagccaccatgcctggcctagagtacttttagagtttagtctcatttcagttactatctacatttatcatcttttgccagtgagtattaaaacatcaagaactaaatggtttgaccagcagaagcatgattagtttcttttagagccccctctgatttttattgaacttgctcctactcctcttgagcttggcgtatgcataggaatgtttattttacctgttttaagtgacgtttacttggaagcatttgagtagtttataaatacatggtgtcatagtattggcttgtgtcaggaagacttgcttaccacaaagcagtgaagtctcagtggaaagctggcccctggtctacagagtgacccagagctgggtcatggctggttcaagagcgtctcacattcgctgtctatcttatactgtctggatcttgagtttttgcatgtgataagccatccactttttgggaatatatatgctgtctctgtcactgctatctgggattcagtttctagtttctgaccatagctcctcactcctaccttgtaggctcctagctcagtccctttctctccttctggatatttagttaaaagccttgccatcagatcaaaccggaaacaaaacttgatttgagcaaggtctgcatgtgt

SEQ ID NO: 229101 - DNA, 317 bp, Homo sapiens
ctggccaagagaagagaagatggagcggccattttgatcatgcctagtcccagaatatatcagctgtgaaaataagtgaaagaaagattttcttatctccaacatttctgggaaggggtgtgtctgtggattttatgttactggaaagagacaatccagtagtccactttgtcaggagtgtttcaaacaacatctgtgaacccactggacttcaagctcctacaggctagagatttggtctatttcatctgcattgtgaaaggtcctggagactgagaatcaggaattactagactataatggatgagatttataaa

SEQ ID NO: 229102 - DNA, 663 bp, Homo sapiens
ctgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccaaaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtggtgttccctcatccctcccatccatttcactgtgtgtggatggatagcagagggtaccacgcattccttgatgcagtcctgtgtgattcca

SEQ ID NO: 229103 - DNA, 452 bp, Homo sapiens
acaggcaggtggacctgggccttggggaggcagtcctgccccagcaggacccttgacccaggggaggcctgtgcccttttctctttctctccaccctgcccttgcggttgtggggacaggcacgcacgagtccctatcttccaaatggaaagaatagggtggaaggagctgggagcagtggctcacatctgtaatccgagcactttgggaggctgaggtgggaggatcgcttgagtccaggagtttgaggccagcctgggcaacatagggagactttgtctctacaaaaaataaacaaaactggccaggcttagtggcatgcacctgtagtctcagctacttgggaggctgaggtgggaggatcatctgagcctggcaggcggaggtttctgtgagctgtgattgtgccactgcactacagcctgagcagcagagtgagaccctctgtcaag

SEQ ID NO: 229104 - DNA, 231 bp, Homo sapiens
agctggatgaccacagtaacaataagaagctgcctaccagaagtgtttccatgacaacagttgggtactgtgggatactgaatttcctccccaagaactgaatagagaggcatgccagtgttttgaaatacattataaagcttttcatattttgtactctagataagccttctattttcctatttaaattaacttgggaaattgctaaagagtgaaattactttggggtgg

SEQ ID NO: 229105 - DNA, 174 bp, Homo sapiens
ttgtaacctacaaaattgtcatctaaagcagtgattcccagtctatcgcagaacaagaaaaatatggaaaaacggatgtttctgagattcatgtttttaacaacacaattgtaatagggcattgtacttgaccaaataaactggcagtcttttgttggtccttttttaaaaaaa

SEQ ID NO: 229106 - DNA, 698 bp, Homo sapiens
cctgccaagcccttcctctcttctgttctgctctcctggaaagttctggacttctctggcccagggcctcaggggactggccagccctgctcctgtgggcactgggcagagggacaaggcggaccacctgagcctgctggagggccggtatcccagggcagtagtgattagggaatgtcactctggccacatcccagcctgggcgggcctctatggggaggtccccgtttgatttggtttggttgtccacagtcagagccaagctctgggcatggagtctgggatggcaccctgaccccttgccttacaggactttgggcagccttctttggcactgtgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtcttgaagtgttcggaaaattgctttcatgtgctgaggaggccctgcggaggcttccagactgagctgcctgctcaag

SEQ ID NO: 229107 - DNA, 819 bp, Homo sapiens
cgtacgcattcagagatcgcattctttttttgcatccagttgtcctcactggcctgtgacgcaggttgccctacttgatggatggatgagaagagaaggagagggatgggaagcttgggtcgtacttcagggttaaggatcccagccaaagggctttcctagaaagactctctggtccgtcaccgcttttgtcaatcttcagtgttacatgttcttcatctttttttccttgtaaagtaatgatcggcaggtacttctaatttgcctgcagaatatgtattctagactctttcatatatgaatatttctaacagaagcaaaatctgttaattattctttatcttagtactaagcatctttattagctagcactcaagagctaaacctttaaaaaagtaagaggccaggcacagtgtctcacgcctataatcccacaactatgggagactgaagcaggaattgcttgaggctaggagtcagagaccagcatgggcaacatagcaagactctgtctctacagaaaacttaaaaaattagctgggtgtggtgacacatacctgtagcccctgcttctcaggagaatcccttgtgcccaggagtttgaggctgcagtgagtcatgatcgtgccactgcactccatcctgggtggtaaagcaagaacctatctcttagaaaaaaaaaaaaaaaaagccaaaaaattaatttgaaaacacaggtgtttgtatgagggagtacttactcgtgtgcttctgcttgttcaccaaactataaatgatatcagcagtttccaaacatagagtgacacaggttgtgaatgg

SEQ ID NO: 229108 - DNA, 601 bp, Homo sapiens
tactttacataaagactgggaagcatccaccagcaaaagcccagatggagaggggaggggtggttcacttcttgtctctgccacatcactcaatcttgtagaatattaggtttctcatttgtcaaaagaagacagcctcatcaagttttaaaggtgcatagtatgtataattttaaacttgaaggccaggcacagtgtctcacgcctataatcccacaactatgggagactgaagcaggaattgcttgaggctaggagtcagagaccagcatgggcaacatagcaagactctgtctctacagaaaacttaaaaaattagctgggtgtggtgacacatacctgtagcccctgcttctcaggagaatcccttgtgcccaggagtttgaggctgcagtgagtcatgatcgtgccactgcactccatcctgggtggtaaagcaagaacctatctcttagaaaaaaaaaaaaaaaaagccaaaaaattaatttgaaaacacaggtgtttgtatgagggagtacttactcgtgtgcttctgcttgttcaccaaactataaatgatatcagcagtttccaaacatagagtgacacaggttgtgaatgg

SEQ ID NO: 229109 - DNA, 218 bp, Homo sapiens
ttaacttctaaagaactttgtgggataaatacagttattttatagatgaagaaactgaagcacagagaagttaagtgctttgtccagggtaacagctcagatatggcagagtcaggatttgaaactagaccctcacataccttaactgctgtgctgtggcagtgtttttcatactgtaggttgggaccagccttctcttatgccctcaccccctgcca

SEQ ID NO: 229110 - DNA, 612 bp, Homo sapiens
aaagatggagtcttgctctgttgccaggctggagtgcagtggcacaatcttggctcactgcagtctccgcctcccgggttcaagtgattctcctgcctcagcctcccgagtagctgggattacaggcgcccgccatcacgtacccagctaatttttgtatttttagtaaagacggggtttcaccatgttggtcaggatggtctcgatctcctgacctcaggtgatccgcccgccttggcctcccaaagtgctgggattacaggcgtaagccaccgcacccagcccatatttgttataactatcttttgggaaaggatgccattcctaaaattaactcccttctggcaaatttctccctgccaggtacctaacctccccagcatgatgtttttctaccatttgccttttggattcctagaagtattttatttggatgtgactggtttgaatttggagcttttagagcaagacatttggaaagatagcatgtgagtgaatttatgtatggaatgaatgacatgtgagaaaactcttgttagacatgatgtttcctatacagaagaaaagatacaaacttgattgcttcagtaaaaacacttttagagattgtgt

SEQ ID NO: 229111 - DNA, 603 bp, Homo sapiens
gtgaatcagagtataaatcaaacaaggctggccaaacatgctgaagtagaggaataggtatgtgaggatgcattatgcttctctacttttgtatgtttacaatttcctataatagatatctgtgaatttgcttagtatgctttctgtaagcaaacatggatgaagcagcacatgaaaaagaattttaaccaacaaactagcagaaaataatgtgacagacgacttttagaggctttggagaaactgaatgctaaaggtgctgtacagccagccccagtctttctgacattctggcagtgtctttctcaattgcagctcctcatctgagccactgtccagaaaataatttgagtaactttaatcctcaattctcccaaggatagtaccattctagatcttactaatttattagctacaatggataccttagggggggattaaggcctacttttctagtgaaatcccagttgagaatggctgctaaaaactgagtaacattagactgaaaaaaagggaatattgtataaagttgtactttaaaaaagagaaaaagatgtgtctaagtgactatcagatagcaatgtaatgctccctaattgtaaa

SEQ ID NO: 229112 - DNA, 464 bp, Homo sapiens
attttgcccgcaccaatgtcgtggagttcttcccctatgttttattctggtagttttatagtttcaagtcttatgtttaagtttttaatccattttgagttgatttttgtgcatgatgtaaaataaagttttaatttttttcttctacatctggataaccaagtttcccagcctcatttattaagtagactatcctttccccattgtgtattcttggcatctttgtcaaaaatcaattgaccataaatgtgtttttgtttctaggccttctatcctgatccattggtcagtgagtctgcttttatgccagtcctaggcatgagtcttctttcatttctgatattgatcgttatgtcctctcttattcttgattagcatggtcagaatatttttaattttattgatttgtttaaaagaataagtttttgccagcttctgcgaaataggaagaacctggctgtatt

SEQ ID NO: 229113 - DNA, 381 bp, Homo sapiens
aatttcatttaaatcttgcaatactcttgagagatattatcattccctttttaccaaaaaaaggctgaatggccaagatcacataaaatcacataaataatagaagtcaaaagtatgactttaacccatctagtgttataagaaccacataatcgtcaataatttgagagtatcttaattaattaaattaaaaaaattaataaaaattttttcaaaagatgtattcaagttatcaatttgaagaaaaatgaacatattacttagaaacagccctggattagagtcccaattatatcacttaataattgtgtggtttaggtaagccatgtaaagttgctgtactacttaaatttaaaataaagacaattttacccaaacata

SEQ ID NO: 229114 - DNA, 468 bp, Homo sapiens
aacagaaggtctgtttgtttagatattaactagtagtaggtaacggtcagctgactcatggtgagatccataaccttaagggattctagcttaacttattcctacttatttttttgaactccttcaatgaatatgaattcctccaatgaattgactggtggtgtagtcctctaatttttctcttctttgataactgttgttttaaagttcagagttgagtgaattttaacatagactttaactatctttttcttctcctccagcataggaactttttccttaaaacatcatagccttttcttgatgcaactactcatattctaccatgtgctcaagggaacgtacttatttactatcttctaacattttaattctagttgaatgtattttctttacccagctttctctacttacccctttttatctttttgtccttttttaaataaaaattaaagtggttttgtgtaa

SEQ ID NO: 229115 - DNA, 653 bp, Homo sapiens
attcaatcaattgtctggtatttgtttttttatgggagccaatcacccaccatctctgaaattatgccaaagggtaactaggacctgattctaagctctgttaattagacagtagcctcaacagagataaagtaattcaaataagaaaacaccatatcagagactacataaatgggaaaaaaaaaggaaataaaaatttaataactactatgtagcacacccatatatactggaatttgatccccctaactccttgtagttgttgcttttatcttcatctggacagatgctgctgctgcaactcgggttaaatagctgatgagtgacagaagtggaactggagcccattactgcctaggtcccaagcccatgagcctctcactatgttgccttgtttctctccaaattcacagaatcctacttagagacaaattaagaaaaaaaaaatctcatctttattcatcctgccatttcccattgtgaaaaaatacaagcacatagtgtctgataatatccatttctcagatgtttttctagctctcccagctaatgaccatttaattccttttttattttcacaataattattgttcatatcagatttagtattgcttcaatcatggtgctgcttgtagcactatcattttactctc

SEQ ID NO: 229116 - DNA, 381 bp, Homo sapiens
ccttgaaataaattagcagtcacttaaattattcccattttagagatgaggcttaggaaactttaataacttgccctttaataagttcatcctcgctaacaattggcagaaccaggattgaacccaatccacctgagtccctctgacagtgtcctcggtgaggaggaggtctccaggccagggcccagtggtgagaacagaagaagcagaaccacaaactgtcttatgctggcctaacatagagaacctccatggtttatcacaaacagcaaaggcaaaagaatgcctattttcctagttacaagacagatttcaccacaatgcaatactacttactacttcaccacaatgcgattcatacccttaggatggctataatta

SEQ ID NO: 229117 - DNA, 211 bp, Homo sapiens
ctgtttccccactgagtgaagcccaccctggcacccagcacggtgtggggtcagggaagccctgcgaggaggacctgcccgctgggcattaggggaacaggagcccctccccacggctcacacacaggcaggcccagaacaggcaaccaaaacatattccaagatacacctactaagtacccatagaaataaaaaaatatgtattttgcga

SEQ ID NO: 229118 - DNA, 455 bp, Homo sapiens
gagtcatggaatgaccattctcgttatgtcatctgacattgttgataaatgttgtcattttctttttatgtgtgttgtcctgtttatgcagcatagcagggatgaccactgcagagctaaaagactggcatgcaggaaccatgagccttcccctggcatccccaggataggttgacggactcaggggtctggtaggctggccagggcaaatccagggagatgacgttttggtgcgtttattgtgataatgtttcctcctgcctatcacctcctcgtttgtctggcaaactgctgttcatccttcaatactgaatgcttggtgggaatataaattagtacaacctctacggaaaacagtatagagatttcttaaagagctaaaagtagatctactacttgacacagcaatcccactactgagtatctacccaaagtaaaaggagtcattacataaa

SEQ ID NO: 229119 - DNA, 432 bp, Homo sapiens
aaaaagatagtccaaacagggcggttgagaattgtcttccagaattcagattcttaaatctgttggttactttctccttttatttcagtaaatttatattttatgagctattttttagaacttattactagtaatcttaatatatgcatggcaatatggagagtgctcaactgcctgtacaaactcatgcagtaagctctctaccatggtgaaaagaaatcctcaacctaccagttttctactgctagagaaaactcatggtaagatatatttagtgtcataagttacagtttttcttatttttaattatcactcatttcctcagaaaatatttactcatcctttatgtgatcataaaaacttgctggacttcaagattgtggaccaagcacagtatattactcttcctttctaaaataaaaaaagattaaa

SEQ ID NO: 229120 - DNA, 232 bp, Homo sapiens
ctcccccacttgcagttggcttgatccacctttcatccgcatccctaactccagctgcaagaagcttttgctgcttcctcgccacttcaccatcagatttctcttgcttggttttgttggttgatttggtcgggttgtttttcttattgtagtaagagaaacagtgtccttccttgcattggccacatcacatttttcctgtactcaccccactcgttagggctgacatcct

SEQ ID NO: 229121 - DNA, 436 bp, Homo sapiens
tgttgacttgtgctttttaaaaatccttcttaagaaaacaatcatagttatatgtttggctagtcaagtccatgccattataatgagtttgcatcagatttatttgagtgtgttaaaagggaaacaggctgggcatggtaatcctaacactttgggaaactgtaattccagcacctgtaatcccagcactttgggaggttgagacaggaggattgcacaagcccaggagtttgagaccagcctgagcaacatagtgagaccccatctttacaaaaaataaaaataattagctgggtgtggtagtgtgttcttgtattccccactatttgggaggttgaggcaggaggatcacttgagtctgggaggttgaggctgcagtgagccgtgattgcaccactgcactccagtctgggtgacagagcaagaccctgcctca

SEQ ID NO: 229122 - DNA, 784 bp, Homo sapiens
gctaaaccatggcactggctgtttctgggaagtagggcctattaaagcatgggccaaggagacggtattgtctccttcaaaagaaaatacatctctcctggggcggggtggggggtctttctaggcccccaaatagctttttgtctttctcagcctctgatgtgtgtttatatggggtcttactatgctgtccaggctggtctcaaactcctgggctcaggagatcctcccatctccgcctctcaaagtgctgggattgctggcgtgagcaactgtgcccagcctctctcttctttttttctgaaccctatctctgatctctctgtctctgtctcatcatctctatgtatctctgtcactttctgcttttattcccgtgagtccctttctgggtctctgtctctggttgtgattttcctttattacttaactctccctcaggttgtttccaaacattcttaggagaaatctgagtagcaccaagcccctcgcagctgactgctgtgtgatgttggggtgagctgtctgctctttgggccttgactcttctctgtctgtaaaatcagatgcagtaactagtacaagcaggcaggggtcccagcactggggagtattttaaaggtgggttcctccagttccacacccacaagctgtgggtcagaatctcagagaaagacgaccgggcgcgatggcttatgcctgtaatcccacactttgggaggcccagtgggtggatcacctgggtttggagtttgagaccagcatggccagctgtgaaaccccg

SEQ ID NO: 229123 - DNA, 733 bp, Homo sapiens
gctaaaccatggcactggctgtttctgggaagtagggcctattaaagcatgggccaaggagacggtattgtctccttcaaaagaaaatacatctctcctggggcggggtggggggtctttctaggcccccaaatagctttttgtctttctcagcctctgatgtgtgtttatatggggtcttactatgctgtccaggctggtctcaaactcctgggctcaggagatcctcccatctccgcctctcaaagtgctgggattgctggcgtgagcaactgtgcccagcctctctcttctttttttctgaaccctatctctgatctctctgtctctgtctcatcatctctatgtatctctgtcactttctgcttttattcccgtgagtccctttctgggtctctgtctctggttgtgattttcctttattacttaactctccctcaggttgtttccaaacattcttaggagaaatctgagtagcaccaagcccctcgcagctgactgctgtgtgatgttggggtgagctgtctgctctttgggccttgactcttctctgtctggagtattttaaaggtgggttcctccagttccacacccacaagctgtgggtcagaatctcagagaaagacgaccgggcgcgatggcttatgcctgtaatcccacactttgggaggcccagtgggtggatcacctgggtttggagtttgagaccagcatggccagctgtgaaaccccg

SEQ ID NO: 229124 - DNA, 712 bp, Homo sapiens
gctaaaccatggcactggctgtttctgggaagtagggcctattaaagcatgggccaaggagacggtattgtctccttcaaaagaaaatacatctctcctggggcggggtggggggtctttctaggcccccaaatagctttttgtctttctcagcctctgatgtgtgtttatctctctctgcattttttttaaattaataaaaacttttttttaaataaagatggggtcttactatgctgtccaggctggtctcaaactcctgggctcaggagatcctcccatctccgcctctcaaagtgctgggattgctggcgtgagcaactgtgcccagcctctctcttctttttttctgaaccctatctctgatctctctgtctctgtctcatcatctctatgtatctctgtcactttctgcttttattcccgtgagtccctttctgggtctctgtctctggttgtgattttcctttattacttaactctccctcaggttgtttccaaacattcttaggagaaatctgagtagcaccaagcccctcgcagctgactgctgtgtgatgttggggtgagctgtctgctctttgggccttgactcttctctgtctgtaaaatcagatgcagtaactagtacaagcaggcaggggtcccagcactgggggagtattttgaccaccggccgcgaaggcttatgcccggtattcccctttgggcg

SEQ ID NO: 229125 - DNA, 710 bp, Homo sapiens
gctaaaccatggcactggctgtttctgggaagtagggcctattaaagcatgggccaaggagacggtattgtctccttcaaaagaaaatacatctctcctggggcggggtggggggtctttctaggcccccaaatagctttttgtctttctcagcctctgatgtgtgtttatctctctctgcattttttttaaattaataaaaacttttttttaaataaagatggggtcttactatgctgtccaggctggtctcaaactcctgggctcaggagatcctcccatctccgcctctcaaagtgctgggattgctggcgtgagcaactgtgcccagcctctctcttctttttttctgaaccctatctctgatctctctgtctctgtctcatcatctctatgtatctctgtcactttctgcttttattcccgtgagtccctttctgggtctctgtctctggttgtgattttcctttattacttaactctccctcaggttgtttccaaacattcttaggagaaatctgagtagcaccaagcccctcgcagctgactgctgtgtgatgttggggtgagctgtctgctctttgggccttgactcttctctgtctgggattttaaggatgggacctccaggtcccaaccaccagccgggggttcggaccctcagaggaccaaccggacgccgtggaattattcccttcactccccctttg

SEQ ID NO: 229126 - DNA, 546 bp, Homo sapiens
  misc_feature (546)..(546): n is a, c, g, or t
gctaaaccatggcactggctgtttctgggaagtagggcctattaaagcatgggccaaggagacggtattgtctccttcaaaagaaaatacatctctcctggggcggggtggggggtctttctaggcccccaaatagctttttgtctttctcagcctctgatgtgtgtttatctctctctgcattttttttaaattaataaaaacttttttttaaataaagatggggtcttactatgctgtccaggctggtctcaaactcctgggctcaggagatcctcccatctccgcctctcaaagtgctgggattgctggcgtgagcaactgtgcccagcctctctcttctttttttctgaaccctatctctgatctctctgtctctgtctcatcatctctatgtatctctgtcactttctgcttttattcccgtgagtccctttctgggtctctgtctctggttgtgattttcctttattacttaactctccctcaggttgttttccatttcttaggaggaggcggcctgttctctgggctctgtttctttcn

SEQ ID NO: 229127 - DNA, 529 bp, Homo sapiens
cattttaaaagaatgacccatgattattctgctgcatggccctgtaaattaagatggaaaggcccttcctgtcccggcttgaatcctcttgtcttgagaaataataaccccccagggccatctccattaagtttccattaccaggccatgcagcagaggcagtgttacctgaaatacaacttctactcagaacaatttctgaatcctgaagattgaacatgcctgagaggaggagcacctctctgggctctcagtagcttgttcattacgcggggtttcagactttcaaaacgactcacttgccctttaaaaaatgtcctcttttatgtatgcgctcactcattccatcagtcagccaacagctgtattttagactccttgtccataaaattatgccatgtgtatttgagatcatgatattacaaaaatagtttccttggaggaactcacagtctattaggggcaagacatgaaacaaaaaccatgtaaagctgaaaaaacaaatagaataaaagagaaaacacttaga

SEQ ID NO: 229128 - DNA, 374 bp, Homo sapiens
ataatgtctttctaaagctttcatgtaagtatgattttgtgtataaacaactatgggctattgtttttgcacttgtacttcattattttgtgaattgtttaagtgagataattgcagtaagtgtatctcagtctggtttgggaacagacacaacttatgcctggactggtgggagcagagtgcagtgttgcaccacagacaggatcagttcatggcagcggggatagagattaatcattaatctgactaggagttttaaattagccggaagatctgttaagagtttatgggttttttccgggaggcggaggttgcagtgagccaagattgcgccactgcactccagcctgagcgacagagtaagactccgtctc

SEQ ID NO: 229129 - DNA, 531 bp, Homo sapiens
ccagaatgagatgtctccacacacagagagctgcagccgatgccggccggtgacttgggacttggatgcttaacaggaggctccccctctcttgggaggtagagagcagtgaggaaggggactcagcctccatgcctcccgccagcccagctgcgcccgaatcacctccctcctgaaaggatgtcagcctctgcttggacaccgtggagacagggccctccttgtgcttcagaagcatcaacgtgtcagaaaatcatcttcacgccaagtctggaaaaaatggctttgaggttgtgcacacaaaggaaggagggagagccccaggtgtcgcggaggaccatgcggctgacagagccagcagggcggtggcgtgtgagccgtgctctggatatataaggatctgacgctgctggcaatgtctgagctctatgctcgcccatctgtcggctgctatcatcaccgggtgggattagcggagatccactctttcatatttaaatcttcacaagagaatgaatcacttttataata

SEQ ID NO: 229130 - DNA, 377 bp, Homo sapiens
tgacctcatgatccgcctgcctcggcctcccaaagtgctgggattacaggtgcgagccaccacacctgacctgtagttttctatactggagctttgacatcttttattagacggtatttcatatttttggacagtattataagtggcatattcaaagttttaaattttttttttaactttttgaggctgtctaaagaaatgcaattgatttcctctcctgcttttctttgttttttttgttttgttttttgagacacagtctcactctgtcgcccaggctggagtgcagtggtgcgatcttggctcactgcagcctttgccttctgggttcaagcgattctcctacctatctccccttttatactaataattttata

SEQ ID NO: 229131 - DNA, 372 bp, Homo sapiens
tcttgaatattcatagctcctcctgtaacctgtaattacatatatctggctaaccatttcagtttgaattcctgtcttactcttccctttctggaagtgtctgtctctgcgctctgtgggaggctatgcttcccagaccatcaaaatgggcacctggcaggctgtaacccttcataaaaaataaagtctaccttcttaatttataaattgtatgatttaagttaacaaaagacatgtttcaagtcatgaccttgccgcaatggaattttagtgcatcatttattctctgagcttcattagcaaaatgtgatgtgcgtaagcatcacctaggaagctgctaaaatgcagattctgattgagtaggtctgggtg

SEQ ID NO: 229132 - DNA, 426 bp, Homo sapiens
gttctgagtagtgtaatgaaccttgagtcattttactagattctccctggaacgtgaatcctcccattgtccatcggacccatgctgtatacgccacttccctgttagccacttagtagctgatcagatcaggtgggacagtatcctagtgcttatgttcaaggaatccttattttacttttattatattgttatagctagctatatagctagctataacaatatattattagctattctattagttttaataaaaaactgtattagtttaaaatagttattagtaactactattattatcatcgtttgagagagtcttactctgtcacccagggtggagtgcatgatcttcgctcactgcaacctcctcctccttggttcaagcaattctcctgcctcagcctcccgagtagctgggattacagg

SEQ ID NO: 229133 - DNA, 531 bp, Homo sapiens
gttactctgtttcatcattatcacctcccttacactcctggaggtcagcagtccaaaatcaggtcccctacactaacttcaaggtgtctgcagggctggttccatctggagactctaggggagaacccatttccttgctgtttccagctcctggtggccacctgcattccttggcttgtggccccttcctccatcttcaaagtgcatcacccaatctctgctccctcaccacatcaccgtctccccttctgtagtcaaatgttcctctgtctcctttttataagcattcttattatcatatttatggcccacgaggataatccaggataatcccccatctcaagattcttaatcatgtccacaaagttccctttgccatgtaaggtcttattcacaggttccagggattaggatgtagacactctagagggtcattattaactcaccacacaagtattcgagaattttctctgtattctggctttatcatttgttttgattaaagaatatatatttaaaataaacttttat

SEQ ID NO: 229134 - DNA, 575 bp, Homo sapiens
aagggaagatggggttcacctcacaatgctaaaggtgaaaaggggagtgccgaccctgccctttgttttggcatttttatttccatactttgtggtttgtatgtgcccagttaaacggatgtacagattagataatctggctttaactccaaccttcacgagatgcacacatgccttaaaaagattcttacaaagaaactagaattaggagacaattctgacaacacaaaaacaagtgaacaaaaatcaaatgactgacctgacgtgtccactaggcttgatatgagcttggtcaactaaaacatgagacagaatgaatgaccatctggtcaggttggataagaagtaacttttggcaaaatctctgaagtctggatttacacttcgtggaaggaatcttgacctttccccaagtatattatgccttgagataataatcctgtataaggccgcataagcaaaacgacatttgaaaatgagtttcatctttagctcatccttttacaaatttctattccttgtgcatgattgaagtgtacacattttttagttaaaatataagcatatagaaggca

SEQ ID NO: 229135 - DNA, 424 bp, Homo sapiens
aatcgtttaagcccaggagttggagaccagcctgaacaacgttgtaagaccccacctctacaaagtccgtatcctttgacccagcaaataattagtaattatcctaaataattaagactacatagatggctgtacaacaatagctgtcatttattgagtgcctactatgtattaaacactgctctagcactttacaagtattatcctatttatccttgtaacaaccctgtgtattacagtacacacgattcttttttagagacggagtctcactctgttgccaggctagaatgcagtggcgcaatcttggctcactgcaactttggaggcctcagcctcccgagtagctgggactacaggcacgcaccaccacgcccagctaatttttatagtatacgctatgattatttccattttacagatg

SEQ ID NO: 229136 - DNA, 407 bp, Homo sapiens
acatctaagcagggaatgctgtggccgatgaataggcatggtgggggtcccctcacgaggattccggtgaatatgaggtactagtaattacagacttctctacttccttctatgatttaggagataaataaaattcaagatacctcaggctctcagcaagtcacaagaaaacaagaaaacatgatgctgtctgagcaactggtacaggaagcctggacgcattgctgaggaaatcagaacttctttgcaaaagatggtgacaatctgtggccaagatgctgccgggagatgattacaggcacaggagaggagtttcaggcaggtcagtgagttcatgtgtatttcagatgaaggggttgtcatccacgtcaatatttaaataaattcttcctggtgcctaagtgaaa

SEQ ID NO: 229137 - DNA, 1761 bp, Homo sapiens
  misc_feature (1524)..(1524): n is a, c, g, or t
  misc_feature (1527)..(1527): n is a, c, g, or t
  misc_feature (1533)..(1536): n is a, c, g, or t
  misc_feature (1547)..(1547): n is a, c, g, or t
  misc_feature (1556)..(1557): n is a, c, g, or t
  misc_feature (1562)..(1562): n is a, c, g, or t
  misc_feature (1570)..(1570): n is a, c, g, or t
  misc_feature (1577)..(1577): n is a, c, g, or t
  misc_feature (1582)..(1582): n is a, c, g, or t
gagctgatgtccactaatagaaagaatagaaagatctgattatttcctttttgccagtgtgtagtcaccttggtaaaaggccataggtccctttggaaaaggctgggagaaagatttaccttataaatgtttggcggtggagtggagttcttccacaatagtacctactctccccttcattcaaagagttctgggtctgtaaaccagctcaggtctggtaattgattgaggggatatgactctatttttatgtttcaagttagacttgttcatttgacctacaactcttccacttctacaaagcaagtcagaatttgctagacttcccagctgtttcacttccaggaacaccatgatcaactagtcagcataggtctctgagtcagactattttgactgctgtttcaactccattgtccattatggtaaccacacccgccttgcttttggtggtttattgccaccacttggctgccaccaacctggggcccaattacccccattgcacttaggttttccaacttgatggcagcagtttccacatccttgacatctattctcacagatattcctcaaattgctgtctgtctgtttaaattggaaaaatcatttagttcttttgaagtgtagcgcaccttctcatgggtcatactttgtacttcacctttcagggcttgctgggatttgagtccagttatcagttgataaggaaagtgggatgggggtgggtcctgaagagaatcagtggggtcttccatgacagctgcctcaggggaggccattacagttttctcgggcaaagcagggttaacctgctcaaacatgggttggggggtgcagttgcttcttctgacaaagaagactcgttggaatttaggggttcagtgtccccatcttcgtcatgatcttcccatatgtccccaaagcaattttcaaagtcctattccttcccaatctatgcccccactttaacagcagatactctgcaaggtttggaatttaacttgcattgcaattcagacctcgcaggatgaagattcttggtttggttttctgcagtctcagctctgaggctgtaggagataaggatttctttctaggaaggcatagaaactttcaggtcatttatgctgcatctgagtgggaattcaaatccctcaactccttttctttcccactttgtccagcccaattaggagcaaccagccaagttcattatgcccattagtttgacggaaatgttctacgttatcaaatacgtggtcacccagaaccttgcctatcataattatttgattaggagtatctaatagtgatatttttgtgtatctctattaccacatcacaccgatgactatcagtgctttattcactattggaactagagtcattagtgcttctaaatctagtcatttagagaaccaattccagaaacccccaaaccaattcagagaatttattcttaaaattctgttcctggctgggcattgtcttatgcctataattccagcactttgggaggcnaangtgggnnnntcacttgaggncaggagttnnagacnagcctggncaacatngtganaccctgtctctactaaaaaaatacaaaaattagccaggcatcgtggtgcatgcctgtatttccagcttcttgggaggctgaggtgggaaaatcgcttgaatctgagaggcagagtttgcagtgggctgagatcgcaccactggactccagcctgaacatcacagactgagaatttgtct

SEQ ID NO: 229138 - DNA, 338 bp, Homo sapiens
cggccgcccctgacaaggcccaggactcggtcgaggcctggctagcggaccgaggcggagtcaggcccaaggccctgcttgctctcctgcctctccctccctcggagaactgtccagtcttttaagggggctttcacagactgaaccgttcttctttcctgaccctcctctatgaatcattctcaaaggactagagcaacccggctcttccccgcccatctatgaaccagccgctaaatggactgcaattccctgcatgcaatggggctatcccgctcttccatctaatttactggcgtgccgaatggcatgctgggattggtagtcatccagccgga

SEQ ID NO: 229139 - DNA, 474 bp, Homo sapiens
aatcactttaagcaggctatgtgtgacgaacttgttcacgagccctcaaccttggcttttattgacctcacctggggagcttacaaatgatgatggctgggctctcttacccagagattttgatttacttgaacctgtgtgggtctgagaggttttaaaagcaccagtgatagttcagacgatgaagttcttcaagggatcaagctcaaatggaggacaagaaaaaactatactaaggtgaggaacatcaacattcaacaggataatttttgaggaaaccaggtcagcacttgatattgggagtgccatacacatcaaattagaagtctcagaaagagtggtaagaaaactgatcaaagatggaactttatgggaaacatctagggaagaaaagtcaaaaagggcttacagagggagtttttaggagaaactaacacaaaaacaaaagcaaaatcatagttgtttttgattaaa

SEQ ID NO: 229140 - DNA, 427 bp, Homo sapiens
gacccagaacataagcagataatagaataaaagcataaaaaaagaatactgcattccatatattcaaacaaataagtaacaacataagaatggtataagaaagacccaaatcaaatattcagagataaaaagtacaatgtatgtgatttaaaaaatacaccatataagattatctgattattaagctttagtgattttgaacacataacaattaaaactatccaaaacaaaacatctaaaataattttcaaaaatgtcataaatgaactatggaacaactttaagtagcctaatatgcatttaattggagtctctagaaaggggtggatagaaaatacatatgaagaaataatgaatgaaaaatttccaaacctgattaaaactataaaaccacacatatacaagtagttccatgaaacccaaggac

SEQ ID NO: 229141 - DNA, 571 bp, Homo sapiens
atggatcgtcccatcttctgatcagttatgctttaataaggtgtgaaatgaagggggaaggaaggaaatggctgaaatattataaggctgggtaatatttccacctaaaatgctagaagagacaaagaggttaatgaaaagctgagtctctatggttgaagcagtcgaaacaagttctttttgcactcacaaatagtgtagttctccaaggagctggaaggaatgctgaaacccttgggagaacagatttggagggaaccccatctcttagcctgtgtcttctgcagatatttaacttctggaacaacttgaaaggaacaactcatcttgtggccaaggtccatcccaagacattttgaaagcataggttcaagttcaaccattaatccagacatttcaacaagtgtctgtaattgctccaataaatagaaaacttgtaaatcagactgaagacctaaccctgacatttcttgaaaatggccacccccagtatttaacatactgaacataatatggtcaaaatattgtttgtaacttatatcttctgagccctaaaaatacaaatatcttt

SEQ ID NO: 229142 - DNA, 274 bp, Homo sapiens
ctgcacgagggcagacgctgccttctcaaccattacattcctagcacggaagcacagggcctggcagaaattagcgcttgatcaatgtttgttgaaatcaatggataactgcctgcttgaatgaatgttgaaaacaactgttttgcaagcgccacaatgtgatgtgtctgactcctatgccatgttcacaaggagtcgagagcctggaagctttgcacactactgcctggaagatctgattctttggaaataaaatatatatatatattctgca

SEQ ID NO: 229143 - DNA, 462 bp, Homo sapiens
cagttaccatggcttggtccaagcagtgacttctgttcatgggctctggaattgagtggccaaaaatctggaatccctacagtagggagagtagccttgtccctgccccactacaagtctgttcatatgaagacatacaaagccgtcgcctctaatcagtgttcaaagggtcgattgtgcaactcacattcctccagagaaattcccccagcttgtgagatctccaagagggaacacgtattcctggcatccaacttcccctggtgctccccctgacctgcctcattccaggagttccctctccagagaccctgtgtgcccacacgagcagacttttagaaaatggcctacagttcaaaggccctgcattgctttatggccttggaaatgtggggaaagtgtcagatgaagaatttctatcctcctcacctcctccctgtctccaataaatgcataccaaga

SEQ ID NO: 229144 - DNA, 461 bp, Homo sapiens
gcaggagaggtacttccaggggctccattagatgatcactgcctgtccacagccgccagccccttcatgacagcataccatcaagagttttctaaataggagctttccaaaaacaacaccacaaagtgcatccctcttctcttagtgattgtccgtggagtggccaagggtagacttgggtagcaagagtataataactttttatttttggaaacaaaaagcaagtctacttattggcagctaaaatgctggcataggccagagagaaaagttcagattacatggctttccaatgcccttgtttttgtaaaccaacccctggggcaatggctttggcaaatctctcagtagttgcctttgaggaaatctaccagaagtcttattcttttgttttgaaatgtggatatcagttgtaaaaaaatgaaacaaaaagcaataaaataaaacaatcctttcagtga

SEQ ID NO: 229145 - DNA, 366 bp, Homo sapiens
gggacttgcttgttgaacttaactgatcaaggtcaacatcttgcttttggtgtaaaaatgagatgcagcttgcaagctgagatgggagatgaattcagcctgtggaaaaatagaagacactgccatattgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagt

SEQ ID NO: 229146 - DNA, 372 bp, Homo sapiens
tctcaaggtgtggcagaaacggtcagacagatttgcattcaaatccagcctctgctgcagacagccaggaatcttaggcaaatgcctttgacctttctaggcttccacttcctcatccacaaaatggaaagtacaatgtcagattttgttatgaaaattaagtgagagaacactaatacacatacacacacacatatacatatacatatgagtgtgtatatacatttttaatttttcaacctcaaagttctttgtatctgtcatattatttatagattattactgccatcgaatattacttccatgtcaaaatttaatacaagaattgaaacaaaatacattgagttaaaaagaaattgaacaagagtacgc

SEQ ID NO: 229147 - DNA, 702 bp, Homo sapiens
caggagaatcgcttgaacccagcagggcagaggttgcagtgagccaggatcgcgccacttcactccagcctgggcgaaagagtgaaactccgtccaaaaaaaaaaaaaaaattagccaggtgtgatgacacatacctgtaatcccaggtactcaggaggctgaggcgagaggattgcttgaaccaaggagtttgaagttgcaataagctatgatgattgcaccactgcactccaggctgggtaacagagtatgaccctgtctcaaaaacgaaacaaaaacaaaaacaaaaaacaaacttgagttgcatatgaccatagcaaatatggttttgaggctttgctattttttaactttatattatttaatctaaaaatctatattaccaagacctgattgtatattctgtatcactcaattactaaaagatacttgaaaatagtgtaaaatactaatacattaatgaaatgttattagtgatataaagtactaatacatgaatgattctaatgtttagaatcaccagtaactaataacaacttgtcatataacatatgcaattagaataaagcttccatttaacatttgcctaattcccaactcttggcctgttcaaactatatttaatttgtaatcctttatctagcttagcaaaattatttggtattcaaatcattcataccttttcctgttgtccaccaaat

SEQ ID NO: 229148 - DNA, 598 bp, Homo sapiens
agaatgtactgtcaagcttggtgtgttctatgaagctctggagtcaattttggcttggtcatctttatccgtgtgtccctgggaatgttacttaatttctctgtgtgtgtgtggtttttttgtttgtttgtttttatgtttttgtggttttttttttttttttttttttggtttttggtacacctccaaagtcagaaaaataatgtctcactcaaaattatctcaaaagggttacatgtgataatatagtaccttgtgaatgttatcattattatgatgctttaaagtgtttaatgtaaaacactggcaaacgctctttatgaagaaaattctggcatcaatttccccagagaaaaagcctacttagaaaaatgtaagataagcatagggaatgaggggaagtgataccaagtagtgatgtttaggatggctttcttctgagtcaaataaaaccatcatagaatgatcagaatgatgtgatggaagcaaaaaccaataggaacagcctaattcttactagagtaatagagtaagcaaattatttaaagttttcttatgtgagaaattgtgaagattccagcctgtaaagtaatagtat

SEQ ID NO: 229149 - DNA, 625 bp, Homo sapiens
cagccattgctctgatggtgctctggatgtttagagatgtacactatctcctcccaaagggaccaatccatggtgatgtctgaccggcacagactacccatcagagacctgtgttggtcctagtgggtgcagagggcatgcagccaggcctgcagagaaagcttcagatcaagtccacaggaagactctgcctcaatagggggcctgacagcagcaaagactcatgacagctcaaagttctgggaatagaaacccccagctatcttccatcaggggcagagataggcttccacccactctgacaggctgcagggctagttctggaagaaccaatgtgctgcctacaccagatgactcacactcaggcacttgagtgagcctcctgtcactccctgcaagagggtagggagggacaaggagcccagttctctttgccttgagccttaggctcaatagtcagacttaaataacacacaatataaatcttaacagggccaagcacagtgactcacacatgtaatcccagcactttgggaggccaaggcaggagggttgcttgaggccaggagttcaagaccagcctgcacaatatagcaagaccctgtttctattttaaaaattaaac

SEQ ID NO: 229150 - DNA, 126 bp, Homo sapiens
ggaaacctgtactttttgagctcactgccccttccactattctctctataagtctccatggccaacccctgtggcattaattggtgttctctatcctgatacctctcaaagacatcctaacccctt

SEQ ID NO: 229151 - DNA, 1303 bp, Homo sapiens
aagcaaacagtaaatatcattagggcaatcatttcagagcttctttccagtcacaatttgcttatataagcagctaatttaatctcaattcaattgaagagacattttgagtacatcctgcatggcaggccctgatatacttcctaggcactagggaaacaagcagactagaagttcccattgattaaaatttagtcctttccttcaaagagctcatgcaggggggaaataggtaaacagtcactgtacactatggctatgaaataatccatcagagctcataaacggcacacccagtctttcttgtggaacacatgttaatataattagatgggaaaaggattcacaaggatgatatctggcgtgaagattttgttaaatcaaatgctataaaaatttaaagtaccacccttactaaacatcaatctggttagggaagaggcaaaagtacaaatcctctaattacccacaaaagattagaattcccaataatcagtgaaaaaatgttagtatagagattttccaacttaaaaatgagttgatggtgggaataccaagacacatttctcccaacagtgttataaaatattggtaaattctatgagtagctccactcccaagcctacttatccataatatgctaaaatgccattttttatgaaacccagctaataatatagttcagttaattaacagagaaaaactcaattaaaagtggtttttatatataatgaacaatggttcttatgcttaaggaaaagctgtttaattaaaggaatgaaaaggattaaatgaaacaagctagacatgtatatgtactaggcactttataagcattatacaaatttaatcctcacagccacctaagatatatttcttaaaagaataaagacagagagatataaatatggaatcacaaaagaatataaatagggcacgagttcatttttgcaagctttcaataatcatattttttaaatttcactctaagtctatggctcctccctcccatttacttctctattaaattcaggatggacaattctaaactattgctattgggaaaatgtgatgtttccattgcatctgagtgtcattcattcactcaacaaatgtttattgagctcctaaatgctaactgccttaggacaagtaaataacatacaaaaggagtttacaattaagaaaactaaacaagcagatcacaatcttgttgctagaatagatgaaatacagtatgtacaaggcaccatcaatttgtaagatgaaaagctaagaaaaagaatttgtaagatgaaaaact

SEQ ID NO: 229152 - DNA, 529 bp, Homo sapiens
aataaaggaaattggatgtggggtacatgagaatgctgtactatttttgcaacttttcttaaatctaaaactcttataaaatttaaaaataaaaagaaatgtggagttattattattattttttggctcaggatttgacccagagctatggtctggcagaattttctcagaggaggaatactggctagtacaagtcattcaaattactgtgtttttctatgatttctccacaaattaagttgctttaataatgcataatgtaacttaattcagcagttttgcttcctttgctgagtaagtatagactataattatagagaatgtaaaatggtgatataaagtcaaaatacacaacttcttaaaatcacttagatatgttctttattgaagctgtgcacattaacccagcagaccccactagcaaatttatgatatgttgatgtcatgtacattcataaataagattattttacttaatactgggcctgttacttttgttaggagtaatacagcatttaaacaacctcca

SEQ ID NO: 229153 - DNA, 478 bp, Homo sapiens
gtctcaaaaaaaaaaaacaaaaacaaaaacaaaaaagaatgagacctagatccatctttaatgaatccatgaccttaaaacgttaaagtttctgagctacaattttctaattgttgaagagtattgtagtaccagtagctgtgataacaaagatgccctgaaattgatttattaaaaaattagtataaaatggtagctgttttcatttttacatttgctattttatttgcctttattcataaatctctctttgatagacagcaataagctagaagttatgcaatcacttcctaactgcgttatatcccctaaacgtgagcagctaaggcacattatataccaccaggtattgaatataccacaaggaattaagggaattttcacaagccttggagccaggcaaagtgagcatacagaaattattatttgatttacaagaatgctcaaataatgagtattctattttaagtctttacta

SEQ ID NO: 229154 - DNA, 371 bp, Homo sapiens
ctattctatatttgaagtatccagagtaggtctagaatacatttttaaattcattctgcccaaatgtctaagttaggttattagctcctaagggtttaacatctgaaatctgtaggtattagaaaaggcattagaatagctccagattaaagagtgctggcacctatttcaatggtgagttattggagagtagataagtttcttaatgtgaaagccttggtctttcttaatttttggataaaaacttaacctgctgggcacaatggctcatgcctgtaatcccagcactttgggaggccacgactggagaatcgcttgagcccaggggttcgagaccagcctgggcaaaatagggagatttcatctctgca

SEQ ID NO: 229155 - DNA, 834 bp, Homo sapiens
gcatttctgaatgatgaccatgccatatgtccatagtagaagcagccataaccagagtcaatgtctcagacaatgagatgtctcatagtggactctggccatgtaaatcccaggactaacctgtgaactgatgaagttcttggttaaatttagaaaagatttggccttgagagctgaatttgaaaaccaggtcgttgtgatgtagaaaattgttcatgcgctggttggagattttgctaaggttgaacactgctttcaggtatgagtccagggtactggaatagggaagatggaacaacatgttagtgggtgacacagttattggcaaacaattaccttccttttaccactgacctgtccaactggatgctgccctggtggctgaaggcacacttcatgatgctgtccagggtcatcagggagacatgttgaaagagctccagacgtgagttttgggcaatgtgttcctcccatttgttctggggcaggggatgaatatcatgatcatacacatgcccatcttttcccaatttctaagttattttatgtcccttttagagtttgctggggtttgaaaatataaagtgtacaaaatgaatttgccttattatgacaaccatataaaataaaacaccttgtcagtactgaaaatgatactgtgccttagatgctatttgtgactttgtaagggtggggaaatagctatttttccctctttttcaagtttcattagtacaatttatatgacttttatcatggaaaaactaagctgacaaaacatggaataaaaaataaataagaattcaaaaacatctgtagagagcataaataaac

SEQ ID NO: 229156 - DNA, 555 bp, Homo sapiens
agaaatataaaattttactcagatgtctacttcctgatggcatgaaattcttaattgttttgaaaccaaagtagaaaagcagacaaacgaaaaatactagcaaatcagattctgttatctttcacccaacagagacaagatctctataaaccagcagtccttccccaaatacgtagtatacaaaccgcttcatgtctgtcattttcgtcaaccctggggtccttcaaatgccttttgttccttctcatttacttcaccttgacttttcaagacatattggttatactacacagttggttacatttgaagtatttcatgtaaattacaaaagtatatgaataatgtgaattcatttttgtttatatatgtatatgcatgcatacacatacacacacactcctatagagtgaacatttggctgaatatactgccaaattgttaaacaatagtcatttctagctggtggaattacaggaaaatttgtgtttctgattatatatttctatagcatttaaattttttgcaagtcagcgtgcatttcttagataagcaaaa

SEQ ID NO: 229157 - DNA, 422 bp, Homo sapiens
ggtttcatgttgaggtgagctgtgtttgtagtctgaagcattttaccaggctgaggggaacagcatgtgcaaaagcatgaaggtgtgagtaaggtttgtgtgggggtggagcaagttcagtatgacccgaggatagtttgcaaaagaggcctttgattgtatagtgtagcactcagtaaatagtgttggcgcctgaaatcaatgactgtacatcccaaactaatctcaaagctatttccttttggtgtgggtttggttttgttgttaattttgaaatatacttttgaacactgaaatctctgaaactgctaagatctctagaagtgtaattgggaaagaaacttgcttgtagctttaacaaaataagaaactcttcccaaataaaacttattttgaagtttgaaaatatatacttttggtga

SEQ ID NO: 229158 - DNA, 518 bp, Homo sapiens
tacaagaaagccctacaccctagaatggaacacttagttccctggctgctattctgtgtagaagcaaatttaaagtggtacaagaaaaaaaatccaatcagacaaaggaattcgtcagattttaatgcatgagattctagccagtgtctgtatgagactgtctttaaaggttgttggtatggaaaatgtttgaaagaacgtaggatttatttcagaaataaaattcaaaagagcatcttgtaaagctggagttaacaatcctccatggttggagggctttagagctggggttctgtatgtgggttataccactagtttatttgaaaagaaacgcatacatgttttttccttggaaacaagactgcagaaaattgcaatgatctagtccttgaaaaaggcgattgctctcaagctgttattaaggtactaaactgcactttgaagtgaaaatacatagaggtcctaggtgagctcttggacactctggaaataaatgacttcctaaattggccttctaa

SEQ ID NO: 229159 - DNA, 376 bp, Homo sapiens
aacaatttcatactcaggagttgacagaactcccacactggcatgcagagtaagagctatggcagtaggaaaggccaaggggaagtccctgaaactgctccctgctccaagatagtaaatcaaaaccaagatcccatcctggagtatatgacagatattaatgccaccttcaaatactcacgtaatgcaggagtaatagactctgtcatatcccatttattcagtagggcaaaaactggatgcattatgatagatgttaatggactatcacaaacttagccaagtgtagtctcatttgtagctgctgtgccagatatggtgtctttactaaaggagattaacacagcttgagatatatcatatgtggctatcgaac

SEQ ID NO: 229160 - DNA, 552 bp, Homo sapiens
tggctcatgcctataattccagcaccttgggaagccaaggcaggctcacttgagcccagttagaggttacagtgagctgtgaacacaccactgcactccagcctgggtgacagaacaagtccctgtcacaaaaaacaagctccttaataggtgatatgatttggccctgtgccccacccaaatctcatctcaaattgtaatccccacgtgtggagggagggacctggtgagaggtgactggatcatgggggtggtttcctccatgctgttctcgtgatagagttctcagagatctgatggtttaaaacttcaccctttgtgctctctctcgcctgccaccctgtaagacatgccttgcttccccttccaccataattttaagtttcctgatgcctccccagccatgcggaactatgagtcaattaaaatctctttttcttaattacccagtctcaggtagttctttatagcagtgtgaaaacagactaatacaatgggttagaatcagcattaggggccgggcactgtggctcacacctgtaatcccagcac

SEQ ID NO: 229161 - DNA, 271 bp, Homo sapiens
ttcagatggggtataagcttctcaagtcccttaaaattcactttgggggatagaggctgaagatgtgaattcaacctctatgaattcaggatatttggaagaaactctttttagcttttccttgttttggttttggtttttaaaatgctcttcttcctccttacctggccacccgtttctggagaatttggatgtggatctttctttttactaggtataattactgatacacaacattcccaaaacattaataaatatttaatgtacaaat

SEQ ID NO: 229162 - DNA, 300 bp, Homo sapiens
atgctttaattaaggaggatttgatggactctttaacactacccagtttaaggaaagctagtaagccttttaagggaactattatgcatatgtcctttgggtaaggctatgattttggcaaagaacaaaagaatgcctgtgaattccctttttcagtttttcatcctgaccagcactccttaaacacatttatttataatttcttctaaaaagaaagtgtgtgtgtatgtatccactgataaatttgggagtcaggtagtggagggcaggcatttagctacatctggaagaattaataaa

SEQ ID NO: 229163 - DNA, 444 bp, Homo sapiens
aaatttttattttccaagtatacttcagtaaagctgggaaaaaacacatttaagaaaaaaacacatttaagaaatatatactccatataaacttcattacggcaggtatagttatctgctttgctcactactgtatctcagggctgagaagccctaagataagctcttataaaaggatgaaatatggagtataggataaaacatattagacttgaaattttcacagctgtacatacaagtctagtatagttttcagggctttataattaggtattcacttttgcttttttgggaaggagactcaacaggagatgaaatgtgtgtttcctgtgttgcatgttcctgcacaggtacttcgaggacagtagatcttcccaccccttctaaatactctgtgtgtgtacatttttgagattacatatttggattttatgttttttttaa

SEQ ID NO: 229164 - DNA, 430 bp, Homo sapiens
acacattagcataatgtggattttccaagctacttttatacatgaaataatataagctgtaatgagtgaaagtaagcacggatttttcagcagtactttccagaaattttgatggaagatcagctttttgtagctggagaagttggattaaaaaatgaccacagagaaattgaaagatgtccagtagaaggtctgtagacttcattccaattcagcatatccatgaggtcaccaagaaattaagtcaccaagaagttaatttcctcaagaaaggacccttgaagaaagttgctattattaagtcgattagggtgtagtggcaggaaaaaaagtaaggactgatttctaagaaacataaaaatgaaaacattaaagaaaaaccctaaatttcattgaagaataaattgtgggactgagccacagaacaaaa

SEQ ID NO: 229165 - DNA, 475 bp, Homo sapiens
ctcagtctttaagaggttgaagagagtggcctagtcccttcagccctttttgccatgtgaggacacagcaacaaggctctatctatgaagcagagagtgggccttcactggacaccaaatctactaacaccttgatcttggacttcccagcctccagaactgtgagagatattttcctattatttataaattgccccatctgaggtattttgttatagcagcctgaacagactgagacacattggaaagacattttgtttgtttccttttaagaagaaatgctattttcttccattagtattgctgctgtgtaaacaacagggacttctgcagcctttggtcattatgaggaaaagagtctgcctaatgaggaaatgtgcatggaggaagtagaaacaagagatggggaaatggccttggtacattgtttgagctcctggatttagccatacctgaagcagtattactctttcag

SEQ ID NO: 229166 - DNA, 516 bp, Homo sapiens
agccctgctgacgcctcgcgggtccctctctttcagtgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatg

SEQ ID NO: 229167 - DNA, 233 bp, Homo sapiens
tctaaattaattttatcttatttaagaagcttataatgctcctatttatgaataacaggctatgtgggggatatttcccaccacttcacgaattattttttccaggtactttcttgcaaaaatcctacttactattgtccttaaaccaaatgacttaagaagaattttatacgagctctgatcagattgactcaaggctccagagaaactcaaagctccatgacatgatttct

SEQ ID NO: 229168 - DNA, 754 bp, Homo sapiens
atttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctcatatacaattatcttccttctaacttttcttgccagaaataccttttataactttctttacattgcttttatttaacgattacttttaccttgtttcataagttttaaatagccttgaattagataaaaaattattttcctttaaataagaacacatttctttttttagaaaaatatttttctgtaattttttttttttcttgagacagagtcttgctctgtcacccaggctggagtgcagtggcacaatcttggctcactgcaagttctgcctcccgggttcacgccatcctcctgcctcagcctccagggtagctgggactagaggtgcacaccaccacgcctggctaattttttgtatttttagtagagacggggtttcactgtgttagccaggatgatctcgatctcctgactatgatctgtctgcctcagcctcccaaagtgctgggattacaggtgtgagccactgcacctggcctaatattttaaattggaaatgacccagatgtttaatgagtacctattatttaactta

SEQ ID NO: 229169 - DNA, 466 bp, Homo sapiens
ggggtgataaagaaatgaaattgaaatgcagttagttttgagaatggtagttggcttttgcaaatttgttttcaggtgatcattataaaatccccccacccgcaccaatcacatccactgtgatgtggagaaagggctcatggcactgcactggggcaccgcgttggggtcacacctgccactcacggcccgccatgtccgtgttgcagaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagcatttggcgacttgaagtcggacgagttggagctgctctactcagcctacggagatgagacaggcgtgcagtgtgcgccgagatggacacccgctccgggagccagtgtt

SEQ ID NO: 229170 - DNA, 451 bp, Homo sapiens
gccgcaagattaggattatgggaggggcctgagttctgctaaaatgtgggcatagttttcataatccctttctgctcaggagtcatgtggccagaggtcacaatgtttgtgacttccccaattgctcctatagataacatcacattgtggaacctaagattgttcttttgagatgtttttcagactgaccccactggactcatgactcatggactcagctggtcctgtggccctacccagaagtggactcagcacacgaggaccatttcccacactcctgtgatttcatccccaattattcagcagtaccctttccatagccccttgcccaccaagttgtccataaaaaccctagcctctgagcttttggggagatggagttgagtaataactccatctactgcatggctggccttgtgtcaattaaacttttttctttactgcaataaca

SEQ ID NO: 229171 - DNA, 195 bp, Homo sapiens
tggcttcaagtgacttgtgtttatattgtatggcaatttgagtgtagcgttacatggaaagtgcttaaagaggtacggggacaagtgccttaaacccttataggaagcccttaggataaaatttacattttattttattttatattttatattttattttattttaatttaatttaattttattttattttatta

SEQ ID NO: 229172 - DNA, 313 bp, Homo sapiens
acattataacattataacatgcaataaaggtaagtactaagtgagattttataaaactgattttttagtcagcagtttaggttgctgttgattgcaaattactagtattatttagtgcccttgaaacttctgaagttggaggtttcaattgttagttactccctgctttccttcaatagaaaatgtgtagtaaaggttatttataaaagactaattgtatccaaagctaaatggtcttattatagagtttgtataggatttattttcacttgcacgggtaggttctcaaaatgtatttgaatgtgaatgactt

SEQ ID NO: 229173 - DNA, 377 bp, Homo sapiens
ttctagttatttggaaatccgaggcaggtggatcatttagttctggctatgccagtcaggtgtctgcactaagtttgccatcagtatggtgacttcccaggagctgggaaccaccaggttgcctgaggaggggggagccagcccaggtcagaaacagagcaggtcaaaactcccatgctgatcagtagtgggactgcacctgtgaatagccactgcgcttcagccaggacaacatagcaagacctcgtcttaaaaagtggacaaaaaggcagtggcttacacctgtaatcccagcattttgggaggccaaggcaggaggatcccttaaggctaggagtttgaaaccagcctgatcaacattgaaatcctatctctac

SEQ ID NO: 229174 - DNA, 654 bp, Homo sapiens
agaggctagctgagcttcaataccctgtcttcacaaaaaaataaaaaaaatcagctgggcatggtggtatgtaccctagccccagctactcaggaggctgagatgggaagatagcttaaacctgggaggtcaaggcttcagtgagccgagatcgcgccactgcactccaacctcagcaacagagtgaggaacctgtctcaaaaaaaaaaaaaacacacacaaaaaaaacacccatgctttattaataattactcaaacccagaaattacccaaatgtctaccaaatggagactggataaacaaactgtggtacattcacaccatgaaacgatacggagtgataaaaaagaatgaactactgatacatacactaccatggatgaatctctaaagctttatattaagtgagagaagccagacactaaaggctatatgacatcctagaaaagactaaatcatagtaacaaatatcacactggtgaccaatggttgccagggtctagaggtggggaaaagggacttaactgcaaaagggcacgtgggaactatttcaggtcattaaaatcactctatctagattgtggtgatggtaccgtgctatatggtcatatacatttttcaaaagtcgtgaaccatcaccaaaagggtgaattt

SEQ ID NO: 229175 - DNA, 487 bp, Homo sapiens
gcttagttagcaacagagagggtaaatatctgctttaaagatcacaatgtctgatggctatgaaacagatgagaagttttgagaagatgacatcaatatggtgttgattggtttcatgtggctttgagcttttctgccactgggaagatcactactgtacatagtttacatatgattcatgtgtgatgccagattgcagcttcttgctgtatcttaagtgtacttggtattctgattcaagagtgagatcttgaagctttggcaaatagaattgcctaattttcatttgtccactaagcaatgcatgcagttaaaaaaatgaaaacaataccaaacctccttcttttgcagtgaaggagcccaaaacaagttactctctttccgtctctctctttaacttagaatattggttattttgtattctcacacatgtaaaattcctttcctttaatgcatatgttctcaataaaaaagaattttccactga

SEQ ID NO: 229176 - DNA, 437 bp, Homo sapiens
tataacaggcgcctccttgaccgtccatgatattgcaaatatgtggtgccaaaagcttatgtgtacttcgtcaaactgaccatggcagctggacgtctccaagcagccacacatgtgaaggcggaactcacccaggccagcctaacaggcctgggaatttccaaagtaaattatcaagaaagccgaggctatgaaacccacaagtttaaaatgggcagggggctaattgtctctgaagtttaaatggcttgtttataaaaggcttctccagcattcgtattttttccccatttcttgaaaactacattccacttgaaaggagtgagagggaaacgcaggcgccctgtgagccttgtgagtttgccgttgagctctgcttcctttcaagatcttcacttctgggagagctcctcagtgaaagaaataaatttgagtta

SEQ ID NO: 229177 - DNA, 1634 bp, Homo sapiens
gcgcagcacaagaattcagtaaagttacaaaagtacaagactgacacacaaaaatcagttgtatttatatataccagcaattaacaatctgaaaaggaaattaagaaaacaatttcatttgcaatagcatataaaggatctaggaataaatttaaccaaggatgtgaaagacttgtataatgaaactacaaaacattgctgaaagaaattaaaaaagacataaataaatggacagacaccctgtgttcacggattagaagacaatatagttaaagatggtgatactatacaaaatgatctacagattcaacacaatttctgtcaaaattccaacagccttttcttgtagaaatggaaatctaatcctcaaattcacatggaatttcaagaagaccccaactgtcaaaaacaatagtgaaaaagaagaacaaaattggagaagtcacttctaattttcaaaatttacaaaaattactatagtaatcagagcaatgcggtactggcataagaacagacatgtaggccaatgaaatagaattgagagtccagaaataaacctatacatatgattaaataatttttgagaagagtaccaagaccattcaataggtaaaagtctcttcaacaaatgatgctgggataactggacatcaacatgtaaaagaatgaaatcagaccctacctcacggcatacacaaaagttaacttaaaaatggaacaataacctaaatagaaaagttaaattgatagaactcttagaagaaaacttagggatacatctgtatgcccttggttatttatgacaatggactcttacatgacaccaaaagcccaaccatcaaaagacaaagcagatacattggattttatcaaaatttaaaacttggcacaggcttgagcatccaaatcagaaaatccaagatccaaaatgctccaatagaaaatctgaacttgagcaccaacatgacacacaacaaaaatgctcatttgaacattttggagttcagatttgggaggcttaactggtaagtataattcaaagttccaatatctgaaaaaattcaaagcccttctggtcccaagcatttcggataagagatactatactcaatctgtacatcatagaacattatcaaggagcaaaaaaggcaacctataggagaaaatatctgcatatcatggatctggacaagggtctaatttctaaaatatataaagaactctaataaatcaacaaaaaaacaagcaatccaataaaaaatgagcaaagaacttgaataaacatttctccaaagatacacaaatagccaataagcatatgaaaagatgttccacattattaatcattagggaaatgcaaatgtaatccataatgaggtatcatgtcactcccggtaggatgcctcctcaaaaagttaaacaaagatttccacatgactcagcaattccattcctagtatacagccaaaagaaatgaaaacaggtactcaaaaaaatacttctgcacaaatattcatagcagcagtactcataatagccaaaaggtggatacagcccaaatgttcatcaatggataaataaacaaactgtgatatttccatgcaatggaatgttattcagtcataaaaggggat

SEQ ID NO: 229178 - DNA, 319 bp, Homo sapiens
cgattttaagagttttacttaaatgtcatcttcacagtgatgcctgatctgaccactgtacttaaaattgtaactccctaactttttaaaacttccttgttctcattatttttctaaagtacaatacacattctaacacagtatttttttcttactaacattgtcttttacctcccccaccccacccagaggtatactccctatacgaaggaatttttatctggttgttctttgttttatctctggtgcctagaatgacatctggtcataacacatgcttattaaatatatgctgaatgaataaatgaacgaactgcca

SEQ ID NO: 229179 - DNA, 563 bp, Homo sapiens
atgttttgagcaatcaaccaaaattgttccttttcttttcctgtagatgttctgacagatttgcagggctttcggctcactgtgctagtatgtaaaaaggtgttgtttacacgaggcaaagagaaaacatgctattcagacagttgccaaatagaataattatagcacaaatactgtaaaggtgcctggcaccagcaacctgagaaagtgttaaaaaaaaaaaaaaaaaagtgttacaagatttaaaaaaaaacatctttgctaatttttttgtcctgttgaacattcatggaattgttaatatgacttatatagacccacacaggttttatttttgtgtctttaaaataaaagtccaaaatatttaaattttatggtcaaatatgcagtcaacagctgctactttttctttatatattaaatttctcatatgtcttttattgttctaataaacctaagcttgtgtgacctccagtgcatattagaccattcactgtatgaaagaaaacatgttgaataaatttgtgagtttttaataaaaatagaaaatctgatgtttagat

SEQ ID NO: 229180 - DNA, 433 bp, Homo sapiens
ggacaggagacagggagacattgggtaggagagggcagttccttggcaaaggccccactctcaagcgtggaaatccacagcctggaaacccacagccctcagtgagaaaaagtgtttctgtttttgtacccaaaaagttgccttttggtacactacacttccctatcctgtacccatataaaccctgaaccctgggctccaaaaggagatgagcaagcagaacaacggcagaatggcagagcagaaaagaagagaagaagcatctgaatgtcaagaggagcacagctggggacaatcagagagatcagctgctggaccgccaaaccctaggggaagatcattttcccactctgtcccccttccagctccccattcatcctgctgagagctacctccaccactcaataaaaccctgcattcattcttcaagtcc

SEQ ID NO: 229181 - DNA, 430 bp, Homo sapiens
tgctcatcaagatctctgggagtttaaagctatatggtgccagtctttacccacagacactaggattaaattgatctgggtaccacctgggcatgaggattattttttccatgctccccaggtgaattctaatgagcacccaagacaagaaccagtgttctagagcagtgagcctcacactttaatgtgcacaccaatcacgtggagatcttgtcaaaatgcagattctcagtcagtggtctggagtggggctccagatgctacatttctatcaagctccctggtaatgctggggtagcaggtctgccaaccatacttttactattccaggcccttaggtatacatagatgtacatacttttttcccctaaaaattagatccaatcatagtcctgttttacaacgtgcttttttaattcaatgatccatc

SEQ ID NO: 229182 - DNA, 543 bp, Homo sapiens
taggctagatttcctaggggcctcccagctctctctgtctctgtgaccccgacccccacgtggcccatgcaagccccatcaggaagcagcctgtctcttgcctgtcagccacctgctgcttctttacattttccactggaaacagagaggggggaagtccggcagtactccaaaagatggcaggaaaagcaaacaaccctgctgtggaatgcagaaagttccccttctgcaaacctcctttccttattaggaactataatcctgcaaagataggtcttaatctctgcaactctgggcacagtcagggagagcctcctcgcctctggcctctggcactcctccttcctggcagcctatccatctgaaatactctcctcaccctgcctggctccttgcctgcccaagttcccccagcattcttcctattaaagagcatgtgtctggaataaaaaatataatacatacacagcatgttgacaaagagggtgtttgaattttcagtaatgctgttgctgggtggtggggttttacaggatttttaaa

SEQ ID NO: 229183 - DNA, 694 bp, Homo sapiens
cagataaagaatacgtgggctgggtgtggtggctcccgcctgtaatctcagcactttgggaggcgaaggtgggcagattacctgaggtcaggagttcaagaccaccctggccaacatggtgaaatcctgtctctactaaaaacacaaaagtgagctgagcgtaatggcgcatgcctgtagtcccagctactctcaggaggctgaggcaggagaatcgcttaaacccgggaagcagaggttgcagtgagctgagattgcgccacaacactccagcccaggcaacagagtaagactccgtctcagaaaaaaaaatggaccaggagagatattagtgctggttgggtggctccaaaggcagacactgttgggggactgctgcattaggtgactcctggagccttcaagtcttcaattttctttaggtttcatggggagtgaggcccttcaggctgctgagtgttacaagaaagttctccgctttcctgcctcactgagcagtctaaaggaggtgaggtgagctttctgctggcattacttctggcaccatctgcttttccctaaggccaaagtttccctgggatctaggggtttaggccactcaaaacacaattttcggccgggtgcgaaggctcacgcctgtaatcccagcactttgggaggctgaggcagggggatcacttgaggtcaggagttc

SEQ ID NO: 229184 - DNA, 846 bp, Homo sapiens
tgtcaggcgcataaacagtgtctagtttaaacttgctgcgctcctggtaattctgagtggcacggggtggcctttccacgtaagctgcatgggcccctcgggaacacagttgcgctgacctggaggaaagctctgctgtgatttgcccggagctgcagtactgacatgcgggcgtcagggtgtgcagcaccttggagccaccggcctctcaggtgtctgagctttcatttgctgctcatagatgacgtgaatgcattagagatgggtctcgctgtttcccaggctggagtgcagtcactattcacaggcatgatcatagctcactgcagcctcgaagtcctgggcccagcaaccctcccgcctcagcctcccgggccactgcatgcatggcggatgatgcttttaaaggctggtaaataaatccagtgttgaggcccttgcctcggtgctgacagtggaggttggccttctccagagcctttgtggcctgacagagccctgcccacggttcaggactcagcatagctgccacctcaacccaggtactttggtcccgcctggcagtgtgagatggtaaccagatggggcgaaacctgtgggtgccatggcagagcctggtgggtgctagcacggggctggtgcttaggtggcaccgagatcccaaagcacagagcttggagtttggtgggaacttactccctgggcaggggccagcgctgctgtgggccgttcaggccagggttccttccatccttccagctctcccctgccccaccgggtgctctccacgctgcctggtccttgggagcccacccccaagctagttccgggttgggcaccctctgc

SEQ ID NO: 229185 - DNA, 360 bp, Homo sapiens
gtgctgggattacaggcatgagtcactgcacctggtccttaactttttactaaactgtcaaatatttatacaacttttcagactctcaccagcattgtatgtggttaataacttttcaatgatcaaatatttttgctcaacattttccttaaccttgaaattatttgataatattgaatatcagcccttctttgaaatgcttgttcttgacttcatgatagaactctgttgtcttctttctattttgccaagttatctctatatgcctctttttacatatcactaatatattcagtttcaaatatcttctattctcataatttgtcactactattaaaatttatagactatgagttaaat

SEQ ID NO: 229186 - DNA, 158 bp, Homo sapiens
gtgtgcccctcagggcaaaggcagccatggtaaccctgccaactcatgccttaaaaattcatcgttgtttaatgcagtcgatgtgtctggtacacttaaaagtttcttgcagggagtggggtgggaggaggaggaggatgcggaacttgtttttctgg

SEQ ID NO: 229187 - DNA, 1196 bp, Homo sapiens
ctcaggtgatccacccgtctcggcctcccaaagtgctgggattacaggcatgagccagcgcgcccggccagaaaatttaaaattattttgaactgcatgaaagtaaaaacacaatatatcaaaatgtatacgatgcagctaaagccatgctcagagacaaatttacagctttaacacttttttgttttcttttgtttttgagatggagtctcgctctgtcgcctaagctggagtgcagtggtgtgatctcggctcactgcaacctccgccaaccgggttcaagtgattctcctgcctcagtcacctgagtagctgggactacaggcgcccaccaccaagcctggctaatttttgtatttttagtagagacggggtttcaccatgttggtgtggctggtctcgaactcctgacctcatgatccgcccccttggcctcccaaagtgctgggattacaggcgtgagccaccgcacccggccagctataacacttttatcagaaaagaacagtctccaataaccaaatcttcactgttgtggaacacctagcagtatttaaagaaaagaacatgtttagacaagtgtctgtatagttcgaagatatacaggttcacaccgtggagacaacactggttttgagcagagccacaaatagaaattttggttcctggggcaagcacctaatataccttcagatcaacttggaaatgcatgatgtgactcacagatgagtgttggtaacagatgcattactaacaacatcaaccatttggtggcttcttagatgtgaaaatcagtgtctaaaggctgcttgaaggagagttgacgataaatgcaaccaattacaaaactgcacaatcttcaaaagtaactatttttttttgtagacagggtctcactctatagattgctacagtaagtttaaatattgttaaaatgcccagactacccaaagcaatctacagattcaatgcaatccctatcaaaataccaatgacattcttcacagaaatagacaaaacaatcctaaaatgtatgtggaaccacaaaatcataccgggaaattctccagcacattgagcttggcaaagatttcttaagtaatactccagaagcataggcaaccaaagcaaaaacggacaaataggatcacatcaagttaaaaagcttctgcacaacaaaggaaatgatcgacaaa

SEQ ID NO: 229188 - DNA, 822 bp, Homo sapiens
gcatggcattctttctcaactcagagtccaaccacttacgcctatctctaggctcagggttgtttaaagagaaatctgtaaatgactgcaaagtgactctgtatttgtcttagagaagaaaataatgaggcctttgaaacaggtagtgaggtttatgcctacatttattcagtaagtattgaactcccttctcttttctcagccttatagtaggaatgtgtccccattgatgaaaaagtgtgtctatgtgctcaaggaatgtacagaatgcagataattttatgatttaaaagtttcagcgagacagggcactgtgaatcacacctgtaatttcagcattctgggaggctaaggcgggaggattgcttgagcccaggagttcaggaccaatctgggcaatataggaaggccccatctctacaaaaaattttataaaagttagccatgtatcatggtgcatgcctgtagtcccagctacctggggggctgaggtgggaggatcgcttgagcctcagaggtcgaggctgcagtgaactgtgattgcgccactgcactctaccctgggcaacagagcgagattccatctcaaaaaaaaaaaaggataaaaagtttgatgattccattcattgagaggaaactgaaaaataacaaaaatgtgggtgatattctgtatgtaaattgaaacttcaggataagttgaaatttttgaaagatgcctaaagcaattaggtggtttcataaatgagacaacatcacttaatggtagtttttgtaacatatttttaacttaagttttctcatgtaaatagtctctgtattgaa

SEQ ID NO: 229189 - DNA, 985 bp, Homo sapiens
agtagagacgaggtttcaccatgttggccaggctggtctggaacttctgacctcaggtgatccacctgcctcagcctcccaaagtgctgggattacaggcatgagccactgcacccagtcctcatttagatttattaaactttcatggttcgagctttccatatgttttgtttgtgacatggtctctctggagtacactggtacaagccttgaactcctgggcttaaatgaccctcccaccccagcctcccaaagtactgggattacaggtgtgagccactgtgcttggcttcccctgctcctcagattcttcaggtagaaacttaagttattgatttgagcctccctttttcttaatccaaagctaaaaacttttgagtgttgcttttttacatctcataaatttggatatattggggttttgtttgcatttagtttaaaattctttttttttttttttttgagaacggagtctcactcctgttgctcaggctggagtgcagtggcataatcctggctcactgcaacctccgcctcccaagttcaagcgattctccctacctcagcctcccgagtagctgggattacaggcacatgccaccatgcccagctaattttgtatttttagtagagacagggtttcacatgttggccaggctggtctccaactcctgacctcaggtgatccacccacctagacctcccaaagtgccaggattacaggcgtgagccaccgagcccggcccagtttaaaatattttctaatttcctttgtgatttcttccttgttacatgggttatttagaagtgtattaggctccatgtatttgaggatttcccaagtctttttctgttgttgatttctaatttaatttcattatttcatttttttttttatttaccaaggcttgttttatgtcccaaaatggtgtcttttagtggatgttccatgttcacttgagtagaatgtgtagtctgctgtcat

SEQ ID NO: 229190 - DNA, 444 bp, Homo sapiens
tggtcttaaactcctggcctcaggtgatctgcccgccttggcctcccaaagtgttgggattataggcatgagccactgtgtctggccatgagtttttatggagctcctgttgtgttccaaggaattctctgcaacttaggacagatgggagatgagtaaagagggttctttctagccttaaggaaatttgaagcaaggagaggacagacaggaatcagaggttcacggaagaactgataaagatttgtgtatgccacatttggcttctgtaggaaaaagcctctatatgtatcatttaataaatagctaagcgcggtggctcacgcctgtaatgccagcactttgggagaccgaggagggaggatcgcttgggtccaggagtttgagatcagcctgggcaatacaaaaaataaaaaattgaagtttctcatttctacaaaaaaa

SEQ ID NO: 229191 - DNA, 648 bp, Homo sapiens
gcaagactgtgtggccttgacatgggccagggaacagggcccgtccccaggcatagtcccggctgaggacaccactgtcagcacagacagtgcagctgagccactagcacatggagtcacctctggccttcaaggcccaggtctttagataataacttaactcttttgaccaattgtcaattggccatgtacatctcccacgtactgagtgatgtctcgtgtcccgaacatgtatcaaaccagctgcaccccaaccctctcgggccacacatgttctcaggatctcctgggacggcatcatgggccttccgtcactcatatttggctcagaatcactctccaagtattttacagggtttcactcttttcctcgacaacccccagcgggcagctactgttgggggctctgagaccgccggcctgcagggtatggttctcccgaagctgcatgttcagacacaattggaggccgtgcttccaagggggtggagtgagggccctcaagaaaggccaactcaggaatttccaacgtgacccacagcgtctgagctattgaggaggggtcacccgaagaagccgctgggcttgggtgagaacagatgttcctctggccttcttgcctggggctgctcctgaaaccacctttgc

SEQ ID NO: 229192 - DNA, 471 bp, Homo sapiens
gacagtcaaaagaagaatccataagacgctacctctgaaaaacaaaggagtagggctttcaattatttgactaatgatcaacatctgccatctcaaatgtcactgtcctctggtattatctcaagacattcatgttaaaaacaatttttggtgaaggcaaagctaaaatacgtcatctacttctagattagtataactataacagatttagtaaccctaaatgagattctagaaaatatttaagcagtgaaaataccttcagaaaatagacatctgacattcagttccaaacaatgaagtacaaaaatatttattaaggataaattacaaggcagcaatgtagattgctttatatatggagatatataaagaagtccactgttataaaatattttagttggcaaggaaataagacagatcattctacctttgttaactggtatgagacagatataaaagtcacaaaagaga

SEQ ID NO: 229193 - DNA, 602 bp, Homo sapiens
attcctaataaactttcttttctcacaggataattatttctattctatatttaagaaagtcagaacttaaactattttagacaccacaattagaaaccaacagattttacgctaacgaaataaatcagaaatgttatcagttcccccatgtagaagttccctcttggttctgttttgatctttataatttattccaagttcacacctctcagctctatataccttgagcagtacagacgtcccccagtaacctcaggggattggttacaggatctcttgcggggatgctcaagtccctgatataaaatggcatagtatttgcataaaagcctacatgtatcctcccacatattttaagtaatctgtagattacttgtaatacctaacacaatgtaaatgctgtattgttttttgtttttattatttttattgttatattgtcattttttgttgttgctttttctaaatattttcaacctgtgataggtgtaacctgctgatacaaaacccatgggtatggagggctggctgtacctggttgggaataacaaaattctgtgccaatggaaggaacactatcaggcagtccctgaggccctgag

SEQ ID NO: 229194 - DNA, 363 bp, Homo sapiens
atcctgtaaaacaggtacagtactataattaccctcatcatatagatgaggaaaatggaacacctgtgataaataaacttgctcaattctcccatttagcaaatagcactggtgagatttgaaccaggcagtctgaggccaaagcttgtgctgttactaacattcttgccttcctacagcctgtctttgaaatgactccgtgatttctccacatggaaatatggcaaagtgtttttgatggcccacatccatggacctactgagattttataattttaacataaatttgccttcatctttgagcctctggtctaccccttgaaggccatgagtctgacaataaaagcattatactgttaaata

SEQ ID NO: 229195 - DNA, 449 bp, Homo sapiens
ctcagcagggattcacacccagatctgtcagccttgtggacagctgtgctgtccagaaaaggctgggtctcctctgtgtatgtactggggggtgtggggagtggggagggcatctttgggtggtcttggtgcaggcaacctgcacagaaggggctggagctttaaggggcggctctgaagccttgagtcttcatttcagtctttggaatgtcactttgaccccatttccctctgccttagtgaagacaacaaacatgccccaatacacgcagtctgtgcttctcactctcctgcctgtctggaagattcgggtgtgtttccccaagtgtcatcagggtacatgagatgggattttaaatgaaatgtttttaaaattgattgtaaatggataacatactagtgtgataaatgtttcctcttcaaaataaattcattgtaagtaaaaacat

SEQ ID NO: 229196 - DNA, 977 bp, Homo sapiens
tgagatggagtttcactcttgttgcccaggctggagtgcaatggcacgatctcggttcactgcaacctctgcctcctgggttcaagtgattctcctgcctcagcctcccaagtagctaggattacaggcatgtgccaccacgcccggctaattttgtatttttagtagagacgggggtttcttcatgttggtgaggttggtctcgaactcctgacctcaggtgattcatccgcttcggcatcccaaagtgttgggattacagccgtgagccaccacgcccagcctgctttcatttttaacagtacacattgaaatacagaaaaggtgagaggaagcaactttcattgtatcgtagcaataaactccacactgggtgacatctacctagaaatcccttccctctaaccaggccatgatgggaacctttgctgcctgcccttggagaaccccggattggcttccctgggactcaggtctggtggcaggagggcagcagtgtgcccccaccatccctcatggcctgccgccagcagggccataatggcaggactttgatttgacttccagccccacatgaggaggggggctaccaagccaggtgcagtgtttgtggccctttatttaagttgttttcttatattattctgcatataaacaatgacgtttaaatggaaaaaacaacaacaacgaaaacctccattgggtggagccacactttaaatgaaaatttctctttgactatgctcagaaaaaaaaatagaattttgaatatatttagcagttgttgtctatttttaactaactccatatgctgccagtatcgacttcatgacatttgccaaaataaaattttatttttgcctttataagattttcttggaaaaaatgaaatgaatattttgcaagaaaaagttaatttaaaaatgtaatggtttgcaaaaaaaatgtgatgtacagattaaaatattaacctgaaa

SEQ ID NO: 229197 - DNA, 566 bp, Homo sapiens
agtaaaagagaaggctaggaacatggctgtaggtttggtactagaagaaaagtgggacctattccgacttcctgatcctgtgatttttttctttttttgagattcacacacacacacacacacaaactatgcacaagtttgcttccatgttgtatagcaagagtttaaatatttctgagttaatgatgccaaactgtgctccgattatatcagcatatttacatgatccttgaacaccacatatagattcctatactacacatttaagcaaaatcacctcctgacttcacaatgaaagagacctattggattaaaaagtggtttctagtaaaccccaaagagatactgttactaaattactaaatttaaaggcaaaatagtattcactaaactgatttttctgtcttattttccttatttggcataatcattaaccaacttctagtaaatggaagcattctcacaatttaagtttttttagggggaaacacacaatttataaatactgtcaagtgaagaacagattcctgaatactaaaagacccatgcatatccttgtatgtaaa

SEQ ID NO: 229198 - DNA, 405 bp, Homo sapiens
caaaaaactgcagttatgattaaaatgacacataggacacacaggaaaacatattcaacagaaagccaatgggttcaattatttctttttttctctaatttcaaaaatgtttaagaatttatatctgggcgcagtggctaacacctgtaatcccagcactttgggagcccgaggcggcagatcacttgaggccagaagtttgagaccagcctggccaacatggtgtaaccctgtttctgctaaaaatacaaaatttagccaggcttagtgccgcttgcctgtaatcccagctactggggaggctgaggcaggacaatcacttgaatctgggaggtagaggttgcagtgagccaagatggtgctgctgcactccaacctgggtgacagagcgagactccgtctcca

SEQ ID NO: 229199 - DNA, 421 bp, Homo sapiens
tgaattccctctataaaactgcatttgtactactgtaaacactagtcaggaaaaattaaatccacatacttcctaagacctttgagcagtactgggtgaagtctagcaaacaacagggaaattaataaacagctctcattaagccacatacactaatcaaactacaaatctcatgggcctattttggcccacaaggtgctgatatgctagagaggtgctacgaaactaagaagtaagctaggcacagcaatgcttgcttctaaatcattcctgcaagacagaaatactaactgaacatccagttgcattacaaactttctggacagcatcctctacttcatctctcaggtcgtcttcagagtccattccctttgtcttgatcttttctcttttatttgattcatcttgatgaagcatctga

SEQ ID NO: 229200 - DNA, 653 bp, Homo sapiens
cagagtgttatgaaaggaaattataggagaatggggtaaaggacagtctctctgaggagctgacttcagctgttacctgaaagataggaaagagtcagccgctcaaacagcttccctgtagcgagcattgtaagcaccaggcagtaaagagactgatgtgtactaggaactagtagatacccaaggtaggaagaagaaagcaagccagaattttccctggttttctggaaaaggaaggaggcatgagaaggcattggactgggattcatgtccccacactgcatctcaggtaacctgtagactccctgaagcagggaccagttttcttgttcaatgctctgacgcccagcagagcatttagaccataggaggcacttaaacatatttgctggataacacataaatgaattttaacttgtattctcatttgcttctttgtcaaatttaattgaaaaactcagagcctcagagttagaagggatattgcgagtcagcttgtctggtcccccatctgtttgcgtaaatcccctctgcaacgtgcgtggcaaagacccgacagcctcgactttctgagcacttccagggaggagggctcatttcctttggacccagttcagcaccttaaaaaattattttgtaaagactgccatgca

SEQ ID NO: 229201 - DNA, 644 bp, Homo sapiens
aaaaaaaaggtaaagctgttgctacttgccagcttttctttttgccttttgctgatagatggcactttttttgctggcactgttatcaactttattaatagatttaaaagtactgacaatttttcaagccacaaaaggtttaaaaatctttggaacttcttgtcatacttctggttttctgctttcctgaggccgttgtcccatagagtactgtcaatacagtgttgagaagtgaatgggagttaaactagctccctaatatgccatcagtggcttccagtccatttccttgaggggtctaatcttgggctttggggagattacttagagatttatacaggtgagtagtgaaatttgcccagggatttgagttgtactttttagccttacggattttagctaactccagagaaaatgcgaaagagaaacgttggttcaagacagacagccctcaacgaagaattatcttcataagcttgctttcatcctgtttctcagagagttccaggccagtgtcagaccttccgtggctctggacaatattaatagttcatgaatgagctacaaaaattcctgatggatgcaattgtatgagcctatagtcccggctacttaggaagctgaggcaggaggattgcttgagc

SEQ ID NO: 229202 - DNA, 437 bp, Homo sapiens
ttcagggaacctggcacacaaatcaaagtgttgtctttctgtttggaagggaagccttcttctttaaaaagtaacctgacatcaccagccctggccggaattgttgatgcccagatagagttggcctcccccaggctcatctgtcctgagtacccttctcctctgctatgtagcatgacccaatctactccctttcccagggtaggactagggcagcctctccagattcttctttgttactcccattgcaacaaaacaatgtggtgggctcagaatgaaggtcgacattgcttttctgcttttcagcaactgtctattgctgtttctggggcttctgagagaaagatttgtgggaccctcagaattcactcctccccagggcagaaccttcagtaaattctgttggtggtgttccatccaacatttcttgatcagct

SEQ ID NO: 229203 - DNA, 448 bp, Homo sapiens
ctttactgtagcataatttataatcatgaaaaatatggagccattaaaatgttctaacactagggaactggttacatacaaaatattcatccacttgataaaacactacatagctgtcagaaatgatgctcactcaatgactgggttaacgtggaaaatgttgattgtattattaggtggaaaagagcaaggactttcttaccttttacctaaggggaaacacatctctcaaacttgtgtgtaggaaaacaaaaccccttaaaggaatacagcaaggtcacaatgcagctgtttatttagaggtaaatttggtgattccttcccctcttctttctgcctttctgtgtttttcaagttttcagttatgcacattacagttttataaaatagaaggaatatagataataaatatttacatcaaatctaaaataaaatgtttaaaaagagg

SEQ ID NO: 229204 - DNA, 392 bp, Homo sapiens
aacagcaagactgaccctgtctctaaaaataaataaaggtagaatttttgataagttggatgtgggctatgaaagaggactccttttttttttaggtgaaagcagctggaagaatagtttccatactgataatggggaaaataggatcaggctttgtgtgtagctgtggtccctgagcaattgggtaagaattcagagaaagctctgggctgaagatttaaatttggcagttagcagcatgtagctggtatttaaggccataagactggatgaaatagcttgggggcatgtagatagagagggctgggaactgaactctagagaactcataaagttatgagcttggtttggttggttatatagaaggaactggcaaagatgacaggagggcc

SEQ ID NO: 229205 - DNA, 341 bp, Homo sapiens
aagtgagatttttgacatagtttaaggaattggtgtgccaaaatctttttataaagcatttctgaaaatcctacctcaaattgtgcaatctcttaattatttaatccattgactagttctgtgcagttcagataaagcatcataattcaaccgcaaagtcagtgtagtgttctattaaacatccatatagaaaactgaaggataagggattttgaagacaacatacaaggttaaactagtattttaaaattgaagtaggcctcctaaatgtaataattgcatatctgacttagttaatacttcaaatatagtcaaatcttattaaactgtactaatataat

SEQ ID NO: 229206 - DNA, 202 bp, Homo sapiens
aagatcacctcagaagatcacctctttgctgtctttggtacaacataaaagaatctagagggcacttctaatgattcagatcccttaagaaacacaaaaaaaggtgccatctacctcttacttgtactgtaggagaaatgtgacttgtgtgtgtgtgagagatgagtggtgagtcatcaccacggtaagagctacagtttta

SEQ ID NO: 229207 - DNA, 319 bp, Homo sapiens
aaattttgttttcctgattcaaaggactggatgccaacctcagaactcaagaggtaaatgggctaatttatctgatttctattcattagacctgcaaaaataaatcagagtatttgagaaatgggtacagccattagtgaagctatgtgaatactgtggcaagtcaaggatgtggtaggaggaaaggaagaagcagaactagaacatttcctatgtggggcttaaaaaaataaaaacgtggaataatttcagtgtcaaaaggaaaacaaatttgagagtctcttcagtttgccagttctacaaaaaaaaaaaaaagttc

SEQ ID NO: 229208 - DNA, 417 bp, Homo sapiens
tttcctccttcatgtagaatttgtaatcaagagcccaattttgtcatttggaaatactaattatctaatcacggcatgctgtataacgtacttgtctgcccaattagctaggacaattattaaaattcagaggcctaattatgtctcaatttaatgctggcaaacttgcatacagagcagtaattaaaatcctctctttccctctgcctttagggcaggggatgattaggccctgtcagggggtgtactgaaccaaaccagtgaagcgtattgtgcaacatgaccctgcattgttaagtgtgtcaacatattaacctgaattcccttcagcccccacataatcacatttggtggaagaatgaaggagctaaaacatgaagcatttttttaaaaaaacataaattcattttaattaaa

SEQ ID NO: 229209 - DNA, 717 bp, Homo sapiens
aatctgggtaattcagttcttggagcatttttggggactgtgctctttgggggacatagcccatcccttgagtttacatctagtggggagaggtggataaggtatgtatgccaaggtaagatgttgaggttattgccacaagagaaacacaaagtcctgtgggatccagtggcgagaaggggaaggccaacaatgggttgttttatttcccaagtaccaaagagaagaaatatttttttgcaaatcccatgtgatgttttgtttcttctctgtttagttggaaatgtgttcttggccaatgcctctttttttaaaattttttaaaaggtaatggctatgccttctttttttttgagatggagtattttctcttgttgcccaggctggagtgcaatggcatgatcttggctcactgcaacctctatcttccgggttcaagcgattcttctgcctcagcctcaagtagctgggattacaggcatgcgccaccacgctcggctaattttgtatttttagtagagacagggtttctccatgttggtcaggctggtctcgagctcccgatgtcaggtgatccgcccgctttggcctcccaaagtgctgagattataggcgtgactcaccgtgtctggcagctacatcttaagatatttcagttgtctcatgttaacagaaaaattaatgcagtcatgttttcaggcttgggaatatgtacct

SEQ ID NO: 229210 - DNA, 549 bp, Homo sapiens
taaccctctttcaaaattaagatttgtttaagtgtgtttaaataattttatcctggttggatatttttataattctatatattcttttaaaaacctataatatatctgattgatctgatgtaaaaacaagaagaaattctagcttcaaaggccaaaatgcatataaaggtcataatttcacaatagcaactacagaaacacattgaaggcattgggtctttctcctgttgcttctggagaaagaagaagaaggataaatgaaggaaacggaggacgcatggcatttccctaatccattttttgtagcaactctgacaggcgagcttgcaatggaaaattgtgcctgatccttgattcttgaaacaaatttccccaaaataaacttttactttagtgatgggattaaactcagtaaaaacagtcaaggattagtgaagaagactccatattctatcagaggatttgtaaaaaattctaattctttgacactttaatttgtggaatgggccaggtgtggtggctcacacctgtaatcctagcactttggga

SEQ ID NO: 229211 - DNA, 482 bp, Homo sapiens
ttgattaaagaaaatgattggaataatactcattctttgaaatttattgagactccttgtggtatagtacagagtagatttttgtgattttcccatatattcttggaaagaacgtatattctctacttgttgagctattctttataactttgactatttttgtctgcttgaactatcagttactttcagcattgtgtcaaaatttccaactaccattacagtgtcatgcatcatttaataaggagggtacgttctgagaaatgggtgccgattttgctgttgtgaaatcatcatagagtgtacttacataaacctaggtggtatagcctgctacacacctaggctatatggtatagcctgttgctcccaggctacaaacctgtacagcatgttattgtgctgaatactgtaggcagttgtaacacaagggtaagtattgtgtgtctaaacatatctagatgtagaaaagatacagtaaaaaa

SEQ ID NO: 229212 - DNA, 549 bp, Homo sapiens
cactggcttgacggctttctctgaaaccctctgattccgcctggcccatccacactgtcccttcccggccagggctcatctcctatgcctggaccaaacagcgtagtctccagtctccctgatctccccacacgtggccccacccatcctctgaagcagccccaggaggcagcagtgacttcacacttctagtgcccggccctcccggccctcctctctgggcttgcttgccagggtcctcccaacctgactgctgcctcccacctcctctccgcccctggagctctccagccgcagccgcggggcctgcttgggattctcctctgctggcatcatccctgcctgcctcagccttcccaggcccaatcctgcccgatctcacctcttcccgcccagccacctggtcgggtcccgaccagcatctgccttcaaacctggagtccttccctgagtgcttgcggtgcactgtgaggaaggaaatcaatgtaaggattatgacccacattttttaaaaataaaaagattaaggagaacagcatagagtagaaa

SEQ ID NO: 229213 - DNA, 448 bp, Homo sapiens
atattttacttcatcaaaatagccctcaatggcagccgtaattgaatggttttgttttttaaatttctaattctctaaatcttcattggtcaatgttttaggacatggtaaggatctttgttcaaatgtgtatgcgtgtcaatgtgtgaatgcctacgcatgatttaattcttccagttgataattggaagataatgagtcaatcagacatatttaccaattaacttttctgtaagaattcataaactagacatgtgagtcctgaggaaagaaaaagaatacaacccttgccctaaagaacacgacgtgtcagaattatataaaatttggcagggtgtagtggcacacacctgtagtcccagctactcaggaggctgaggtggggaaatcgcttgagtctaggaattcgagaccagcgagggcaacatagcaagttgctgtctctaaa

SEQ ID NO: 229214 - DNA, 475 bp, Homo sapiens
aaatagttgcacagcattgtgaataattccactgaatagtacacttaaaaataattaagatggtgcattttatgttctgtatattttaccacaatttaaaagtttgcttcaaactgtgcctcaaatctgcctacccagtgttcttatgctgaaagttttctgcacaagagtcacttgtcaagtcatttctgaagataacatcttgtcatttcttgattgtggaaatggatcaaaaatgcttcattaaatgcttatagcacctttaccaaaatctgaaatgagtgaaaactaatggctacatttatatcctgagttctaaagataaattggagactccttgaaacttagaattgtaatgccttcatgttttataagattatgtcttgttattcttaatgacaatttagaaaaaaaaatggtttttaaaatttaacagatagtccagaccatggatgtaaattggagagagaattaa

SEQ ID NO: 229215 - DNA, 357 bp, Homo sapiens
aggtagcccatggactgcagtcttaaacgacgtccaaagcaggactcagccggatcaatcagctgtggtgatagtttttcccagtgattgactctaaagtactccagaaaatccaatatgaagtatttcacaagaaaggcagtcttataaagaacagatgtactaaacggattgtactgctcacaaacaccaaactgaaatacagttaatagagagcagcaaacaagtttgaagacccaaaagagaacatttttaaagaagctgtaccatgtgaaagagacatcatttgtcacagcattgagaacagaattgtagaggggtcatggggataaaaatgcatatctgagaaaacttcat

SEQ ID NO: 229216 - DNA, 315 bp, Homo sapiens
aggcgtgagaatccggaactggcaatgcactgtctcctattggtcaatgcaaaatgtttaatttgcatatataacacaaggcggggccctccggtgaggtcacgtggctatgaaccactgaagaagaccccggcgcaggggtgcggccggagctccagtggcgcaatcggttagcgcgcggtacttatatgacagtgcgagcggagcaatgccgaggttgtgagttcgatcctcacctggagcactttttttccccatcagtttttataaacttacacatctaataaaccaaccaaaacatctacatcaaaaaaa

SEQ ID NO: 229217 - DNA, 437 bp, Homo sapiens
gatttttcacacaagctctatttgtccaactgtcccagtgcttctgatggaccagtcactgattcttcctctgatcccctgactctcccttctagatgttcactccctgagatccttcctcatctgtgagatctgaatcctatagtaaatttttatcctcataatactcatagtggctctgcttccctgaaacacctgggcctacacacacttctttgcatggcggttcttgcctcatcacttaagtctcagtttaaatgtcacttcacagagtccccttctcttatgacccttagtaaaataaccactctttccccagactctctctctggtagtggtagtggttccagtgtgtgtaccttatggagttgatgaaaatatttagaacttacatttttgtctaaaaaacaagaaaaaactgaaaattgactgtaaat

SEQ ID NO: 229218 - DNA, 301 bp, Homo sapiens
ggggaattttaattttatttaattttagttcaatttaaataaccaaatgtgaatactggttaccatattggataatgtagatttaggccctcatttataaatatgagctaagcagactaaactttttaggaaaatagaaaccatgaaacgcatgctagaaaccctcccatgcccagttaagagaggtaatgtaagtcacagaagagtacttttaaaaacccgaaacccgaagtatcctaaattatatccttaatgattcaaatagctttcaaagtccaaaaaccagcaaacactgctgttg

SEQ ID NO: 229219 - DNA, 525 bp, Homo sapiens
tcagagcgcggttagttctgcgctcaatctatcctcggcgtgggaggtcccgccccttccggcctgtgattggtctgcccgagctcctcgcagccgcattggctgtcaatatcaaccaatcacctgctgtttagccccggggctctctgggagatgtagtcccgctccccagtttcccgcgggagcttttcgcgtctctgtgtgcccaggatccggaagtgtaagcctaagtggcccctctaaggaaaagtcacagcgccaagttcgtgctgatctcgacacgctgtgtggtgtcgagcctgaaattttagttccgttttgctgttgacttgcgctgggcaagacagttaacctctcagtctccacactctacaaacaagaatgataggatggtagtaattagaattttttagggttgtagtaggcgttaaatgagatcgtttgaccgcgctatgaaaactctgaattaccatatgggggtgttaattgtaacttattgacagtaaacatatattgagcacctac

SEQ ID NO: 229220 - DNA, 364 bp, Homo sapiens
tactgctcagatgagccgagcctgaatttgggagtggttgttacagagcattaccctggcaataactgactgatgcagagatgtaaatagacatcactggtggagcccccaggaaagctctttaacagaagacagactcagctggcaggtttcccgtctccttgaatgaagacaggctcaatgcttggaggggtgagaggaggcagccatcttacaaccacaggtcacaggaagacactaaacaaggccgtgtggaaagacagaaggagcctccatccctcagcaccacagagacattgtatcagcctagaaatgcctaaatctgaacttcctcttacctaagaaaaataaaacctcaatttga

SEQ ID NO: 229221 - DNA, 464 bp, Homo sapiens
  misc_feature (30)..(30): n is a, c, g, or t
  misc_feature (132)..(132): n is a, c, g, or t
  misc_feature (142)..(142): n is a, c, g, or t
cagtaaggctgtttgctttcttatttgtgntattcaaagaagagagacaggaatacttgattggaggatcagtcagcatacatacaacattcatcaatataagttccccatcttatatgggtgtagttggtnggcaccccangaacaactacaatagtgacgttaaagatcactgtaggccaggcgcggtggctcattcctgtaatcccagcactttgggaggctgaggcaggcggatcacctgaagtcaggagatcgagaccatcctgaccaacatggtgaaaccctgtctctactaaaaatacaaaaattagccgggcgtggtggcgggtgcctgtagtcccagctactcgggaggctgaggcaggagaatcgcttgaacccgggaggcagaggttgcagtgagccgagatcacaccactgcactccagcccgggcgacaagagcaaaactccatctcaaga

SEQ ID NO: 229222 - DNA, 401 bp, Homo sapiens
tgttcatatccttgttagtccctgtgtgtctggattggtttgtatgaccaatagaataaagaagaagtgatcatgtgtgaatacagagactagatcataaaaggcattgttacttccctcttggtcactctctttagaatagtttcttttgagggaagccagctgttatgccaagtagccttctggagtctcttgtgacaaggaactgtggcctcctgacaatagtcagtgaggaactgagcctctagccaacagccacatgaaagatgccatgttagaggtgaatcctccatccccagtcaaatcataactgcagccctggccagcaacttggctacaacctatggaaggccctaagccagaaccacccaggttcctggccctcagaaactgcacggagg

SEQ ID NO: 229223 - DNA, 369 bp, Homo sapiens
ctcaaaaaaaaaaaaaaaaaaaaaatcactgagacatactgccaaggacagatggagttagggggcttaaagatcctctataccagccgggtgcggtggctcacgcctataatcccagtactttgggaggccgaggcaggcagatcaagaggtcaggagatcaagaccatcctggctaacacggtgaaaccccatctctactaaaaatacaaaaaaattagccaggcgtggtggtgggtgcctgtagtcccagccactcgggaggctgaggcaggagaatggtgtgaacccgggaggtggagcttgcagtgagccgagatcacgccactgcattccagcctgggggacagagcgagactctgtctcaaa

SEQ ID NO: 229224 - DNA, 509 bp, Homo sapiens
ctgctttcttcttttctatgcgcaagccccaccacagtgtcttctagccagcattcaaggcccctgaatgtgtcactcagtcgggcgtgtgagcatttccctgcgtttttggttagcagctgatgaggggagatgagtagaggaaggagtgggatcagaggatggctgcttcccttctgtgaggtcccgcacagtcagtgctatttgtaggcacatggagcctcaaggctcaccaatatgcccagcctcccatgggggctgtgcagctctcttcctcaggtctcccagggaccctgtgggatccgcctgcccacacctgccagcctgtggcatgacacatttgtggcagtgtgtaaactttaccctaaagttgggctactgcaaaataaaatgaaagtccactgaattaatcaagcagaaacgtaaggagcttagtctaaagtaaaaattttaagtgaagagactggtggcatttggaaactctgaataatgcattttcctcatgtcag

SEQ ID NO: 229225 - DNA, 408 bp, Homo sapiens
atctgacttttaaaaaaaattatctgaccttgagttatagtgccccaaagtaagcaaagttccaaacacacagtatcatcagaattgagttaaaattatcaccaggggcttaatttctgaaattaaaaaggaaatgttatttccttatgaaaagaaaaggaaccaaaaatgaacttcaaggtagctgatttctgtctatgttaagacttaggtaatgggagaaagggaaaaggaaggacagaattaggagaggagcagtgtttaacaattgcgggtgcaagactcaagttttttagaatccattagcagagaaccctatttctcccattaactgctgtccttttaaatcctggcaccagctctgaggactgcagggtccatagctagtgccccactctacccagttta

SEQ ID NO: 229226 - DNA, 489 bp, Homo sapiens
acatgttttacttatttattggcattggcatttaaacacaattctgaaacatttttaaaatgcagaaaggtttccagagtagtacaagaacttctattaaatatctatcccatgcccaataatgtcctttatagcaaagggcccaatccaggatcacattttgcactcaattaccatgtctctctagtctccttcaacctggaacagttcttcgggatttcttgactttcatgatcttgattttttttttttttttttttttttttgagacagggtctcactctgtcacccaggaccatattgaattcctggactcaagaaatcctctcacgtcagcctcccaaattgctgggattatagccggaagtcaccgtgcccggccgtcatgaccttgatatttttaaagattacaggctggtcattttattttgttcttcaatttgggattgcctgatgtttcctcctgattagatccaatttaggtatctt

SEQ ID NO: 229227 - DNA, 427 bp, Homo sapiens
agaaccaaaattctgtcacaagttgtttccttgattttggtgacaagtgacaatgggcggatgccaagagtatgctaagaattgagacaaacatctctccatccctggcccttactaccagttagatgacagtcatcaattttgctgactctggatctgtttcctttgctggaactctcagataatcttatagctccaaaacccagctcatatcagagaaacagaatagtacctgcctgacttggtttttagctcaggtggtatctggcaatcataaatatttcattaacataacatttgcaaaaaaagaaatacatgttttgtatgtatagttttgtaaatcactgcaaactctttctgaaagcaagcagggtacaaataattaaagtaaaataaaataatttggaagctgaacaagaacaataaa

SEQ ID NO: 229228 - DNA, 730 bp, Homo sapiens
ctgcctgggttcttattctgcctccaccatttattctgtaactttaggacaatatgtttagcctctctgtgtctcagtttcctcttctacgaaatgttattctgatgacacttcttcaggagctctgtgaggattaaatgagatgctacatgtaaaaggcttaggaaatgttagccacttaattctactttggaaaattttaatcattgctgttttttatctcaactgttttggcactgtaactagcacatagtaactactcagtaagtagttaaatgaatatcgtaagtattcaatatacttctgttagtacagagcagtataatagtcagaatttaggaattaaagcggtcgtatgcctggtttcctagttattggagggttggaagttcagtcattcttgtcactttcacaaagagttcttctgtctgtagctcccctctcactgcaggattgtaagtgctttgcaatgtccaggcctcctgcctctaagtgcttcacacactctcagttcccctctgctttctctcactttgcattactttctgggtcatcagagatgaggtagaggtgataagaggaaaccaaggactgggatttgaaataaaactatgccctcttgagcaagtcacttaacctctctagtcctaagcatccttccctacagaatgggaataatatcttcccacataagatttgtggtagtggatcaaatagggtacagcatggg

SEQ ID NO: 229229 - DNA, 357 bp, Homo sapiens
gctttttatttaaattagcaatctaaatgaaacagcacaggatattaattgtatttggacaactgagttccttcccgcccctatcctcccaaccccccaactacacaaatttgatcaaaatcttttagagagggggttagggataaattttcaatgaaagagactgtggaaatcggaataagagatataataaagaatgcagccataacggccaaaagagtttctgtattagagagcctgtccaggattgaagttcagtcctgaaacccaggactgcagttgtcatttgaatataaagcggaaagcagtagaaaatacttgggaagggatttgaaagtggaccaagactggtgtaaa

SEQ ID NO: 229230 - DNA, 291 bp, Homo sapiens
tgagctactagaatttaggatttcaacatgttttgaggagggtcgcttgagtccagaagatcaaggctgtggcgagctgtgattgcaccactgcactccagcctgggcaatagagcaagccctgtctcaaaaaaaaaaaaaaaaaaagtcatctcctttgtcttctgattccgtgagctctcatagaaaggaagtgaagcagtgaaagcatccccccaaaagggagttttcaaaaccagcctaagcaacatagcaagaccttgcctttagaaagtatttaaatttgaagga

SEQ ID NO: 229231 - DNA, 701 bp, Homo sapiens
gaaacatttccagacagaagatatgtaaaagaattccaagatgagagataaggatttcaacagggcagtgacatgatcagatttggctttaaaatagtaatcctgggagcaatatggaaaacagagaagagcccagtgaacactgtaagactagcaacactgaatatttcaagagagaaatgaaggtggtttgatgttgagtaacagacaataaagagaaaactggagagtctagcaacagatgatgtagggagaaaaaaagaacttataagaataattctcaggtttcagtatgatagtgattatcaactgaatgatagtgattatgagctcatttggacatgccaagtttgaagtacttcagagaatgaaggctccattaactagacaaatgcatatatgagtctgaatctcaggaaatgaagctagagacacaatttgggaatcatctgcacagaggcacatgaagctacataaggtgaagagagtgtaccatgagaagaacaactaggactaaaccccaagaatgcctctatttaaggggggatggtgggggcagttagtagtcattgaaggaggaggagaggctaagaaacagatagaaggtaggtaggaggcatacaaagagagttctttgttacagaaatcaaggaaacatgttagaagaacgaaggaatgaccaactgtggcaaacgctgctt

SEQ ID NO: 229232 - DNA, 376 bp, Homo sapiens
gacatttccagaataaagaatggggaaaagcagactaggttttcaataccctttcagtagaaaactgccccataaactcattggctacctacttcttaatccccaataactgtttttatgtgcgcatccccacccccataataggcttgactcccaccctccaatacaaacactgggctttctccagagcagatcaggccaaaagcaagggctgggacaggaaatacacttacagggagaagagctgggtctgaatgactccttgaaagataatccttcatgtattcactctaaaacacgaatctagcacttactatgtgttctggtaccattctagcactggggatgcaataaaaatcaaataagacgtggttct

SEQ ID NO: 229233 - DNA, 422 bp, Homo sapiens
tcagagcaattctgctcaaaatttgggatatcaagaagaatgaaattactaatcttttttgtcatcctccttactgttatccccagatatttgtatgtttctattttcccacttacaatttagatcacttgtaaacatacatacaatggagttttggcaaattttgagcttaccgtgtggattaccttctggttgctgtcagtgttttccaaaactcacacataatgtgaaagaaaagaacaaaattgggtagcaatcattgtatggtccagccatgaaataatgggttttataacttcctctaaactaaactagaataagaaaaaatcataaataagattacaatttggggcaacccactcgggtccccttccacactgtggaagctttgttctttcactcttcgcaataaatttgcagca

SEQ ID NO: 229234 - DNA, 204 bp, Homo sapiens
gggacagacacgctgatgcacatgggagtagtggatcctcatttacactctggaagggaattgtggagagggaggtatagatgaggggatggaagggaagggcaccggcaaatattgttgatagcgagggaagggcggtattgtgatcggctttgactgtcagcctaaggaatttgaatttcattctagagatccaggggaggt

SEQ ID NO: 229235 - DNA, 513 bp, Homo sapiens
attaattccccccccccctggtgccacacacacatttttgaacagccagatctcaggagaactcactcactgtcgtgaggacagcacccagggtatggtgccagaccattcatgagatatccaccccatgacccaaccacctcccaccaggccccacctccgacactggggattacgactcaacatgagatctggcggggacaaatgtccaaaccatcccagtctccctcacgttctcccagcggacattggcgagccgctgcccagcgtcaggtgctgggcactgagatggtgaggacccctgcccagccctcaggagctctctgactgtgtaaagagctgagtcatgatcaatcaaaggtactccgctggagggatgcgttagggcccagaaaagggagttgcttgctcgccttagggtggagttggtaaggggaggtttcccagagttaagttgaagccaggttctgagggatgagtaggagtttgacaggcagaagaagcaactcgagc

SEQ ID NO: 229236 - DNA, 481 bp, Homo sapiens
atggaatgtgcaaaggtatatgaaagtgccttgctaaaatcctagtgcgtggttggcactcattaactgtgctgtatttctcccatgttttagatgactgggccttcagagaacttgccgcaattttcaggaaatgtgtgagctaagggtatctctgttttcacttgcttctgattttgtcccttctctaattgctccactctaggtgtctttgtttcttatcttcattgtaggcctaagcactgaccaggcaaggcagagagtgaagccataaagagaagtcagcaaggcagttgggcccccgggaggaagggggtgggcaggtctcattctatttgtacaggtgcattgtaatgctgcctgtggtgtgaacattttccacttcattactcctggccctggcccaggccctgtctgctcccctggcccctgccttggtttaatttcagcagttcctggcctttggaaggcagcagtcaca

SEQ ID NO: 229237 - DNA, 307 bp, Homo sapiens
ggaattagcaagaacacttcccaggagtaggggaatctccaattgttcaactccccaaggcctaccttaaaggcacaaacattaaagtttgtcattgtttcctcctcttccaactcccccttgctcgttacccatcccacatttatcctgttcctcttgcaagtataaacacggggataaagatgctgtgttgcagttttcagcttttggttacctatatcagttctgtaacatagagtatcaaagttaatatgaatgatgattttgactggcttgactagggatagccattggtaaaacataacgt

SEQ ID NO: 229238 - DNA, 623 bp, Homo sapiens
tgaagttattcctaacattgacccaaacatgcatcccccatttgggcatagctttagcttacaccttgcttacagcctgggtgtatcttcagagaccagaattttattgatatataaaaaaaaaatctgccaaccgaaaacctttgtagctgcttcctgtttgagcagcatggttttctaaaatgcatcttggaggggctgtcaatagggcagcatttctgctgcagacgctgagcccctggtcctaggtgccagagttccccaggtccctgtctccacctggttttctttccagtctcagcagtgttcagactttcccagcagatatttttctttgttggtgacttttccataccatggaatgattagcaaatgcatttctgctgtctttgaaggatgctattccaaaacaggatcaggaagaacccttagtttcctttcagaataaacaagaagctagaaaggggtttctaagaggccactcctctgaatcgagatgaagcctaggttgggggtgctaagagtatgggttaccttcccccttttactcaacttttccttttaacgtggctatggccacccctggcttaatgctaaaactcataggacaaaatgtacttaaa

SEQ ID NO: 229239 - DNA, 524 bp, Homo sapiens
tacaggcgcccgccaccacgcccggctaattttttgtattttttagtagtgatggggtatcaccgtgttagccaggatggtctccatctcctgacctcgtgatccgtctgcctcagcctcccaaagtgctgggattacaggcgtgagccaccgcacccgaccaagttacccatcgtttttatctcctactgcctagcacagtgagtgcttatcacatgaaaggtactgatttttttaaaatgaatctaacattcatttttaaaaaagcctaccctttcatccaattattttttctcttcccagctgttttcttctcccccacctctgattttttaacttcttaatttctttttctttttcttttcttttttctttttttgagacgacagagtcttactctattgcccaggctggtctcaaactcctgacctcaggtgatccacctgcttccacctcctgaagtgctgggattacaggtgtgagccaccgtgcctggccagcttcttaatttcttgaaattgttg

SEQ ID NO: 229240 - DNA, 388 bp, Homo sapiens
aataagaaggtgatagacctggagtgagaatccacccaattcatgtcaatcggagacaaatttgcaatatcctgtgattcctgaactggctgtggtcactgatcacttctgtcctggaggaactagagacattcaagacaaataaggactcatctagtcccctgattaaaggacttttcatagaggctgcattaagggccaaattatgtacaatgtgctctctgagatggggatgtgtaaatagccgtcaaaatgtcatctgggcagaaatttgtttgggaggataaatttatgttcaggggtgaggggtgaatacaatagaaatttgtattttgcagagggaaatgtgggttccatggtgggtagaaataaaatagattagtagaat

SEQ ID NO: 229241 - DNA, 758 bp, Homo sapiens
acaaaaacaattaaactgaaaagtgtattgtgcgttattgtgttaagcactatacatacattatgctgtttaatcatggtacttcttgaagtagttatttttctctttgttttaccaaaaaactctgaggcttagagatgtttaaaataactttttcaaagttatacatttgtaagtaagaaggctaaccctgatcacctctcaagcatatttgtaatcctgtgtaaaatctagttggctgtgttcaaaatggtaagactagagtgtgtcttggaagcctcaagcagttcagtccatcttgcctcatacctctgtctgcctggatcccaggtccaaatgcaggctcccaaagtgttgagattacaggtgtgagccactatgccttgcccctatttttttcttttgtttcaattgacaaataattgtagatattgatggggtacgtatgatgttttgatacatatagtgtttagtgatcagatcagggtacttttgtatcctttaacaaatctttccctatccctcccttcctcaagcccttcccatcctctctcatcacgtttttataagtcctttgtagagctcttatttcatgctgaacaaacttctctgcagccacacttcttcataaattactcagtctcctcactttagttgaaaagtagtttaggtgtggtggcccataggttgagagaggattgcttgaggccaggagttcaacaccagtctgggcaacgtagtgagagctcatctctaca

SEQ ID NO: 229242 - DNA, 274 bp, Homo sapiens
agctggtcagcgggagtggctgtgtccctgctctagggtgctctggaagcccttcctgttcccttccctccgtggccgacctggagctctgacatggtggctgaggtgtgggctgcatcctgggccataagacgaggctcccaccttaagaatgggagaaccatgagtgggaagaagcgtgggtccccgaagacttcatgaagctaaattacctgctcgggacagtctgcttcagagacttctttaacttaaaaaataaaatctcgagtgtttg

SEQ ID NO: 229243 - DNA, 739 bp, Homo sapiens
ggatcacttgaggtcaggagtgaaaccccatctccactaagaatacaaaaattagctggcagtggtggcttgcacgtgtaatcccaactactcaggaggctgaggcgggagaatcccttgaccctgagaggcggaggctgcagtgaaccgagatcacaccactgcatttcagcctggcaacagagtgagaattcgcctcaatttaaaaaaaagaagaatgaacccagtagctatgaagatgatgagctggaaagattttatatcacatacccaaacttagtcttaggcctctattctctttatctgcaacacctttcttctgagaagttactgtttctcactcagaaaagcctcaccctttcctgtgagcctaagaaataattaaaagttagaatttaaaaggctcccttaaagtaaaaattttaagtacaaaaagatattacatcaagtaagtaaaaacttttaaaaagttggccaggcatggtggctcacgcatgtaatcccagcactttgggaggccaaggcaggagtttgagaccagcctgggtaacatagtgagaccccatctctacaaacatccagaatagccaggcacagtggttacatgcctgtagttccagctacttgggaggctgaggtgggaggatcacttgagcccagatgattgaggctgcagtgagccttggtcacaccactgcactcagcctgggcgattgagtgagaccctgtctcaaaaaat

SEQ ID NO: 229244 - DNA, 430 bp, Homo sapiens
ggtctgggatccaaaacccagattgcaggatccttgttatacaagaggagttacattgctttctctgaaacagaaaggaagaaagaaaatttagacacaaatcatcttaaaggcattagcagaagaatgaggttagtctctccaacccaagagatcttggtttccttagggaaaaatcagaaaatggttgagtcaaccaaggataaataggaacagacatttccaccattatcttggattctacctctgctctttccgcaatccaccaagccccgtaaacttgccagaagttacattgtgtctgcagttataatgtttaaaacatgctctcacttgaccccaggattctcattagctgggttaccctctccaacctcatcagcagacaagaagcttggcaaaaacaaattaaacttttaaaattacccaa

SEQ ID NO: 229245 - DNA, 971 bp, Homo sapiens
acagtggtgtttgttgtgaggattaaaagagtgaaggtgtggcgagcatttggaatagcacctagtgatagtataatagcatttggtaaatgttattggatattattatatggtacatccatcagcgtgtagagcgtgtatctttgtgtgcagagcctgtgtgagtgcgtgtgtgttctcactatgtgcacccctgtggatgtgtgtgacacacagtgcacatatctgtgtctagaggggttgcccatgtctctatgtgtgatcaacccaggcccacacgcttcctggggtgcccacaagcatggtttcctaatggcttcatctcctgcccctcaagttctgttctttccatctccccatgtcaccctcctgccttggctcccagcccagcctgcacatggcctgtccctcccaacccctccagcctgcccccacctcctgccattgctcgaaataccttcagggatgttcaggcttttgccctgccattctcccggtctggagcatcctcacttcctcttatctgggccaacttccactcctgcatggattctgactgaaatgttgcctcctctggaccgtcctcaatctctcaggtcccctgcattgccctcatcctgcagccctcttccgcatggtgccagcagctacctgctcccctgcgtaggtgcagatgcacctaagttgggagccctgtggctggggctcactcccatggcctccctaactcccgtcctggctgagcccattgtggtccacacaatcctgtcctctgtggctcctgagagtcttggaccctcaattcccttgctgaaggtggaaaggctgtctcaggggtggggccagccctcagacacctggtcatcacacacctggttatcaggcacccgtccatgccccagcatgatgtagtggagggtggggtagtaaagggatagtttgggtgaagtcagtgagtcagctggctctgc

SEQ ID NO: 229246 - DNA, 502 bp, Homo sapiens
ccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttggacagggtcagaactgcgtggaggatcccgctggttgcagcatggagccctcagagtgtatggagcccgtggccaagcagactagaatatttgacatgatttctgtgggtgctgtaaggccctgggtggcgtgagggggaaggtgtgtgtgtggggtggcagggaggagaaggaatctgctctgtgcttattcttgtccccgtttcttttgcagcctgcccacggcttcaacctgcctccagccccacctgctccaagcagacagatggggcgagtgtagggagtgtgtttaaaagaaaaaagaaacaaaaagtctctctcttttttttttttgaagtacccagaccttttcagg

SEQ ID NO: 229247 - DNA, 417 bp, Homo sapiens
gttactagagaagtttctctgaacgtgtagagcacatcatagctcactgcagccttgaactcctcagctcaagcgatcctccctcctcagcctctgaatttcctccttggcaggaaccaggagactagtggctgcactcagttaaaggaacagctgcaaatgggaagataagaaagagaataagaggaaataaggtcagtatgtcctggcacagcccacacctggctgtggctgagaattcacccttatgtagaaacagtggccaagataaggggctagtgccccaaagtatctaaatcatcacatagctgacaacttcccaaagacggaggaagccacacagagctccttagaactccagcaccttccacagttcctgcttcagaaaaggagcttaataaatgttatctgaattga

SEQ ID NO: 229248 - DNA, 483 bp, Homo sapiens
attcggcacgaggagcgcctggaatctgcgcccgagtcacacacaaacacacacgcacacataatcccaaaacaaccaccacgcgcagccagcccctgctcgctgaaatcattctgaaagccaatggaggtatctcacagcaacaagagggaaggaggcgaatgaagaggcgcccgggtcggagctgcaagctggaagaaaagaatgctcgctactgccccagcccacgaccctggcaagctggggatggggtggaacggagcggagtggctcttaggacacccaattttcttggagtgccggtgaaaaaaggcagaaacgggagcgagcagagaaacagccttctgcagcccgcactggcctctcccccatcctcctttccccaggcttcccgtcgccccggggtctcccactcgggctgcagggacttcttctcgcgtttattttagctcttccaaaatagaaataaaaaatacaaacaca

SEQ ID NO: 229249 - DNA, 358 bp, Homo sapiens
ccctttaacttgatttgagattagtaaatccaagaataaactccattaggcaaaaagtcttatagagagtaatgggtttgtttaatcccttctcatttactagggaatgaagctgagcagcaactaggtaatggcttgaactaaattaggtgagatggggagtgacagttttaatttaccgtagagtaccctgggattaagcttctagtcaaaccaagtcccatggagctttctcttcacctatgcatcgattcattcctttccatttcatttctagtatacaaagaccaatccagtgttactttctaccagcttgccttgctatatactaatacatgattaccctaggatttcctaa

SEQ ID NO: 229250 - DNA, 532 bp, Homo sapiens
ccttaccaagtccacacttacacaaacaggtgaattaaatatttcacaaaataatacttactttcaccatgcgagatactattattttctttttttcctttagaaatagggtcttgctgccacccctgcgtgcagtagtccaatcacagctcattgcagcctccaactcctgggctcaagtgatcctcccgcctctgcctccacctccccaggagctggaactacaagacccaatattggtccgtgatctgatgatgttcacggtcaagacggaagcaaaaaaagcacacaccgcgcgccctcggtcactaatcacgcggagtatacgcgaggagggcccgcagctaagcgacggcgggcggccgagcttcctccacggccggggaggtgggcaaggcctccgggccgcagccccgggtacgagcggaggctccgaggcccccggtagccagtcagaatttattttaagggaaatggaaagctgcggcaggctttgggaggaggggcaggattaaaagagaaagtgtgctca

SEQ ID NO: 229251 - DNA, 862 bp, Homo sapiens
ctaatttttgtatttttagtagagatggggtttcgctatgttggccaggctggtcttgaactcctggcctcatgtgatctccctgccttggtctcccaaagtgtcaggattacaggcgtgaaccactgtgcccagcctggaagtttgtaccgtggagctaattctattcacctttttattttttccccacgagcagattcaagttgccctggatatatgcttgctggagctaattctaactagacaagttgctacaaaagacaagcaaatatcaactgcatgagtgttagctcatccttgtctcaacaatgtctcactctgtcgcccaggctggagtgcagtggcgcaacctcggctcactgcaagctccgcctcccgggttcacgccattctcctgcctcagcctcccgagtagctgggactataggtgcccgccaccacacctggctaattttttgtatttttagtagagatggggtttcaccttgttagccagaatggtctcgatctcctgaccttgtgatccacctgcctcggcctcccaaagtgctgggattacgggcatgagccactgtgcctggccgaaacctactgtttctaaaaggtctgttagtaacctctagtctttggcaactaagaattttaagaaatattcaataattctttaacttgacagcttaagaaaccaggttgtgaaatagtggtttttaagagggttcttatgtggctgatactttaggtgccattaaataaaatattagtacacataaaataatctaaaatcccaaaagataagctttagtgttatgaaaacaaaatttagttaacatatattaagaaaatgcttagtattaagtaaacc

SEQ ID NO: 229252 - DNA, 394 bp, Homo sapiens
ataattcttgtgtgatggcagtcagagactgattataatcaggggagagagaagaacttcctggggacacagtgcttcactatagattccctgcctctaattctcaatacagaaatctttgcaagagtactttcatggatgtcaatgacaacaattaagcttgaagagcatgagaagacattttaatcagaagctaattaagaacaatgggggcatatgtatcactgattgtgtctcaagtactctgactgatctggaagattattccattaatatatggatgtaaacagacaccaacattttctcaggatgaggcaacttcactttgaaggttccacctccaaatctggcatttatttattagatgacaaataaaaatgagcaacatttacct

SEQ ID NO: 229253 - DNA, 3157 bp, Homo sapiens
  misc_feature (363)..(363): n is a, c, g, or t
  misc_feature (393)..(393): n is a, c, g, or t
  misc_feature (1521)..(1521): n is a, c, g, or t
  misc_feature (1832)..(1832): n is a, c, g, or t
  misc_feature (1850)..(1850): n is a, c, g, or t
  misc_feature (1875)..(1875): n is a, c, g, or t
  misc_feature (2491)..(2491): n is a, c, g, or t
  misc_feature (2719)..(2719): n is a, c, g, or t
gagtttttctattttattgatagttttgtccttcattatttccttcctaatcgttttttgaaggttgattggctgttatttttctagcttcttgagctggaagcactaattttttgccttttaaatttctattattcattacatgtctttgtaagtacccacaagtcttgacatgtgttggaaaaggcggtctcatgcacacagcctttccaccccttctcaccaaataaaaatgggccttgggcctgaaacactttcttaccaagcgatagagtcctcacagcctgtgctggacctgtcactctgtgtgaaatatttttccctgttttacactcagtgtgtcctcctttgctctgcttcagnatgtgtgtcatatgtcacctggctcacctncagtatctccccattgggaaggggatggagggacagggttggtctgctgtagcccaagaagggtgtgtgtagaccagttgttggcatcagctgctgggaggaacttgctcaccatgggataccaacacctattactgaagctgatcttgctttgtctcctctctgtgtaagtaaagcgttgttccatgcagtgcttgactgtgcatcgtgttttctttggtgactatgataccaagatacaatgaacagaagttctaagacttctactcctgatattaggtgacagataccacttgcttgacaatatgtgtttattatcattcagttcaaaatgttttctaattgccattgtggtggttttttctttatctcactcattttacatatgtatttgattcatttccaatgagttgatgcatatttaattttttaaaaaaattgttataaaaacataaaaatttattatcttaaccggttttatttggtgtgtgtgttattgctatctagctcatatccactgtagtttgagatgatactctaagtgattttcatcctttgatatttgttgaggcttgctttataatgaagcccatagtcaattttggtaatgttttgtgtagtcttgaaaagaatgtatgttcttggccaggcacagcccagcactttgggagcctgaggtgggcagactgtttgattccaggaattcaagattagtctggccaaccctgtctctacaaaaaaaatgcaaaaagttagtggtgatgcatgccttagtcccagctactcgggtggctgaggtgggaggattgcttcagcctgggaggttgaggctgcagtgagctgtgattgtgtcactgcactgcagcctgggtgaacagagtgggaccctctctcaaaaaaaggtaagaaaagaatattctgttgttgagtgtagtgttctgtgtatgtcagttaagttgaatttttaattttgttgtttagagctcttactacataatgatttttctctgctaaaaaaaaatgaggtcttggaaaaaaatagtgtcatctataagcattaaaaaaattaaaaatgaggtcctgaatggtgtgctcaaatttccaacatttattatgggatttgtttanttctgtaagtttttgctctatatcttttgaagctgtattgttggatacatgcacatttagaatttttatatcttcttggtggatcaatcccttagtcattataaaatgtccctccttatctttagtaatatttcattaaggtctattttatttgatatgagatagctacctcagcttccttctctatgtcttttgtaagcagcatatagagttgtcctttcatatccatgacttctgcatccatggattcaagcaactgcagattgaaaatattaagagaaaaaaaagatggttgtttctgtactgaacangtgcagatattttttctngtcattattccttaatacagtatancaactatttacataacatctacattgattaggtattagaagtaatctagtgatgatttaaagtatatggcagaatataaataggttatggcaaatactacatcattctatacaacaggctttcagaacgtgtaaaataatatgaacaaaaaaatttaaatcaaaatataacaggcttgagcatttgtagattttggcattgttgcgggggtgggatcctgcaccgaatccccctcggataccaaggggatacagtgggaccatttgcagatcctctagagtgctctctcctgtctgtctccctgtctttccgctttaatactctgtcctgcatactctagctgttttgatatcctccgatgctcagtttatctcaattaatgaagtccacacaagctccatctggattctctttccctttgctgggacctgagaattctctcaagacattaagccggggcagtcatagagttcacgttgtttgtttcccatctctcagggatcactgttctctctaaagtccattgtcttaaaaattgtcatttcatatgttttgtctggtttttatttgtgggagaggggttgtttcaagtaaaagggtaaaatcctgtccccantactttgccttggccaagagtgaaagtggcccattagatgatttttatcagtgattttcaaccttttctacagggttagaattctttgttcaagtaaaatcttatccccaagtgtcatgtgtatgtgaaataaatgagggcaagatggtggtagtgtagtatatgtgcacatgtgcctttgtatgtgttggggatatagcagagcttttttgctgacttggattcctnttcccattccttgagggctttatagcccaatttgaaagtcactaatatagagagtacaaataggtatataaaaaagtaagcaaatgagaaaataagccagttattagttacagaggaaacaaactatccaggaaaggaaatttacagtatatctcattttggggtttggaaggatgtgtacaaaatagtgtaattgaaaattgataaaataaaaaatcttatatacttatattgggtaaaggaagataggagaagtgacagagcgagagagagagagtgtttatgtgtgaaggaaataagaaagctcagtcttataagaagtctcagataatgtgtagactttacagaaaagcagtttaagaatggtatttaaaaataaggaattaaataacatgagagttgaaaggtagtttagggggaggtctattgttgattgat

SEQ ID NO: 229254 - DNA, 502 bp, Homo sapiens
tatgcatacatctaaggttcaggacgccctggtccagagatctgtcattcatccatctcagaccttcctggtcgcaaccagcttcttcccttctcaggggccgccacagtcacactagtcctctaatcatgggtggacccagcgcaaaaagcctcacacagaatgtcacaagatccctgtgcacgtggctgcgctcctgcaaacgtggcaatcacacgggtccaggtggcctctcacatttaagccacatcacgtatcacccccacaggggccactgcgggagtggcggcgctcgccgcatgagccccacgcgggcatatagaacagccattctcaaaaagcctcaaaaccgtttcaccacccagcgcggtggctcacacctgtcatccaatactttggccactgagacgggaggatcgcttgagcccaggagttcgagaccaccagcctgggcaacatagcgagaccctgtctttaccaaaaaaataaaaataaaataaat

SEQ ID NO: 229255 - DNA, 736 bp, Homo sapiens
cagcatggcccgcctgcacccgccccggtcccaggctgcaacttctcccccagcagctgtcctcccggcagcaaccaccagagggcgtctgtgagcgcctgggtcagggcctgtccctcttctgcccacagctctctgtgagtcccactgtcctcagggtcaaatcccctaagtcctccccatggcccaccaggccctgcacgacctgccctcccctcctccctctactccagccacacaggcctcctccctgttcttccaacacaacatgccaggtgtggtcctgccccagggctttggcactacttgtccctccccattggcctggaatgctctgacatcctgcaggtgtcagggccacgtcacctcctccaagaagccctccctggcttcctgccctggctgtccaggtttctctgagcgttcacctttacacaccacccacgccggtaccaaccacatgttcacctctgtgactattaacacggctggctctgccccaggcccagaccggctgtggtttccaggccctgggcctctacaggcgtgaatgctgtgatgctgtggtctagaaccatccatgtctgaaccctgagttctgtgggtctgggttacacggactcggggctcccttccagctgggaccacccccgatatatttctgtacggtgtcttcagcactgcacacatggacccaacgtttgttgagtgaataaacgaagtgctcagtggaaga

SEQ ID NO: 229256 - DNA, 678 bp, Homo sapiens
cagcatggcccgcctgcacccgccccggtcccaggctgcaacttctcccccagcagctgtcctcccggcagcaaccaccagagggcgtctgtgagcgcctgggtcagggcctgtccctcttctgcccacagctctctgtgagtcccactgtcctcagggtcaaatcccctaagtcctccccatggcccaccaggccctgcacgacctgccctcccctcctccctctactccagccacacaggcctcctccctgttcttccaacacaacatgccaggtgtggtcctgccccagggctttggcactacttgtccctccccattggcctggaatgctctgacatcctgcaggtgtcagggccacgtcacctcctccaagaagccctccctggcttcctgccctggctgtccaggtttctctgagcgttcacctttacacaccacccacgccggtaccaaccacatgttcacctctgtgactattaacacggctggctctgccccaggcccagaccggctgtggtttccaggccctgggcctctacaggcgtgaatgctgtgatgctgtggtctagaaccatccatgtctgaaccctgagttctgtgggtctgggttacacggactcggggctcccttccagctgggaccacccctcgtgcgggatcctctaatcgaccgca

SEQ ID NO: 229257 - DNA, 445 bp, Homo sapiens
ctatcagttagggtccttgaccataaggacagaaagcaggactcactggaaggcacctgggctgaggaaagagtgctcacagagcctactggagactggggcaccaggctcaggccaacaggagccaagggggcatctgagggcaaggaagcatggtgcaagaggatagcaaacatcacacaaccggaacagcccgtgcagggccgctgctgcaggggatggctttgcactggctcaggttcaaggcctgcaagacacagcccactgagctgagctccgtctggcctgggcaggcaaggaaggaccttgcttctaggcagccatgtggaaggcaggaatcctccaaccaccagctacaccccgctggagggagaaaatactctggtgagaaatcagggtactattggggaagagaaataaataaataataaacacgacaatacta

SEQ ID NO: 229258 - DNA, 485 bp, Homo sapiens
ggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgcagtttgctacccagaatttaaacattccttttttgctgctgttttaatttgaaataagaatggtagcccccaggtcccctaacagtgggtgctgatttcacagtgggcttactgctcttcaagagtatctcagtgttgagtccagccacccaagggagactggttcttcactgtgcatcatggccttttaatgccattttgcttttttatcatccaatcagcagatgttctttcttcattcacgttgaaagcacttcgctatggaaacgagtaaagttcattgtcttattttttgtttgttttgtt

SEQ ID NO: 229259 - DNA, 546 bp, Homo sapiens
agagggtctgggctggggtggtgcgaggagtgagcagtgggcttgggagaaggaggcggcgctcggtgagcccaggtgggctcatttctaaccctggaaatccggaattggccccgcgggcctggagccagacccctcagggaggcggtcgggaaagctcgcgggcgctccaaggcggtgggcgtgggggtggtgtccggtggccccgggcggctccggccacagctaatgtcccggtgctgtgtgcatggggtggaagcgtcacgtggagtaattcggtcgccgcttggaggcggtggcgctggcgtgggtcccaggcttgggcatcgccttgcgccgcgcgccagggtcgtgggtcgggggctccctgaggccagaggctacaggggcgcggggaagacagctggggtcgccgcgccaggatgtggggctgctggcaggtgacacccgcccgtggagccgaaatcaacaggcggtcgcccttcactctcacccgcaggcgctggccagacgcgggtagctgagtcccgcgcggaagggcggccg

SEQ ID NO: 229260 - DNA, 517 bp, Homo sapiens
caataacaaattaagttggtgcgagctttaccctctgagtcctcggaatcatttttaaaacataaaggtttccagaactcacagctgtgaacttaactgttctcaagggggtatctttgattgattttcctaactcttctacgataatcggccttttcccctcttctgcttcctctcgttctggcagccgatgctcacatccataacagtgtctgtttccctggattttcccatcccagggccacgcagagtgcagctcccctacacggccacggcattctgtccctctgtcgcgtggccatgcgtggctcagtgccgtgggagcctctccgtgtctgaggccgagggcaggctggtgccccattcgctctgtgcctcacaggcggccctgatgctctgtgctccaaatctctgcaggactggatttcggccgggacagaggaggctgtgcccccacccacgttgttcccagtgcccacgcaccttgtcaactggaataaatttggtttccctgcaa

SEQ ID NO: 229261 - DNA, 386 bp, Homo sapiens
tcaggccccagctcatctcccggctgcccagggagggcagagccgccttcaccggggccagcgcctcctggggaggggccaggcaggaaccccatgcatgcagtgttgggtgggtacttcgtgtaccggccgggatgctggggtgtggggccccggccacgtgagctgccctgtgcgcgagcccgggttggtccgcgaggccctgtgggctcccaggtgcttccccgctctggggtcaagaggtggcaccggggtcgggaagtcggggagccctagctcccatcgcctgcacctgtacctgcaccgtggctgcccgggccagattcttggcctcctggttctccagctgagctttgtcatttccatgcgtggcgttcccacgcatt

SEQ ID NO: 229262 - DNA, 463 bp, Homo sapiens
tgttacgtatctatccgtttgcccattactcaatccgtccatcaatccatcttttctgtatatatatttcaaagtaaatagcagacatctggatgtctccctatatacttttaaattcttatctttagagtttaatatttgtctaaaatatcattgttttgataacgacttttcccagcttctatctcccatgttcttttgctccaatccattgtcttccctacctctgttgtagtctgagattatcatcagtcccactcaagtctgatcctgaatccttcataaaaggcaactgtaatgcccagctaatttttgtatttttaatagagacagggtttcaccatgttggccaggatggtctcgatctcctgaccttgtaatccacccaacttgggtgtgaatagaacttggatatgcagcctgggcaatatagtgacacgcccccatttcttaaaaaaaatgt

SEQ ID NO: 229263 - DNA, 496 bp, Homo sapiens
aattgttggatcatatggtaattctatttttaattttttaggaaaacttgatatcgttttccatagtgactacaccattttacatgcctactaacagtccacaagggctcgaatttctccaagtcctcaccaacatctgttgctttctgttttcctgatagtggctattctaataggcataaggtaataacttaatgtaattttgatttgcatttccctaacaattaggatgttaagtatattttcatgtgcttgtgggccatttgtagttcttctttggagaaatgtctattcaagtctcttgctcattttacatcaggttatttgctttttgttgttattattgaacttagggcttctttatatattctggatattaatccttcatcagatacatggtttgaaaatttttttttccattctgtaagttgccttttcatgctgtcaattattcccttgctgtgcagaagtattaaagtttgatgtagtcccattt

SEQ ID NO: 229264 - DNA, 1304 bp, Homo sapiens
ttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggggacaaccggtattcatttaacttagaaaaaagaattccgagattggagaaggcatgagaaattctccgagggggg

SEQ ID NO: 229265 - DNA, 1273 bp, Homo sapiens
ttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggcaagtgctcacgtgtgattgaatctaaaccttctgagtccatgaacacgcgacgtgttttgggagatagcggagaaattaacatcttaaccggtcaagctccactggctctggcaatattttaacagatgccaggaacatgggcacagaaatcaatgagatcagatggctggggctgaagaatgaaagctttattttttgtttttgcaattccgagattgtgtctctatatttgtgtcattttcattcagattgactgttgccttgagttttaatgtattgttgctttagaaaatgacatgacattctgtccggaaatgtttcctggcagctaaaaggaaaaagctgtatctacttaggtatgaaatgaagagaagcaaagagaacgaggtggtttatgtgataacagcaagctgctcatccaaataacccaggccaaaaatacactgtctacaaggttgtgccaactcagctttcatgtgaaccacaaaagggagtatcggtagacctcaggccaagaaaatacctttttccaggtttctgtgttaaatcaagaactgtactatgcatt

SEQ ID NO: 229266 - DNA, 428 bp, Homo sapiens
cagaagaaaggaaattgcttcccaacattttattagactagcatattccagagacccaaatttgacatggcattaaaagaaatgaaaattactgactgatactcctcctaaaagtagatgcaaaaactcctaaggaaataacatgaggccgggcacggtggctcatgcctgtaaacccagcactttgggaggctgaggtgggtagatcatgaggtcaggagatcaagactgtcctggctaacaagattaaatctcgtctccactaaaaataccaaaaattagcagggcgtggtggtgggcacctgtagtcccagcttctcaggaggctgaggcaggagaatcgcttgaaccctcagaggcagaggttgcagtgagcagagatccagccactgcactccagcctggcaacagagccagactccatctca

SEQ ID NO: 229267 - DNA, 588 bp, Homo sapiens
attccaaaggctttcattcaaacagttgctgcattgtaatgttaagtatgagatactaattcataaaaatttaccaccatagtaaatctccctgataccatcactcttaaacctttagaaatgctacagcatctagcttctctagatcaataatcacagaggcttaagtgctgacctcataaagataaagagttcccatgatttacacattacgtgctttcataaatatctatatataaaagcctattttcctcttggactatattacaaaagtaagtatgcattttcataagattcaaacccagctctaaatgtaagaagccaaattaagaatgtagcaatgtatgaatgaggaaggaagccattactaacccctctgtgcaaaactccctgtcatctaaggtaggaataagatatttatcttgaacacataagggaatatgtcatagaaagggagacagggaggttgaggcaggtgactggcttgagctcagaagttcaagagcagcctgggcaacgtggcaaaaccctgtctctacaaaagctgaggtgggaggatcgcttgaatctgggaggttgaggcagcag

SEQ ID NO: 229268 - DNA, 479 bp, Homo sapiens
ttcccatcattcgctcctgttacactctagcactgtgttctagcttcagtgagaaacctgactctactccctgccctgcctggccactatcactgccccttccagaccaccctccttgcaggagtgaacttcaaaaaatgtatattaacattgattttaaaattttgcaataaaaccttatcaaagaaattaaaattagccaggcacagtgggtcatgcctgtaatcccagcactttgggaggcaaggtggactaatcacctgaggtcaggagttcaagagcagcctggccaacatggtgaaaccccatctctactaaaaatacaaaaattaggtgtggtggcacacacctgtagtcccagctactcaggaggctgaggcaggagaactgcttgaacccaggaggcggaggttacagcgaatggagattgtaccactgcactccagcctaggtgatagagtgagactctgtctcaaaaa

SEQ ID NO: 229269 - DNA, 753 bp, Homo sapiens
gaaggcctgtattattaatgcccttgccgggaacagctgcaccctgccaggttgtcatgtgagacctctgaaaagctcagagctacaaggcccacagctctcctgggcccactgggtcaggtgggaaatatgatcctacagaaactgcaggcagccaaggagggcggaaggcaacttggaaggaactgatcagtctcacgcaggagacacagccgtcctctgagcgcctcaggagggctaattccatcccgtgcctccaggggcctgctgtatttgaagatcttttagcctgagggattttatcacatcatataaaagacacataaaataaaaatgaagatattaataatcagtttaataatatttagagagccattattccttgtagtggtcactatcctcatcacttgaaatagttttaattttcagtacaagcctttgaagtgaatgggacttgttattgccatttaatagataagaaaacagtctcggccgggcgtggtggctcatgcctgtaatcccagcactttgggaggccaaggtgggaggatcacctgaggtcaggagttcgagaccagcctggccatggtgaaaccccatctttactaaaaatacaaaaattagccaggcgtggtggcgcacacctgtaatcccagctacttgggaggctgaggctagagaatcgcttgaacccaggaggcagaggttgcagtgagctgagatcatgccactgcactccagcctgggtgacag

SEQ ID NO: 229270 - DNA, 427 bp, Homo sapiens
gagaagacgacagaagggtaacataggagaagagtgggaactatcatcaccttttagattaaaacagtggtcccatttcttgctggaacgaacactgcgactaatgttcactcccttcatctggatatgttagtgaggtgtgcacagacgattaagattttcccattttcggctgcgcgcggtggctcatgcctgtaatcccagcactttgggaggctgaggtgggggatcatctgaggtcaggagttcaagaccagcctggccaacatggggaaaacccatctctgctgaaaatacaaaaattagccacatgtggtggtgggcacctgtaatcctagctactcagcaggctgaggcaggagaatcacttgaacctggaggcggaggttgcaatgagccaagatcgcgccactgcactccagactgg

SEQ ID NO: 229271 - DNA, 545 bp, Homo sapiens
tcgggctccagccagaccttgtctggagctggctttttgctttatcacagcaaatggtggactcagtaagagagtggccgtactgagcctcattagtaatcacagcagtgagacactacttcacacccaccaggttgtcagaaccttaataatgtgacaatgtcaagtactattgaaatggggcaaccagtactacttgcatacactgttgctaggagtgccagtcagcacaaccactttggaaagcaatttaccaggcatcacctaataaagttgaatatgcacacatcttaacattcagcaagtccacgcctaggctgatactggagaatttctttcatgtcttccccagaggcatgtgccagagtgtttttaattgcaaaaccaagtatccattgacaataaaatggataaaacaaattgtgatagagccatacaatagaacactactcatcagtgaaaatgaatgacctacaaatgtatttttcatgagtaaatctcaaaactataacatttgagtaaaaaaaaaaaaaaaagcaagtcag

SEQ ID NO: 229272 - DNA, 321 bp, Homo sapiens
tttttaagaaattgagactttccataaaaatctaggtttccagtctgtctccagaaatgagaagcctgggcctgccgtctctcctgacatcagttagctggaactagttgtgcactagctgggtcccccgcagtccacctgcttcctgtcacctctccgacatgaggcagggaggcagggccatttgtcactccatgagcactgctgtttgtagtaggggagaagtgttttgcttctctgtgtctcagtttatcagagtagaaaatcaaagatagatggagaaggcctctcaggaaaccctggcagaaacgaaggaatttc

SEQ ID NO: 229273 - DNA, 630 bp, Homo sapiens
gcatgatcttcacttatacgtggaattttaaaaagttgaactcatagaagcagagagtagaatgttgattagcagaggtcggagggggagatatagggaaagggagatattggtcaaagatgttggtttcagacattttagagatctgttgcacagtatggtgaccatacatttcaaaatagccagaagactagattttaaacattttcaccacaaaaaagggtaagtaggtgaggtgttggatatgtaagtttgattaatctttctgcaatgcgtacatatatcgaaacatcacattgtaccccataaacatgtataatgattgtctgtttaaaaaagtttatatttcatcctgagttcaaaacccgtaactgaattaagtgactgctggtgggaaccaggtaaaccttccattcagcttaacttttgagatgagcttggcatttcttgatgttgctaggggaaaaacctcaggagttgtgttgtaacaggaagttaagagtaagattgctgatttcattcattagttcagtgagtttctgtaatgaagaatatatgtgtacccataagagtcaatatgcatgtttactttgtaaagaaaaaagcatttcataacgaatgacttgaatt

SEQ ID NO: 229274 - DNA, 575 bp, Homo sapiens
gctgacttaagtgatgatgctgagttgacttcattccagccacaagtaggcaagcttccatggcctctgaaatttcctcaaaaaaatagagaaaattccccttgggtttaaatagagtgatccttcacctagcatgggatggaattcctgcctgtccctaatgggcaaaactatggtggatgaggatggctgtattgcagcagcccattactacatttaaggaagactggggagtggggtccctgaaagttggaggcagacttgagggatcaaccacagaccagtccttaaggagactcctgtgggatggagaaggtggccctgatgtgttgacagtcaatgacagaccattcaacacccagttgtcattagaagtaaataatgtggcaaaaatgtcaccccctccccaatgtccacctcagtcccatctcagagtggggatctgcaatacagtagaaagattcagtgccaccccaaagacacccatatacaataggaggcaagtctgttggtgtcaaattcacttatatcatgaacatcctgcatgtcaaaatctctagtttctcccataagtg

SEQ ID NO: 229275 - DNA, 687 bp, Homo sapiens
taccctgcataatcaacaagaatgtcagctattccaataataaaatgcttttcacaatcaatttaaaaattgcccattttggcctttctggcagcccacagaatccaccctccgttgtcctcttgtttagagagctggctagctcattcctcaggaatgacccatgtcccaggagctcaggaatcacacatcccctagaggttattctgaagtccatgtggtgctctagtggcagcaacttctccatttgccctctgtgttcctgccattaggccataacccggtctggtcaaagacttgccattttgtttggacaaagttgcaatttaaatgtttggatccagagcttgcagtaggaatgttccagaaatacttagtttagctttttgaatgcaaaggttgaatgcacttggaaaggcctagaatagaaattaagcaagagcacttctttcttaacaagtgatctgttcataactatggatggcagtagagcaagaggacgcaaactggtgaacaaagtcacaaatgccttagaaactaggtgacatttgagccagatgtgaaagagtgtgacttgagaggaattcgcatagaggagaaagaatctagcattaaaatcagacaggcctgagatcaaattccagttttgatgcatattagctctctgaccataaacaagttctttaa

SEQ ID NO: 229276 - DNA, 259 bp, Homo sapiens
ctggcacgaggagaccctcagtgacatgtcctctgaagagtcccctggggacctccggcttcatggatctgtcgtccaccatgtggcgtttcagtctcacagacacccctgttcttgctgggaatctttctgccagctacaaaagactgtgtccatgacccctttctcactgttttcacaaaatccttctccagaaccacagagggttttatttttaaccaaatattaaatgagagccatggccttggagtgaaacaca

SEQ ID NO: 229277 - DNA, 532 bp, Homo sapiens
ttccgtaacgctgcctgcgggacgctcatcattccagatcgtcctctcacgtgagtcttcagttcactttcttttctgcttaaggtcctttaagttcgatttttctccaggaatcgcagcatgtcctggtgtgccatgtccacagtccactcctgggtacaggtgatcctaccccgtggtttccaaaggcagcctctccactcacctctgtgccctctttctttcaaacgggggtcgtcttttggtccctgggtaatttaacatttgctggagtttttcttaaaaaatgagattgatttccttttctagaatcatgtttatttgaattacgtttattcaaatcatgtatatttggcaccaacatacctttaagcagagtagttcaaactcttgttttatatggaaattgtttgatgaagtgatttgctccccagaacataaacgccccatgagagcaggaaccatgtctgttttttctacttctgtacccttcatatgcccaataaatgcttgttgacggggtgaatgcact

SEQ ID NO: 229278 - DNA, 521 bp, Homo sapiens
gcttcctttgctgcagcatgagagaatctgcagcaccacagtcagaagccagcacagctcagtgctatcaggagatgaggctcagttcttggtttgaaagagaagggtgcaacatgcatctaattttccagcttgcagagggtgtgggggctgcctgagggactggtttctgtctcacctggctcagagtggtgaaagaaatagcatactttggatgcctgggagctacagagagcaaaggagagcttagcaacttgttgcagcaccaataaccttcagtacaacagacaggcaccagagatagcaagagactacaagctcctgaaaaagaaattcataaacctctctaactgggaaattatatgcacaaggctagagaagacacatctccagaaaaagattgagaggccctcagaattctgatgcaggctgattggtgatgatctccccttctcttgaaggtactcaaaaaaggtaaagagaagtagctggctttttaaattcccaagtctcaaaaaaaa

SEQ ID NO: 229279 - DNA, 437 bp, Homo sapiens
aagatttaggtggggacacagagccaaatcatatcattctgaccctgacccctctcaaatgtcatctttatcaaatttcaaaacacaattatgcttttccaacagttccccaaagtcttaactcatttcagcattaactcaaaagtccaagtccggctgggtgcgatggctcatgcctgtaatcccagcactttgggaggctgaggcaggtggatcacgaggtcaggagatcaagaccatcttggctaacacggtgaaaccccatctctactaaaaatacaaaaaattagccaggcacagtggcgggcgcctgtaatcccagctactcaggaggctgaggcaggagaatggtgtgagcccaggaggcggagcttgcagtgagccgagatagcaccactgcagtccggcctgggcaaaagagcgagattccgtctcaa

SEQ ID NO: 229280 - DNA, 324 bp, Homo sapiens
taacacctgccactctgggaagagaatgactgtgggtcttgggcagagcctatagccttcatcagcctgttcactgaccaactgcacagcagtgacaggggcatggcagtggcacagaggaatagtggaagcacatccctgagacagcctctctgcagccccagctccagcagcctgcatcccagatttatggatggtacctggtaaagcaatgatgcaaactcaatgtgaaatccaagtacatcatcatctatctctgtatttggtttggggttttattaatgacagagaatgtgattaaacaaagtttatactgtaactaac

SEQ ID NO: 229281 - DNA, 517 bp, Homo sapiens
ttaaagcataacaatgattaaatttgatggccagttagcttttatattctctgctagacaaagcaacaaaatagaaaggccttatcttcatttttaactctagtagaagggttggcataaaatcaagacttactttgtccacagtgacctcaagacacaggcgaagggatttttcagatcaccgcaacagcccagtgttgccccactcttgtggtacctgcatcctcctatgtgcttctccaattacaagacagggtgagagagatgtggagggttttgaatcagcaattaaaatagccctgctaattttaagaagcaggacagtacctagaaagagtataactagaaatctctaccataaggcactatcagagactgctactggagtgtatatttggttataatatttgttgaaaacatatatcaggatctttaaaactgtttataggctgtgatccactaatatcccttccataaatgttttgggataatgataaaaaaaaaatcaatgcttaaa

SEQ ID NO: 229282 - DNA, 857 bp, Homo sapiens
cttttgcaggaattagtactgaaattaatattaatcaatggcaaggaagaccagagcagaggatagtcctgtgacaaatggtcacaagcttctcccagctgtgaaatgtctttccttcataagtgactatttccattccctttcatgtatttgccttgtctggaagactttgattatgtgcttcttaggacacatataaagtccttactttgtatttggggcccagagaagtttagcaatttgcttaagctcacatagctagttagcagcagagctgggcctaaaatcttggaccatttccaaatccagtgtttgctttactgtatcacactgtgcaacgcttgtgttgatcactgtgagtacttaatatactagatttctaacagcagcctatttgcttctgattgccgactagttcacttcaattcatatttatcttaactgaaaaccactccttctgacggctcgtctgttgtctatagaaaatgagttggtgggctcattctagccctgttggacagccgaacccatcacaacaaatcaatgccaaaaatggcatttcaagaggaaaacatagcatttatttagtacccccaacagagtagctcaaagtgatttgaaaatgtctcattaatcctcataacacccctgtgggataataataatattattataacgtttaggcgtagaactgtggcaaagccaacagcttctctgagcatgtgcaggatttcctcatatttcagtctgcaatactagagcctgactaaaaccgtcaggtttgcaaacagcaagggtaaataaatcttggtgtttggcctttctgtgttgctctaggcatagtttgtgtttcctac

SEQ ID NO: 229283 - DNA, 322 bp, Homo sapiens
ggtggtgaatgtgaccaccaaaccctcctccagttttaaacaacagagctgctggtcaccaggttaggaagtgctgtgtaaaagactgtgtggatgtatgtggataatgatcagttttattattttatttatttttattgagatctagtcttgctctgttgcccagggctgtgtttctgggaggcatccctggtgattcgtcgtgggccgctctgctccttttgggcatcccattaacacttattctggatcgacttatccacttccctgctgatggacgctacgtcaccgttccctccatttactagtataaggtcgacgc

SEQ ID NO: 229284 - DNA, 465 bp, Homo sapiens
ttttaaaagcaagccgaacgtcacacatggagagatgactgagatgaaaggacagcaggataagttagaggaaagttggatgatatcaaaaaggattgcaggaaaactaaaattcaagaatagcattaaaatccattttggaggatgacctttaaaaaagcttgcctggaatgtgacaaaaaagaacagagtaacagacgaagaggatcatagcaggcagagaacacaaagctgggtcagagacacagtggaaatatcctttctcccttttcttttcttgacattattttggttttgttagaggtgaggctggtgttagagaggccaaattttgacgatgatgaaaaagccgagggcactggggggtttgggctccaacatccttattccactgaaccacgaccctcaactgcctatccctagacatttcattatgtgagcaaaataaacacctattttaagtca

SEQ ID NO: 229285 - DNA, 488 bp, Homo sapiens
agctaatttttttgtatttttagtagagatggggtttcaccatgttagccaggatggtctcgatctgctgacctcgtgatccacctgcctcagcctcccaaaggcctgggattacagacatgagccaccacacccagcccaaaatctgaaactttttgagagctgacatgacactcaagaggtcatgctcaaaggaaagactcattggagcacttcagatttcagagcttcagattagggatgttcaactgctaagtataatgcaaatattccaaaatctggaagagtctggaattcaaaacacttctggtcccaagcataaaggatatccaacctgtatcatttatttgaaaagtccatattttccccagatttaagaaaccatcttcatcatatacacaatttttatatgtctttgagtctatttctggattttcttttttttctttttttttttgagcctgggtgacagggtgagactccatctc

SEQ ID NO: 229286 - DNA, 307 bp, Homo sapiens
ctgtttgatccaactttttgatagaaactcttttccaggttaaagaggttttcttttatgcctagcttaccaagaattttaatcataagtgagtaaatgttgcaatttatcaaaaaaattgtgcatcagttagacaaacatttttcttttaatctgttaatgttgtgtaaaagatcagtagattttctgatattcaaccattcttctatccttgtactaaacccaacttgatcaatatgaaaatgactaaattcagctgactaatatttttgtatctctattcgtaagtaaatttggactataatta

SEQ ID NO: 229287 - DNA, 471 bp, Homo sapiens
cccagaagtcagtattttgcaagggtgaaaggagtaggactttctactgccccttgaatttctctgccagcaaactaatggccactgcagtttttagctctgagcaccctcttctcaagtttctccttgcacttcatttcttttctcccctttttcttttccttggcaaacagttctactctagagccatcttttccgattcctctcctagcgccactcccaaatatcctctggttactaaaccctcaggctcatctcacatatctgaaccagtctcaaaactttagctggctgggactcctcccctcccacctcccactctgtctggggtcaccagggctacctgttatcattaaataagccccctttccattctcaatttgtcaccctggcccaggtcctcaccatatcaccaccactttcccatctgcctcctcttgctggagagctgcctctctcctcctggcacgc

SEQ ID NO: 229288 - DNA, 408 bp, Homo sapiens
ccagcattcctggatttattgtgcaccatttatggctccacagtccactagatgaaattgtaaagactcaatatggtggctctccagggactttcccttttcttctcccttagcatcagagatgacccgtcagcgttgcaagcagttctgtggtagcacatcaagtattctgtcacagcaggaaaggctggataaacatcaagggactgccaagaccagacttctcattcagtctgagtaggaggaaagaggacaggttgttggagagttggtttaaagatgaattatgggctgggtgcggtggctcacgcctgtaatctcagcactttgggaggccgaggcaggcagatcacgaggtcaggagagttcgagaccagcctgaccaacatggcgaaaccccatctctac

SEQ ID NO: 229289 - DNA, 333 bp, Homo sapiens
caactaaaaatacaaaaattagccaagtgtggtggcatgcacctgtagtcccagctactggggaggctgaggcaggacaatcacttgaacccgggaggtggaggttgcagtgagccgagattgcgccactgcactccagcctgggtgacagagcaagatttcgtttcaaaaaagtaaataaataaatcaaaacagcaccagcagcttttttcctcctatctcctctccttccttcatttaaactcaccaggagctaatggaggtgccggtgaagatacagggctcattttgaaaatggaaatagaagaaagaataagaaaattcttttttgag

SEQ ID NO: 229290 - DNA, 421 bp, Homo sapiens
ctcactaatgaagtgaaacttatattgaggcctataggagagatgagggaacaaactgtacatacctggtgggagaacattgttaaaatcacaattaacctcctcacatcaggactggtgccttccacctatagtgaatagcagagaggaatgtgatgagtagctgttgaccatgaatagacataatatcaaagacatttcgcagtcttgggttctttattaaactgagatgttaaggtcattctggctattttgcttttttgccattcatcaataatttttggttttagcagcaataatatggaatctggttcttgatttattatacatatatacatgttgcaaatcaaaatcaagtcctttataagtactggtgcttaaaataaaggcagatatgtcgcaactagcctacaattgcttt

SEQ ID NO: 229291 - DNA, 2125 bp, Homo sapiens
  misc_feature (1046)..(1046): n is a, c, g, or t
  misc_feature (1606)..(1606): n is a, c, g, or t
  misc_feature (2021)..(2021): n is a, c, g, or t
gaaaaatatgaataagggctaccaattgttttagttttaatcaaaactaaaaatatacatctatgtctttactgatttaaactcacataaaactgccttccaaaataaatgcagaattgggcacttatttgttctcatgtctgtcctctcagagccaataagctgtaaaaaactctcaaaataaaactctgttttattttctgttttgccccggtttctatcacataagtgctcaataatatatgctttacataaatgctgaatgaggaacatatatatctatataaactggggagcaatgcaagactggaagaatgtcttgatgtgttggagaagttgaagaagagattgtgggatagctatgacacatagattgagctacaccacgaatctctccatgtaacccaggaacccaaggatatgtgatgagatgtttgtggaagcaggaattaaaaggaagatttcttttaataatgccttgcagttgcgcagtgatttagaccttccaaaaacacttttaattatattatctcatttgatcctcaaaacaatcgtgggaaataggcaccccagtcattattatccccattttgcagatgaagaaactgagatagagctttaagtatcttgcccaaggttaaataagtaattagtgagctgagacaaaccccccactatttctgtcctcttactcagtctcactccactgtacctttgtgcaacaatgtgaagcacatccaagatgatatttagtgtggggacctctgcgtagagggacaccagtttcttgtcacttccatattagcacagaacaagctgacccactgtaactaggaaacataagtgaatacattcttttaatttaaaatttttttgagagcctgttctctacaaagcacatactaggctctgcggcaatgcagaaataaataaaacctagtccctgttctttggagatcacagagcagtgaggcaggccaacatacaaataacataactacaacagagataaagcacagggatatgggaaagtagagagcactggnattaattttgagtccactttcctctcatccagtccccagcctgaaagatatgaactgtggtggcccacacagcgggactgtaaaccatgtgacaagagtcatttcttaccccttattcatgtttgtaaactccacagtagttggttctttgccttgcatagagtatgtgctcaataaagacctactttctgaaaggttcacagagttcagcccaacacaggacaagttctagaaggcaagaagttaacctcaagattcaaagtagctctgagaattaagaaccagccagacccttccactgagcctagacccaattaattacctctgctctaattaagggaatcagtaatgtaagtaattgtaatatgggcgatatagtttgcctgtgtccccacccaatatcttattttgaattgtaatccccatgtgtcaagggagagaccaggtggaggtaattgaatcatgggggcggtttctcccatgctgttctcctgataatgagcgagttcacgagatctgatggttttatgtgtttggtagttcctcctgcattaattttncttcatgctgccttatgaagaaggtaccttgcttccccctttgccttctgccatgattgttaagtttcctgaggccttcccagccatgctaaactgtgagtcagttaacctgtttcctttataaattacccagtcttgggcagttctttacagcactgtgaagacagactaatacagtgggcttgttgacatagttttgcccttttatgaatgtgattatctcaattttattatgttaaggaaggacacagtggcccacacctgtaatcccaacactttgggagtccaaggcagaaggatggcttgagcccaggagttcaagaccaggctgggccacaaagtgagaccctgtctctacaaaaaattaaaaaactaactgggcatggtgatgcatgtctctagtcccagctactcnggaggctgaggtgggaggaccacttgatcccaggaggttgaggctgcagtgaaccatgttaccactgctgcatttcagctcgggtgacagagcaagaccctgtc

SEQ ID NO: 229292 - DNA, 260 bp, Homo sapiens
gggtatgtaggttttcttttggggtaggtgaatggagaagaaggtacggtagaagtcaagtttttagggcagaagatctggtccaaaataggaaatagaggaaggggaacacaaagaaaggatagttcaaaatccctacttcaatatgggggtcccccaaactcatgttttacatcctttttgcctggttcagaactttctgtaaagatgctttggccatttttctctcaatacaaaaaagtttgtaaacaataaaaccc

SEQ ID NO: 229293 - DNA, 440 bp, Homo sapiens
aaaattaatacaagatggagaaagcattaaaagagtaaatcacagaagaaactttaaaatactttaaaaaaatcttagctctaaaatggcacctcttttgagtatccgtcactttgataagaaaaaagaaaaaaggcaccttctgatttgaattctagctgactttcaaagaatagacactattcaaactattccagaccatataaaaagatgagatagcataagcttaattgaaaaccttatttcaaaatactataaaaatttaaaactatacattttctctttaaaaattctaagtgaaatatggaaaaatcaacaggctcgtaaaagcataaaacatgaacaactggggtttatttcaggaatggaggataggtcaacattcaaaaatcttataactgactgcatcaagaaattaaaagagaaacgatatgattata

SEQ ID NO: 229294 - DNA, 554 bp, Homo sapiens
aaaggttgtagaatttatccttcttcatctatgtattggctaggctgggagggtgtgtggccatgagaatgtgcttctcagatctctgactgaggaaattgtaatttaccagcagtccagctgctgagttctgaaatccatcctgagctttgaaatccattgccctttactccgaggtctgtacttcccatacgctgctcatagccaataactgagcccaacggggattttaggacaggactgttcctgggataagtgatactcttccgatgggtgactttgactcaaggactcctcaatggccttgccaaactttccttagaacttcattgcagtctgagacacttccaccttgaacaccttccctctgtccttcactcagggtcaggcctgcgtcactgtgcgatggctctctcagtcttccccttccatttcctctcataataaattttttatttattatatattaatatatatattatataatatatatataatataattattatatatattaataaattatgtttttcataataaatttattgcatttt

SEQ ID NO: 229295 - DNA, 341 bp, Homo sapiens
acttatttagagctcttagggtgccatttttaacataaagaaaaccaaatgttaaatgcatagaattatgcttaaatacactttactaatgtcaaaagaaatttgagttctgaaatgccgtgacaacttcaaaccagtatcagtagtctgaatgtgtaattgacacaaaaattgagtatattctttagctgctgcacaacccaatcatgtggcagcagggctcttaataggatctccaggcctaacttctagaagatctctgattcagtttggagaaagccctaaaatctttattgaaaaacaacaacaacaaaaaaaaccccaaaaactaattctgttgt

SEQ ID NO: 229296 - DNA, 372 bp, Homo sapiens
tcatcaactaacacctgaaatgcctcagcaccatctgtctccaacattaaacaaaacccacgagattccaggagaaagaaaataggaaatttaatgatgaacttaacctgagtaacttgataaatgttacctttgtggctagccattcaccagcaagtccctaaaatgacctgaaacctgaagagtgtttcacccatgaaagggtttgctctctctgggcatggctacccagcacatatgttagtcaactttctttcccttgcagggccccttggaaaactagtttgaatcattcattaactcagctccactccttccctttcccatggaccatagtttctttgagcaattaaaacttataagacaccaaaa

SEQ ID NO: 229297 - DNA, 473 bp, Homo sapiens
acaagctactctgtctcttcccattgctttaattctagggtttctgagtgaccaaaatgggaaggaaaaaaaaaacctcatctcacagaggagaactgcatgcaataaaagattcaaaagttggaaagtagcttcaaactgctgctggctcccagctgctgttacagggtgggaaggtgttaggaaatgttgtttgttagaagctccttttactgtagaatttaatagcgaatccttccccaatgcctattcagttgccttttggccgttaagctctaagttctttggtaaagagttaatataattaaacatttttactgttttctattttggagtaacttggtgctgatcttccttccctttccccagctgcccaacaagccaccctttaaacaccaaagacaactggttttaaatgcttgaaaaaaattttattgaggagatggatcttgattaaaatcttttcatcatca

SEQ ID NO: 229298 - DNA, 448 bp, Homo sapiens
ccgcctgcggcgccgagggactggttctgggctcctagtcccagcagagccgtgggcaggtcctgacccgggtccgcgattgcctcatccggcgccgccttctaggggcctgggcgcctcctccgagtctagagtcccacacagaacagccctggactctgggcctctccgtccgagccagctagcagttcatttcaagtgagagaaagggacgttaggattgtttctcccactgattgtggaaggacagtgcaagtttgggggactggataaatgtcattagtgggcccagccacacaggctgtaaaggatgtgggcatgcgcaaaagtcgcactaattgtttctaaaaacatatttgtagccacgttttaatgtatcagtataatgctctagaacggtagttctcaactctgacggcacatagaataagccgggaagctttaaaaa

SEQ ID NO: 229299 - DNA, 401 bp, Homo sapiens
ctgcacctgtaggaagggaggcccaggctcctgcactacgcggtgtgatgattcaggttaaaagggagtgtttgcttttttgttttgttttgtttacttgaggcagagtctcgctctgtcgcccaggctagagtgcagtggcttgatctcggctcactgcaacctcctccaaagggagtgttttctaatgatgccttttagatagtcatgagaagggctaccttgtaagcatttgatttgtcagaaattattagaaaatatactattgataaggaactccggcaggtgcacactttgggaggctgaggctagagaattgcttgagcctgggagttcaagaccagcctgggttccatgacaaaaccccatctctacaagaaatacacaaattagccaagcat

SEQ ID NO: 229300 - DNA, 451 bp, Homo sapiens
acacttggatcaaatgaacaatgctgggatctctaaggataaagatcttaaaagtcctgagataaagaatcccgcacccattggtacttctaacttgtcttgctttttgtctgatttctggctgatgcaggggactaaaactcactgccacgcgaaaactacctgaaccaaactatgacatctcacctgatatgtgagatgcaactgttataattattttaaacctcaattcagcattaactagccttttaatgtaaacacttacacatgatgatgactagaaacagcatactctctggccgtctgtccagatagatcttgagaagatacatcaatattttgctcaagtagaaggctgactatacttgctgatccacaacatacagcaagtatgagagcagttctaaaatgacagagataggaactgtaataaagttatttttaaagctaa

SEQ ID NO: 229301 - DNA, 164 bp, Homo sapiens
aacagaaggaaaaattcatcccttcgtggttgcttctcccttttggccaggcaccctgcctcaggcctgtaaccccagcactttgagaggtcgaggcaggcgactcacttgaggccagtagtttgataccagcttggccaacatagtgaaaccacctctccagt

SEQ ID NO: 229302 - DNA, 673 bp, Homo sapiens
ctctagcctgggtgacagaggtcgaccgtgtctcaaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaaca

SEQ ID NO: 229303 - DNA, 339 bp, Homo sapiens
tggtcagcgcgactggcgttgataacgctggtccctacaaagcctcctgctggctgttaagagctttccttctttgggcagagaggataaaaaagcaccatgactgtcctttctctggaaaggacacacgtcacacgctcacagcacaaaaacgccacttcttcctttttctggtgtcaagttttacaataaacctcaactgaataagcaaagaaacaaaaacaaaaataccaacaactacccaactcaacctctctctctttttttttttctgtgtagatttttaagagaatcaggtttactgatgtggaatttatatccaataaaattgaatacaaa

SEQ ID NO: 229304 - DNA, 451 bp, Homo sapiens
agctccaagtagaatttgggatttctatgaatttctcatagtcttaacaggcaacgactaagtgacagagcccaggggtcctgggtttcagcatgtgccgtgcatagcaacagggagagcagaggtgtcaggggagagaaatgagccccagtctcatcatgtggcagtaattggggatgcaccttttcttatattaatagagatgaacaaacactgctccagcacattcacatttgaatcttcctgaaaaccgtgctttcccattttgcagatgcagaaactgaggctccaagagcagaagtgacaccgaagtcacctagcccgtaagtgaccctaaattttatgctgctgcttcccttttcttgtgtgtcccttatttcaagaaatagacccaaggtgcaggtccatttcctacctagacatgcaaacctgacagagacaaaaaaaaaaa

SEQ ID NO: 229305 - DNA, 504 bp, Homo sapiens
aagccggggcaggggccgccgtgagagagcggaggaggagggtgtgaggcgcaaccgggtctgtttcacgctgaaacgctagggccgtgctttccgctaggcagctgcgcagagcaaccgctcctccgctgggcgcgcttcgctgctggggagggacaggcagggatgcctggtgcaagcgatccctcggccccggggcggcccagcctcgccgagctccattagttggcatccgaaacatctggcaggggctcaggctggggccccagggacgaagccagtttggtgagggcccgcgctatgctgtccaggtggccgttcatggtccgcagctccaccaggatgtccccgacgtgggcctccaagctcgccgcagcggcgggccgggctcggggcggcggggatgtacccgcgtccacggtgccctcctccctgcccgcagtgctggggcgcggggcgcggctcctttccgggccctcggccggtgccaggacgggcggcggc

SEQ ID NO: 229306 - DNA, 586 bp, Homo sapiens
agtggttctatcccttaataataactatcactgaagtaggtgttattcctgtagaaatgcaagttatagtccttgcagagcacacagctccggccctgaattacacccaagttgctctccatttgctaactaataaggttaatcagatcaggaaggtggtgcagcaaaactgtatggccgcacacatagttacaactgcccaaggtggcacctgtgcccttgcagggacacagtgttgtacatttatccctaacaaccaccataacataacagcagccttacaaggggtgtcacaggagattaaggtgattgaacaccttaccgaggaccccctgcagagatagtgggtgcctctggggctctggcctacattgggctctaataatcatgggtagcacatcaggaatattagtggtaggttgttgctctctgtggcctatgggtccaaggtgctgccctatgcacacagatctgcactagaagaactccctcagcctagggggtggaatgtaaggcctgtgggccaagcctgtttatcaaactatgtgcccaaaacttatatataaagcctgtgtgtgtatatcaa

SEQ ID NO: 229307 - DNA, 233 bp, Homo sapiens
tttcattttatatcactttctctgggaatcttctatcctgaaagttttgattaggcttagttctaatagcttcattgcaccctctaatagactattgtagaacttattattctaagatgtactaagaaatttatttttctgacctttctcactcttgtttcctccaacaagaccaagattgtcttgttcagtgttgatttcctagcatctggaacatgtccggcataagaagc

SEQ ID NO: 229308 - DNA, 260 bp, Homo sapiens
ttccaagctgccgtccatgtgctgcccaatgaagctgcaacacgtgaacctctgtggaaggcgcccaccttttctccagtccttctctcactgagtgccctatcaaaatggaagaatccctgaatgaacccatttcaagtttgaattgtggtaaaatattgcaatcccaagtgttggttgcctacagcttcctactgattttggctggtgtctaaaaagaaggtacccccaaaataaaataaaaataaaaacaaggccca

SEQ ID NO: 229309 - DNA, 473 bp, Homo sapiens
tgaagccagaactcactggcctggaagcttctctgaacactttgcaggccgaggcatggttgtaacctgtttgtagcacccagtctgagaagctaggcttgaatgtaggccagactaaatatttgaaagtttaaaaacaccatatatatggtatcattttaattaaacgactgacattgtgattaaacaaaggaatgaaaatagcagttcctaagggctccgatgactactgcagcaatagaaataaacaattcctgttactcactcttacaccacattttagcccacatacatcaaactcagttttaggcaccaagactcactcaggcccaagaaggtagtaaggaattcctactctgcacattgcaagtttaagtttacgggcatccagtgccaaaatgtcacaagctaacctgcagaaactgaatgaccatggaatgctgaaattccaaaagaaaaacgtcgcgcggccg

SEQ ID NO: 229310 - DNA, 574 bp, Homo sapiens
cccaattaggagcaaccagccaagttcattatgcccattagtttgacggaaatgttctacgttatcaaatacgtggtcacccagaaccttgcctatcataattatttgattaggagtatctaatagtgatatttttgtgtatctctattaccacatcacaccgatgactatcagtgctttattcactattggaactagagtcattagtgcttctaaatctagtcatttagagaaccaattccagaaacccccaaaccaattcagagaatttattcttaaaattctgttcctggctgggcattgtcttatgcctataattccagcactttgggaggctaatgtgggacagtcacttgaggccaggagtttgagaccagcctgggcaacatagtgagaccctgtctctactaaaaaaatacaaaaattagccaggcatcgtggtgcatgcctgtatttccagcttcttgggaggctgaggtgggaaaatcgcttgaatctgagaggcagagtttgcagtgggctgagatcgcaccactggactccagcctgaacatcacagactgagaatttgtct

SEQ ID NO: 229311 - DNA, 158 bp, Homo sapiens
cctcaaggctggaaacccccaagctaggcagcagcagttgtcaagcatgctgttatggctgtgaagggattctgggtcctttattactcataattgtgtttcactttgagaaacaaaattcgaggctgaacaacatagtgagacctcatctctactga

SEQ ID NO: 229312 - DNA, 437 bp, Homo sapiens
aagggacagggagggaggaaaagctgattgaccagccccgaagcacaaggaccacttgtctgcctcagggttcatcccccaaatacctttttccacctgagaagtaggagtgatattcctgacttcatatgattgttatgatatattgttttattaatttataaacttattcattcatcacataggcttttatttattgagcacctcttatgtgccaggttcatgctagacaccaaggatgcctgtgtttgtgacagttcctgtcttccagaaagtgatcaacaaatattgattattatggctaacaaaaataataatctagttcttactcacaagtagagagtgacctgtccccggaagagattgagcagaaatttgagaatcattctttagggaagtcatgcatgagattctattaaatagcatgttcaaacaga

SEQ ID NO: 229313 - DNA, 498 bp, Homo sapiens
cctaggttacatgtctatccctgaggtgggagaaataagaatgtatgattgatggataaaggagggagacgaaggtaaagagagtttatgtccagaaagtctaagggatgctgtgtaggcaaaacaagatttcccttcatgtagtaatagttagcattgatggatgtttagtggtttctctggaaactatgcctaagtaaatttgttattaattctaaggagatagacctctattaataagaagctctttgtatctgtatgatacacttatcataagatttctttatttgtaaaacaaagaaataatgtacttgaggttagggtagttctttgattgtctgtgatgttacttagaaatgtcctttgattcatatgcatctaatttacgttgcagcgttgaggtgtagtttagagactatgttgggtgttgtcttgttccgagagtttattactaaataccatggttaggctgcggcagacaataaaacagtctgagag

SEQ ID NO: 229314 - DNA, 380 bp, Homo sapiens
cggggtgcgtgctcaaaccagaattgtttgatcccaaaccctagggcctctccatcatttactatcatagttcgtaggagagtcttcaggctggaagtgaaggttgcctggattccggatctgctctgtcttgtggccccccagcacaaagctcttgcatctcaacctcagtagccttactcttgtagcacagatgggactgtcactctcatggctggcttcttgggatactttctttccatgttgaatccagttctgcctttctttggggtgcctcgtcaatcagggcaatatttatgaaatcatacaggtgttcaatacatttttagatttaggtctaaaaacccaggctgactcgcacttggtgtttcaaaaaaaaa

SEQ ID NO: 229315 - DNA, 505 bp, Homo sapiens
catggggtacccagccataaaagatcagggagacgagaagcaattgcagttaagaactgagaaggaggggtagcaaagcagaaggaaaatcagcacaggggttccccagatgccaagttaagtgatgctcactgataactttgaaaagaactgtttcaatagtgtgttaacaatgaaagcctgattggattgagtacaagagaaaatgggacctctcatttcctaggaaaggaaaaaaaccaaaaaactggaaacagcaagtaggaacaacctggtgaattttgctacaaaggtagcaaagaaacagggctgcagctgaaaagggatgtcagtcaagaaaagggttttttgtttgtttgtttgtttcttttaataaaggatacaggccgggcttggtgactcatacctgtaatcccacacttggggaggccaaggtggacagatcacttgaggtcgggagtttaagaccagcctggccaacatggtgaaaccctgtctctactaa

SEQ ID NO: 229316 - DNA, 648 bp, Homo sapiens
aaatacaatggtactccaacaggcttctaaaacagcactaagtccttcatttattgaaggaggagccaaggttattctcaatcaatcgtaaagcaagttcataggaggaataaattgcataccaagaaaaaaagcaatcaagagttaagtacttagagctgttaacactgagtgttatacaaagtaagtctgtacctcaaagaatctacaatcaagaagcccggccgggcgcggtggctcgcgcctgtaatcccagcactttgggaggccgaggcaggcggatcacgaggtcaggacattgaaaccatcctgactaacacagtgaaaccccgtctctactaaaactacaaaaaattagctgggtgtggtgatgggggcctgtagtgccagctactcgggaggctgaggcaggagaatctcttgaacccgggaggcggaggctgcaatgagccgagattgcgccactgcactccagcctggacgacaagagtgaaacgccatatgaagaaagctctcaaaaaaaaaaaaggaaaggaaaaagctctcagccaggtgcggtgactcacacctgtaatcctagcactttgggaggctgaggccagaggtttgagaccggcctgggcaacacaatgagaaacccccatctct

SEQ ID NO: 229317 - DNA, 337 bp, Homo sapiens
ctccatcatctgttgtgggtcacttgtgctttctgattttaacacccatgttgctgaagtcatttctccaattcatgatccatgaaactacttcagcagtgaaaatggcacccctcaggttcaagtcaacacttttatatttccctctaggtcaagatccaagctatggaagaaatcaggatatgtcaattttctagagcagccaagttttctaaaagtctacctagccatgtagttatgtagcctcactctcacttaaacaaagaaaattaaaaagcacaccagaaaagacttttcttgttaaaaacacatgtttattgtagaaaatatagtaagg

SEQ ID NO: 229318 - DNA, 224 bp, Homo sapiens
gggcaaagggcaaccattcattgagagctgttgagtaagaaagcgacatagaggtgaacatagggaggaggatcccggctgcacgtttaggttggaaaagcaagaacaacacctggaattggaggatatttgtaaaaggagggaagaaggctgtgatggttaataattgagtgtcaacttgactggattgaaggatgcaaagtactgttcttgggtgtgtctgt

SEQ ID NO: 229319 - DNA, 601 bp, Homo sapiens
tgtggtgaccaaagccaatcactctttcattcgacaaatgtgtatgagcacctaccatgtgtgctgtgctctgcactgggatcccagcaataaacaacacagaaacaagacaggttatactgtagagaaggagacactagacaaatatttgttggtcaacagaatttgtggaagccaggcaggactctaagtgaggacaaatgacaagaagagggagaatttagaaaataagatatcagtgaaacgactattataggaaaaaggtgtttaatggattcattcagcaggtaatttattgaatatccactgatacaaatgtattcccaggtattagggatataccagtaaataaagcaaagtcctttcccttgtagagcttatattctatcatttagaggcatttttgaaaagcaaagcacctaatattggatgaagcccatctgtgggaggacagcagtgaaggagttaaaatgcttctagggctccaggctttgttgaaacagatggtttctttgcactagggaatgtttttaagagggattagaggactgggctgaggaaggcctgagacctctttccctcacgccatagcacacacacc

SEQ ID NO: 229320 - DNA, 324 bp, Homo sapiens
cccaccaccctggaagattttaacactctgtccttagtgttctcttggcattttgcatttacctttattatagaacttggctgtttaaattttaattttttgcaggacgaaccggagagtgaggtcatttatacgcagaacattgcgtctcctctctttaatttagcattttattctctgaggtcctagctatatggtactttatggtgatgaagtacagccacaccattctgcctttgtgtggccattgcatgacctctccaaatgaaatcatttcttctatagagaaaaaaaagtgaggatcagagacattattaactaagt

SEQ ID NO: 229321 - DNA, 389 bp, Homo sapiens
actctactttcatgaaagcattttgtaggaaagcagtctaatgaaatggttaggccaaattttcgattccaacacccttttatacttacgctattgtctctgataacattagattcacatacatgtgtgcttgtatatatacatgtatacacatacatgcattcaaatatgcacacatattcaccccacagggttcttgagatactaatggagggtaaagtgtgaaaaacctggagcctttgacaagaactctggaaaaggcttaaaagaggttggatgttgtggctcatgcctgtaatcccagcacttggaaaaggctgaggcatgaggatcacttgagctaaggagttcaggactcctccaggcaacatagtgagacttgtctctac

SEQ ID NO: 229322 - DNA, 776 bp, Homo sapiens
ccaggatccctcatcgctggccttcagctttctcatctgccctcaaccacagaaccctgggaggaggctccctcagtggctcgtgcactcttgcaggccctgtgaacatatatacttcctggtgggaagagcaagggagcctctggtggaaagcagccccagggtccaagaaccacacagccctgcattagggcccccagggagggagaagaccaaggtcatgcttttgaacctggatgccagaagagaacagctgtggggaaaagcatgcctggaaccaagaaaaacatgtttaccaggggccattcctcacaccagctgcaggcagggtcaggaaagccacaggctgcactgtagttgcaaccttgcatgcggacgcaaggctcagaatgttcctcaaagatcctaaaatgttcccagagtcaggctgagtccattcaaatgttcactcaccctggccacactcactacacctgacttccctgtatcatgagttagagaaatagtatagagtctggttgatgctggcaggtgggagggaatgggataggaaggagagagagagagagcaagaaagaaggctgtttgggtttttgtctataacatatgtatatacactcatcaagtccattatttaaaacctctttcatggtttcaatttcctgtggaccacttttcatgcccattttaagttccttgaaggcgaggagatacatgtgtatctgccagcttcactgtgccttatatcttaggcaatcaataaatattagtaaatc

SEQ ID NO: 229323 - DNA, 198 bp, Homo sapiens
ctgggagaaataacaggaataagactcactctccatccagcaggcactcaggggctagtggggctggaggtgaagaacagacaagtaaacagaaccttctagcacagcggcttcttaccagtgcgagccccctgctcctgtgtttgagaaacaatgggcatgtcctctctgcccaagagctcttgtcagaattgttta

SEQ ID NO: 229324 - DNA, 81 bp, Homo sapiens
actcttaaataaaaattatgagaggctattgatttgggctaagatcttgtactaggtcccaatagtccaacctaaactgga

SEQ ID NO: 229325 - DNA, 509 bp, Homo sapiens
tcaggatggctctaatgatcctcatctccaactttcaactttcaactttcaacacggctgtaatgatcctcatctccaactttccttgtagtccccttccacactgaaccaggtttagtctgcaagtgaccatacaagtgatggcgtgggtcttctaaggctaggtcatgaaaggcagcacagtgcctcttctactctgctcccttggatcagccactctgggagaatccagaagccatgtcatctggatattcaaggagctgtctagagagttccacatgaaaagtactgagacttcttggaaaaacagccataaacagcaaactaataacacgagtgagtcatctcggaagctgatttgcagccacagtaaaatcttaagatgactgtggtcctggcgagatctcatgagaaatccagagccataactgcccagctaagccactcctgatttcctgattcccagaaaccataagataataaattgttattttaagccaaaaaataaa

SEQ ID NO: 229326 - DNA, 545 bp, Homo sapiens
cttttctttttttttttttttttgaatgaccatataatctggacttactaactttaggtaacagtaagttaaaagatagaataaggtttcatattacaggaattcaaaaattgaccatataataaatgatgaagaaaactaacaataaacaggacaatgttcaaatagctcattggggccaaaagatcagcgtatatcctgcatcatctttcatgcaatgtctcagctttttttccctcaaacataaaggcagattaatacaaattagccttatttagaatattcatttacgtttccttctgaaattgatacttgagtggaagatgtattaataactcgtggtttctactgaaatttaagattccaccagatgatgctcagatttagacgatgctagagtaagacactactgggtgatgatttcaaagtatgagctgcaggtaaaatctaaaaggacatacataataacaaatgttttctaatttaaaagacatatagtaaatatccatgaattaactcacacaacctacttacaaacaaaacta

SEQ ID NO: 229327 - DNA, 560 bp, Homo sapiens
aagggggatgaaacttgtggggtgagccatttgggctgaggaggagggaggttggagctgagaaatgtggagacaatttccctttagaaggactgaatctccctgcctctctggggtgcggcagccagcaggatccaatggtgtatatgtctccccagctccccattcagtgatatcatgtcagtagcttgaaattatccgtggtgggagtattatgtcatggaaattggcaaatggaaacttttattggagattcaattgttaaacttttaccagcacaacactgccctgccttcagagtcaatgaccctatccaagtttaatccatctgtccactgtctccaacacgatctttataaaacacacctgacaacattacccttttattcagttttttaaaagataagtttccagctcatcggggtggctttaaaggccatttctcctctggacctcacccaacttttcaaatcacttttcctacccctacctctaaatgctactcaaactccagccatcctgaataataagacttttgaaaagtagattatgggctgggc

SEQ ID NO: 229328 - DNA, 566 bp, Homo sapiens
ctaaaggtttataatctctgcagaagtttctaattcaacagttcctttgggaaggtgcatagcaaagatgccttattcatcagcacagcaatagatctaacgttcccgccaggggtactggtcagcgttggttctttagaaagcctgtgtagaatcgattaaaaattgctcagcacttactacagccattttcaaccaagaaaaaaataattttcgggactcacttatattccacagtttaaatatggacaattaataggtcaaggtccaggctggaaggggaccacttcgaatcttgaatgcaggggcaaacagctcaagacaccatggctgatgaagacgctatgtacacgctttccagtatgaaaaccaatgagctacatggggctggcgaacacttgaaaggtggtgagttagagttgagatgtgctggacgtgtaaaataatacatcctggagtttgaagacttttgtataaaattacttaagatatctgaatttttcaaatgtcgattttttgttgaaatgatatttgaacagattggattaaataaaatgtattattaa

SEQ ID NO: 229329 - DNA, 1170 bp, Homo sapiens
ggacatcccagcaagtccctcagtggagtcagccagtgcaaggcgagtgagggacccccagagacatgaatgggtctcagatagtgtgtgagtggatgaagcagcaaaaacacacgctgctaattaattgatttatgtcgagctcaaagtagtccacatcaaaaagactgtttggggctgcaggaattcagtggataattgcaggcaaggcaagggaaggtggaccagaaaggtgaggaggacgctcccttcgagggtggagagagtaagactggcattgcacatgggtgggggggcccgtcgaggcccctctttgcttctgagagtctgttttcatcgacagtcttctactaaatgtacatagcagcttttcagggcaagggtcaccgggattcgtctttatgcctccccagcccgggagccaccacctccaccagacccatccacacagttgaatctcatctcaagttctctggtgcccgaccccccacgcacaccgtgctggtctgggcatctcacctgcatccgcacaagtgcctcaggagggtggagtgtctggtgctcggcgctggaggctcagcccacactgtgccgggcagtcgcaggcctcccagatgaatgaagcatgaatgaatcccgatcctgttatcacagcttctccccacgcatcccaggcagaatgttgtgcaaaaaccacaccaggattcgtacatgccagaggactgaacttctgcgtgttgcagataattcatcttcctgaatcactgtggatctaccatgtggttaaccacggaataaacatgggggagagcgtaagcgctgtcctagcagaaacttatgcttcttccgttacccttaaaaagtaaagggtacggatttcataattgtgtttctcttgtaaatgagactctcatggaaaaatcagccatgtaggcgatagatttgtatacctttagattaaaatgtcacttcgattatttcaagtgtaaaagtgtttcagcttttttgaggtataattgctacacaaagagctgcacacatttcatgtgtgcactttggtgagacttgacctgagcaaacacccatgaaaccatcaccaaatcaaagcaatcgaggaattccacacttgctgggggcttccttgcacctgtgcccgtggtgagaacacag

SEQ ID NO: 229330 - DNA, 768 bp, Homo sapiens
taagttacagtcttttgacaagtttacacttcattctcaggaaaggctgatcatggaaaacaggagattttgccttcaggaaaaaaaatgaatatgcttatggaaggaaacatgtgactaaatatgtgggaaatagtgactgagtggcggctgagtaaacagggtagcatccttttagctggttgtgctttgactaactgatctgttctttcttacttgtagaagattccaagcaagaaagtattcagcagtggctggactctggattctttgtctctgcaaatgaaaactttcaacaagtcattgatcgcactggtaagacaagagaagcagttatgctttgggaagctgagtaggagatatattcaaatatctacgtgaataaatcttcttaaaatgagcattatcagaggcttctagaaatgatcagccctcaaaaactatccagctcaatctcttcatttgacatatgactgcgacaaaaatgataggtgcttccccagcagcaggttaagggccgaacccagggctcttgccatatcatcaatggctcagagtatagcataaactcactgggttctatgaagacatttgcaaggatgtagttatgaaaatgaaattgtttaattttccccatcctgtattatacttttatttctgaatctagattttttctattctttggtctcaaaattgcacttacattctctctttctaataatgcacttgttctcaagaagaataaatgtctgaattctaaagcaaaaa

SEQ ID NO: 229331 - DNA, 537 bp, Homo sapiens
tttagcaaataatggtagcttttacttgaagctttaaaatatcaattttaaaaaaacaattttaaaataacaatttgttttcaactatatatgcagttttaataaaaatattagataattcgattacaagagttcttgacttacattcctgccattagcaaagacagtcaacaatgtcttaagagccaccaaacatatcaatctctagatatggtctaaacctaaggttattttaaaaactaagaacagtgagtgtgtagaaactcttcaattatctggattaatcagcttttatcctgcctgtatagaatcaatgtcttcctcctatgaattccacagtttagtaattatgaaaggcagagaattcatttttccttcctaggtatccataaaccaagcttctctaacccatagcccaggatggctttcaatgcagcccaacacaaattcataaatttcttcaagtgtatttcatgtgtggtccaagacaattctttcaacatggcccagagaagacaaaagattggacatccctgg

SEQ ID NO: 229332 - DNA, 413 bp, Homo sapiens
taaaaacaaagcatttaacttgaattagaaaaaaacttggtcacaatataatcccccaatttatggaacaggcaaacatactgtaaaactatccaaatttcatgcataagtatgacaactctgtttcccttcttttttctttttagagacaggcttttgctctgttgcccagtttgtagcatagtggcccgatcatagctcactgcagccttgaactcctaggcttaagcaatcttcctgcctcagcctcccaagtaggtgggaccacaggcatgtgctaccatgcccagctaattttttaaaaaaatattttgtagagacagggtcttgacatgttgcccaggctggtctcgaactcctggtctcaagcaatcctcctgccttgacctcccctcgtgccgaatcctgcaggc

SEQ ID NO: 229333 - DNA, 468 bp, Homo sapiens
tctgagtcagcacagtacaggcgagaacctaagaaggacagtacagtaaggtgaaagaactaggcttttagtattttatgtattagacttaaaaataaaaaatataagcttaagaagctcataagaaatgagcttacaataaaattctgaacattttgacctcctgcctccacaaacactcttgccttaggaccatagctgttacaggaatgcttttccttccagcttctgccaattttaagtgaaatccctttatggactcttcattttttaccttgctggagatcatctctcccttctttgagccagtagcactttgtatacttcgtttatctgtgtcacattttatgttagattgtattttttagagactctggttgatattttttttgtatatctaccctctatttccacaagaccaagaacgagatcttatataaattaggtgcccaataaatacaaactatg

SEQ ID NO: 229334 - DNA, 496 bp, Homo sapiens
gagataaaatattctgagctcattaatgtgaaaaacaaaactgcatataaatagatacatatttatgggtgcatatatggaaatgtaaaggtatagagaaaggtctggagcagtggtgtacaataaaaatgtaatgtgaactacacatgtaattttaaatttcctgatggccacattaaaaagaacaggagaaattaatacattttatttaacccaatatattcaaaatgttatttcaacaggtaatcgatataaaattatgagatatttttactttcttccttcatacccagtctttgaaatccatgtgtaatttatatgaacagaacagctcacttgggactggctgtatttcaagtgcccagtagccacgtgtactaatgaatccggtcttagactgtgcaggtctggaaggacacacccccaaactattcccatgagtcacaacaaattgagaaggtggaaggtgtgaataaaaactttgtatttttttaaa

SEQ ID NO: 229335 - DNA, 650 bp, Homo sapiens
ctatgtgaagattgtgcctgcttcctctttgccttccaccatgattggaagtttcctgagaccttcccagcagcagaagcctatacagtctcgacagttccccagctatcccccagtggcttggagattcccatttcaagagtgtagagttctacccagaaggtggctgcgtggacagtgactacattctcagctccatgcctatttgggtgaggccctgtgatgaatggtcatcagtggaatatgagcagaagtgttatgtgtcagaagaagacatgccttctccatcctttcttttcccctaccctctggtttgtgttggtttccagggtgtccttgggaggggtttgggccataatttcaaaagacacagtgctaaataccacaatcccaaatgttgaaatctggaaagatcaaaatctctaaaggaaggcacacatttaagatggcaaagccactgtgcctttgtccctaaataagagtggggcaactgtgcctttcaccactctgctgttaaccagttatacacacaatgaactgttacgttagcaaaaaaaatgtttcttgtaaaggccactgaaattgtggagtttgtctgttacagtaactagcagtactctaactaaaatgagcgtctttcataatagaga

SEQ ID NO: 229336 - DNA, 701 bp, Homo sapiens
ctatgtgaagattgtgcctgcttcctctttgccttccaccatgattggaagtttcctgagaccttcccagcagcagaagcctatacagtctcgacagaactgtgagcagattaaacctcttttcttaataaattacccagtctcagagttccccagctatcccccagtggcttggagattcccatttcaagagtgtagagttctacccagaaggtggctgcgtggacagtgactacattctcagctccatgcctatttgggtgaggccctgtgatgaatggtcatcagtggaatatgagcagaagtgttatgtgtcagaagaagacatgccttctccatcctttcttttcccctaccctctggtttgtgttggtttccagggtgtccttgggaggggtttgggccataatttcaaaagacacagtgctaaataccacaatcccaaatgttgaaatctggaaagatcaaaatctctaaaggaaggcacacatttaagatggcaaagccactgtgcctttgtccctaaataagagtggggcaactgtgcctttcaccactctgctgttaaccagttatacacacaatgaactgttacgttagcaaaaaaaatgtttcttgtaaaggccactgaaattgtggagtttgtctgttacagtaactagcagtactctaactaaaatgagcgtctttcataatagaga

SEQ ID NO: 229337 - DNA, 360 bp, Homo sapiens
ctgaggttgacatttccgggttcatacaacaaggatgggcatgattgtgaggcctccccacccacatggaatgagttccccagctatcccccagtggcttggagattcccatttcaagagtgtagagttctacccagaaggtggctgcgtggacagtgactacattctcagctccatgcatggtctgaggccttcactcctcacccttcctggatgtggttgcgccagagggccttcagggatgatttagtgagcagatggtaccaggaaaaccaagggtattgcatccagctgtgtgtacccagattggtgaattcaagcctctgatctaggatctgaaataaaaatcagaataagcga

SEQ ID NO: 229338 - DNA, 690 bp, Homo sapiens
ctatgtgaagattgtgcctgcttcctctttgccttccaccatgattggaagtttcctgagaccttcccagcagcagaagcctatacagtctcgacagttccccagctatcccccagtggcttggagattcccatttcaagagtgtagagttctacccagaaggtggctgcgtggacagtgactacattctcagctccatgcatggtctgaggccttcactcctcacccttcctggatgtggttgcgccagaggtgagtaggagaaagaatgcttgagaatttatcttgacaactcctcctcatcctaggctttgcactttctctgtccctgaaacttcaaggtgttgttcctcttaatatttcaaagacccgaaaggaaaggaagttttgcccacaaagcagctcccacagcaaatgatgaatgctccaagtgctttctggggggaaaaaaaacgctgaataaatccccacagaaaaagaaataaatctctgtgacatctgctaatgtctgccatttccttaaacacctctacctgtccagtttccgtacctcttttcccggccttcagggatgatttagtgagcagatggtaccaggaaaaccaagggtattgcatccagctgtgtgtacccagattggtgaattcaagcctctgatctaggatctgaaataaaaatcagaataagcga

SEQ ID NO: 229339 - DNA, 238 bp, Homo sapiens
ttgcctcaagaatttaaagaatggaatgctttggccaatgaaatgattgcatgtctatatctatatagatgtgctatagctatttactccttaaattctgtaatcccagaacttaagagaatcatttgaggccaggggttagagaccagcctgatcaacgagcaagacaatgtttctacaaaaaaatttaaaaattaggccagatgcaatggctcatgcctgtaattccagtactttg

SEQ ID NO: 229340 - DNA, 493 bp, Homo sapiens
tttgctgttactaataagcaatcgatgttgtgcttgacttcttgagcagatgtaaagtcatcatgagatgtttccttgtttctgtgtggttcttgtgtttaataaaatggtgacttccttttgttggcatcagttctgtaattcagatgatctttttactgctttgtatccatccaagttgtgaaatcaactataagctgctcctttcagcttgccagtgatgtggaattcttaccatatgaacgttccccagggtttttgtaagcctctttaacctctggatgcactctattgacagcttccgagttgtgataagtatctaccttttatttcaacttggagatttcttgaacttataaaattacatttgctttggaacaaatactttagagtgcactgagatggcaggttcatgaattccccagaactttcataggaaatggagaatgcaaaggtcatgtaaatatagttgtagtaatgtcttcactgattg

SEQ ID NO: 229341 - DNA, 296 bp, Homo sapiens
caaattagggcagatgggaggcagggatagggaggagggcacctattcaaaagatgttatggaaatagaatcaagagaatgtcttggctgggatgataggggtaacatcattaacaatgaattttaagattaccaggagtctggtggtgctttgacgaaaattagcaataatgcagaaagagaaatttttttagaagagaagataattaaatgctgtttttaacatacatgtggagttcaggtgggatatgggtggaggcatctggaaattcaggagtggagtccaggatagagat

SEQ ID NO: 229342 - DNA, 581 bp, Homo sapiens
gttatcttaagatatctttattttggtttttttctcttgaaattgagtcctgtttttctgtttgtttgcatatggagtaattttttatagcatactcagaattgtggatgataccttgtagggactcttgattctgttatcttcctctaaagaatgttgactttttgttttgtaaaagttaaagctgactaattacactgaacttgttgagtgtctcggtttttcccttagtctagttgaatctattagaccaggtccacagtcctggtacatagtctatacttttaaggcatggcccttctgagatttcagtgggaagtctgaaatatgtactaagacctctaactaagtggaactcaaactccaaattctacccctatgccttgggtagtagctgaaatctctgatcagcttttcaactttccttttgtgggtttctgcagacatcttggagtctcccatacattgtcaattcagggatcagccaaggattttaagggagtctatatgcatatatggggcttcccctttttggctcttttacccatctcttttattccatcattttaatcttatttacc

SEQ ID NO: 229343 - DNA, 547 bp, Homo sapiens
agcgatgtggggtctagtcttgaccctgaacctaacccactctgtgacccagcctcaggcctcggtcttttcagctacaaaaatgcaaggaaggaataaaattagacaatggcaaatattggtgaggttatggggaaatgcattctctggatttgtctttaaactggaaatattcatgacatgtgccagataatcctatgtcttggtctctaccctagaaaaatatttgcacatgtactcaggaaggctgtctcttgcgggaccatatctaataacaaaccactgaaaagagctcaagggctgtccatagggaatgaatgaatacaatggggtctatctacataacgggtcactgcatcacagaaggaataagcaagatctatgcatgcagagaaatggatagagctctaaaatatattaagtaaaagtagaaagttgcacaataatgcatacaatataatacaatttttgtaacatgttaagcagaactgtggattttctgtgattacattcaaacagaacataaaagcattttttaaaaaataac

SEQ ID NO: 229344 - DNA, 438 bp, Homo sapiens
tatagataactgcattttattacacattgaagctttgtggcaactgtgtcaaggaagtctattggcaccattttttttaacagcttgtgctcaattcctgtttctatcacattttggtaattctcacaatatttcaaaccttttcattattattatatcttttatggtgatctgtgatcggtgattcttaatgatactattgtaattgttttgggacgccatgaaccatgctcatataatatagcaaacttaattggtaaatattgtgttctgactactccaccaactggctgcttttttatctctttctctctaattgtggtttcctgttccctgagacacaacaatattgaaattaggccaggtaataacctaattaattggcttgattcaattaggcctctaactaatgatgatggtctctaactatttaagtga

SEQ ID NO: 229345 - DNA, 388 bp, Homo sapiens
agaggaaagtgcttctggagtcagacctgggtcaaattccatctttgctacttcctagctgggggaccttgcatagatcacgtagtgtggtgaggattaaatgagatgatgtttgtaaggagaaatgtgcaaaaggaacataggacattctaccgggaatcatttccactggaaaaacatggttagactgggttattgaaggacatgatagcaacttttccagagatgatgaaaaatactcctgtattttcaccagacatgttaggagatcctaacttgtttgagctggttggcgctcattataaaatctccttttaggaggggtaatgaaggtgtcctaaagattgcaatgccctgcaggagagcacccaagcctggtcaacagagc

SEQ ID NO: 229346 - DNA, 387 bp, Homo sapiens
agaggaaagtgcttctggagtcagacctgggtcaaattccatctttgctacttcctagctgggggaccttgcatagatcacgtagcttctctgatcctctatttcctcaactataaattggagatgacactatcagttttgtggtgaggattaaatgagatgatgtttgtaaggagaaatgtgcaaaaggaacataggacattctaccgggaatcatttccaagatgatgaaaaatactcctgtattttcaccagacatgttaggagatcctaacttgtttgagctggttggcgctcattataaaatctccttttaggaggggtaatgaaggtgtcctaaagattgcaatgccctgcaggagagcacccaagcctggtcaacagagc

SEQ ID NO: 229347 - DNA, 96 bp, Homo sapiens
ttctttatttttttattttttgcctgtgcatatccaatcacttcagcagcattgttgaaacggctatggtttctctatcgaattgcttttgtgcct

SEQ ID NO: 229348 - DNA, 535 bp, Homo sapiens
ctcagttgtcacttgaattcctgctaacaccccaatacatgtggaaaggttgctcttagttatagagccctgttatgttggagctggaaggtctttagccatcaagcccagaatcttaatttctcagatgaaaaagccatgacccagaaagtttaagtgatttactcaagatctcagagtctgtacattagagagagctgggcttgatttagccaaaaattattgtggcccactttagggatttaccctcagatgttgtcatcacaaaatgtatgtatcaaatgtgaaactgccacttcgttgccagggcattcttttagcaaataaccttaaacgttggaattgcccttatgaggagatgatggtacttcagcagtgcccctcagagcccgtttagatgattttgcagagctttctgttttaaacacttctgtctgaagtgtttagtgtgatgctataggttaggcaaaaatatagtaacagcaacatgacaacaacaacaaaacaaccaacatggataaacaaatgaacctta

SEQ ID NO: 229349 - DNA, 481 bp, Homo sapiens
acacagtgagaccatctctacaaaaaaataaaaattaaaaatatattttttaaaaaatctaaagaccctctgttaatttagctgttggaaccacaacagtggttgtcttctaatcatcccagaggactcaactgagattcaatcttcttcatgtgtctctggaattcatagtcagaagactgggatggagtcaatgagatcccattcaattatgtctgccattttcccctctcaaaaggacctatgagactacaggcctccgtccagaactaacctgcaacttcagaggtgtaggaaaggaatgagacagctatacaatgcttttttttttctcttttcctctgtaccccaataaaacaatctgctttacaggttagatataaagagtacaaaatttgttttaaaaatacgaaggttgttattgggagctgtaagtcttcaaccatatttcatatcttgtaagggtactattagcctccag

SEQ ID NO: 229350 - DNA, 490 bp, Homo sapiens
ccataaaggcctttcaaatacaaacatgcacacatgcgcgcgcacacacacacacacatacatcttggatgttagccttttagttgagctgactcttaaccattgaacacttaaaaaaaagctttttaaaaaatcttattgctatatttcagctaggacaaaatgctgctaaacgaactgtgatcgcacaaattatatgatttctgagcccttaaatgtaagcagaaattaacaccagctggtgttaatgctacctttagtcatttaaagggaatgtgcaagacagaatcccaaaccagtttcttactagtgatgggtctcaggctgtagactgctctctaccatcttagaaacagaaaaacaaaaaaacagataactcatcttccctgttggaagacagctcaaactctataaaggagttacttgccttccatcatcacagaggcaggaaaaacttgtcttccttgtgttggaaacaagcaaaactcca

SEQ ID NO: 229351 - DNA, 649 bp, Homo sapiens
tgatagatgaaaatatgatcttgatggaatacaggacagacataagattagattttttgaaagagaatttgtacagtacaagttttattaactatttattatgaaggcttgagcttatcctactaccttaacaatgacataactgacaaaaaaatatatgcagcataattttacagaaattggatgacagacagctctggaatgtgaccctaatgcaaacaaaaaaacaaacaaacaaaaatcttgtgtttcacaattaacctactctcctcctggaggtttagtgaagaaaagaaatagaagatataaataaaaatcaatattaactttttgagatgaaaaatgcagtactttaaatgagataattaagtgtagaggtaaagctcagttactttaaaggcatagcagtagaatctgtcaaaaaggaggcatggaatgaaatgaacctctgatacttggagtaccagaagaaggaagaggagagttaatgaaaatatttgaagaaataatatctggtgattttctgaattagattaaaacaaaacaaaaaaatttatgaattcaagaagctcaataaatttcaggcagcataaacatgaatatatatttaaaaccacaacaaaacacatcattataaaatttctgagaa

SEQ ID NO: 229352 - DNA, 571 bp, Homo sapiens
tggacggggctggtatgaaagattggaactacgcggaactccaaattcatagttggttctcaccattaaacatttgctgatttctggggacagataggaattctaataggcatagctggcaaagtgaagggaagtctcccacagtctcatattacttgaaaaacaaagttccattaaaaagaagaagatggctgtcaacaaattagtaataggcaaatggtggataggaagcaggactaaattgcagctcccactcagacagagagtagcttgtggagactcacattgtgaacttttgctcccagaactactgcaggaacatatgaggaaagatgagagaatccacagactctttgaaggaagcagattgctcctgcagggcctgggagacaaccaaacactgggtccttagggagaggtgccagaggaattggaaaaaggccacaggcagaaggaaggctccagctaaacttgattgacccatcatttggatgacccgaaaccacagatgcaatagaagaatggaacaaatttgtacattttgtcaataaaaactttatcttcaaaaaca

SEQ ID NO: 229353 - DNA, 483 bp, Homo sapiens
tttctaccatcattatagtatagccaccaatttctactgagtatttatctactatatggcaggtcaagtctgcattctgggataaagtgttgacacaatcttgaatcagtgcctaaggagttcacaagtccagagaggggatagcgcatagagaagataaagcagatgtccatccaaagacttgtatgtgaatgttcatagcaactttatttgtaatagccaaaacctgaaagcaacccaaatgtatgttaagaagcgaatggatacataaattgtggcatatgcatacaatgggatacccagcaataaaaaggaatgaactattcaaagataagagagctgaagaagagtgaaaataaagaaacttctgcaaagccacacatgtaattgacccatcatttggatgacccgaaaccacagatgcaatagaagaatggaacaaatttgtacattttgtcaataaaaactttatcttcaaaaaca

SEQ ID NO: 229354 - DNA, 384 bp, Homo sapiens
tattacagtaggaacagaggcaacagcaacatgggtggctggcagtgatagaaaggattttagttttgatacatggaatttgacatgctttttgaaaatcttcagatggtgatgtacaaactactgcaggaacatatgaggaaagatgagagaatccacagactctttgaaggaagcagattgctcctgcagggcctgggagacaaccaaacactgggtccttagggagaggtgccagaggaattggaaaaaggccacaggcagaaggaaggctccagctaaacttgattgacccatcatttggatgacccgaaaccacagatgcaatagaagaatggaacaaatttgtacattttgtcaataaaaactttatcttcaaaaaca

SEQ ID NO: 229355 - DNA, 710 bp, Homo sapiens
ttatagactgtaaatatcccataatggccatttggtaatttagttaataatagctctagttttggatgtttcattttttcaggttttttgctctttcacgttttgtctagtacagattttaagtctttttttcctggctaccctttgcaagttttactgtctttgctagataatggcttttgtatttattttgacgtgtcttatgttttcagtgtggccaacccagtataccaaaattgccttgaatatggtttctgtgatgagagagactatgttccaaaaatcctgttggtagagacatttcttttattcttatggagggttaaagataaatttcattccaaatctctaaatttagaaaaacagtaatgtcctctgttggttaaaaatcctcacctttcttctggcattaagactcaataatgggggctgggcacggtggctcatgcctgtaatcccagcactttgggagaccgaggtgggcggatcacctgaggttgggagtttgagaccagcctgaccaacgtggagaaacctcgtctctactaaaaatacaaaattagccaggcgtgatcgcgcgtgcctttaatcccagctgctcaggaggctgaggctggagaattgcttgaacctgggaggcaaaggttgaagtaagcagagatcgcaccattgcactccagcctgggcgacgagagcgaaactccctctca

SEQ ID NO: 229356 - DNA, 507 bp, Homo sapiens
gcctccttgttttcttgaatattccagatatgcccactatggaacctttgcacccattgttctgtctgccaggaaaagctcttctggatatttgtatggctaacttcctttcctcctttatgtacttgatcaaatgtcatcttttcagtgaggccctaaccatttaaaaattgaaagcttcctcctcccatggctctccgcttattctgttcaatatttttccataacatttatcaatttttaacgcatatatcgtatatatgatatagatagatagtgcatgtctgtgcttctcccagctctcccactagaatgtaagttccgtgaggacagtgatttttgattcaataaggtgtacctcaaatgcccagaacagtgactagtatgtagtgtgcattcaataaatatctcttgaatgattggttcatgactgacaaaggagttgaaacccagtttgaaaaatgcttgtctgatagctagactcaatccttaattttttatttgagg

SEQ ID NO: 229357 - DNA, 488 bp, Homo sapiens
gggctcggccagcgtagtcattgcccatggaatctcaaacactgggttgcttttcaccgaggccacgcgccagcactcctgaagcctcctctcctccagcggatcgtggcccgcggcttctcgccctcgcttgcacgctttgcccaagaactcttcccggggcagagaagttgtggaaacaagcggctggcccgacggcggagaaagcgggctgcggggctgcaggtcagcgtgatggaagagaggaatgcgcacggcgggtggaataaacgcgcatgggtgtgaggacggagctacccgaggggctgaacgcgcggagcatcggagtgagggagcgacccctaaggacgccttctaagggctcacaggcccaaacacagcggggcagccttgatcggcgccccagccagaaaggcggggacagagccctcactccctctcctccccaaaagaaaataatgcaacgagacggaagacttctcgcccgg

SEQ ID NO: 229358 - DNA, 443 bp, Homo sapiens
agcgtaaaaaataccaaactaacaaaccaaccttcttgatgataaataactcatttacaatgtgatttagatctttcccttcatattgtgttgagtcagtttttactgcttggggtacctaagactttaactatttaactactatgcacatcccagtgaaagtagactgttggtgttatattcacttctacagtggggagaaatgtatgttagcatatttttattgcaatactggtattttgagtacataaaataaatatatatatataatggagtgtgtatatatgtgagagagtgtgtgacagggtcttgctttttcacccaggctgaggtaggaggatcacttgagcctggaaggtcttggccacagtgaactgtgattgtgccactgcagtccagcatgggcaacaagagtgagaccctgtctcaaaacaaataaataa

SEQ ID NO: 229359 - DNA, 513 bp, Homo sapiens
tccccagcagagcgtgacaaggatcggaggctggggtggtggaggcgcttgtaggtggggtccaaaccgtcctgcctgtcccattctgtcttgttctttactacccgggtctccccggcgggggatgggtggtctatcccagcccagcggtcctcagagcgacctcgagtgccttcttcccccgtgagtgaggcttctgccctcacccggtctgggccatctcctaccccgcctgtgccctccgaccctctgccctgcgccgctcggtgtcccagcctttcaattcggcaaacatacgttgcgcgcccactgagtgccagcgctgagccagcctcaccccgccgcctctcccccccgccacccgccccttcccggccggcccggcctgtcggctccgtgacagcagccgccgaagccccggccccgcgggagcggccagagaggagccgccgcatggctggctccgacactggcctccccggcggctccaggggcaacgaagggtggcggccg

SEQ ID NO: 229360 - DNA, 798 bp, Homo sapiens
tgatgttatacacagttattccatctaaactctggaaagtggagttgggggaagggacattaagaataattctcaattatttattggcaaataagccaacaattccagagtctgaaaactgcttgatctcttttttaagcaacaagcaatatgatctctgtgagcccatcattactgttcatttcttacaggagaggaatgacacacttccgcctttaattgccaaattatccccaattctgaattagtggaatataatttaatatgattttattatgattaatcctgagtcattctctcccaggtaatgctgggctaggataaaaagaaatctgaattacattaaaataatttaattattccaagagaaaaggtgacagaatgttttaagtgggtgcgtaattcagagagcctagatgcagataagctgaataaagcatttaattcagcacattcatattttaacttgatcatcttgaacagttcaggcatcacaggttactagaatacacatttgctgtgtagctgggacagttacatttccaacagggagaagggggaggctaatgaatgtacaaatgctagcaacaactgtctcccgtcctctgcaagggtaagctaacttcccgtgtaatttaccacaaatgatatggtcacggcgctcactgtgccctcaagtgagagaagactgttctgaacaccagtaccaaccacagagactgacacctagtaggttctcaaagatcgatcaagtccataaagccatgaataaatattatatttctccacttgcctaga

SEQ ID NO: 229361 - DNA, 417 bp, Homo sapiens
ctccaaattatccattgtctttgtagttagagacagaagtgcccttctggtttttttagcttttaaaatgtgtgacctttgattctgtgagcatctgcaaacctagagtaaaagatgggaatgcagtttgtgcaactgggaagtaattctgaaacttgatatgagaaaaaaattgtccttagaggtgatcctggtttgcagtatgcgttgggtgaggtctatcctgggggcgagaagttagactcaaagattatctttgggtttggagggaagaaaggcaagcatgaatgttttgtctcggtgtggtgggctcacacctcaaagtggccagcactttgagaggccaaggcaagaggatcacctgaacccaggagttcaagactagcctgggcaacatggtgaaaccccatctctacc

SEQ ID NO: 229362 - DNA, 481 bp, Homo sapiens
aaatttccttaataaggagtttttattaataccagttcttcacatagtcctccaaaaaatagaagaggagggaatacttcccagcttcttctgtgaagctagtattatcctgataaccagtaccaaagacatgacaagaaaactacaagccagtatcctttatgaatacagatatgaaaacccttaacaaagtactaacaaaccaaatccagcaacatatacaaaggattatataacatgaccaagtgaaattgattccaggaatgattgatttaacatctgaaaataaatcagtgttaagataccatatcaatagaacaaaggaggccaggcgcccggtggctcatgcctgtaatccctgcatttgggaggctgaggcacaggaatcgcttgaacccgggaggtggaggttgtagggagctgagatggcgccactgcactccagcctgggcaacagagactgcatctcaaaaaaaaaaaa

SEQ ID NO: 229363 - DNA, 650 bp, Homo sapiens
gtgagtagaaatttgtataaagaaaaagacgtcttcactgattgcaagtggttcactatttcttgaagacaaagtttggtagtagtggggaagaagggttgaaaggaagtaggcaatgacaggatgacatttttgtctatttgtctactgttatatttctgacacctagaacagtgattggcacatactagatattcagtaaatacttgatgaatgaacagaatgaatgaatgaagaataaacggggccaaaccatgaaggccctgatgtgccttgtaaatacgtttatccattgaagaatatttaacaagaggtgacatcagacttgttttttggaaaaattagtctgccagaagtctggtggttagaaagagtgggctcaggcaaggaaaccagattgagaaagctgttgtaacaatctaagcaagagaacttaaaggcctgacttaagatattaatattggcattgacaatagtgctggaaatgagagaatttaagagatatttggaagataaaatatacagtactaaatggttgcttgtctatggagagagagagaaagagaaagagaaagagagatgactcccatgtttctggcttgagcacataagtgaagagctattctattattaataactaattaaagagt

SEQ ID NO: 229364 - DNA, 619 bp, Homo sapiens
gagatttgggtacatccatcatctgagcagtatacatcgtactcaatttgtagtcttttttctgtcaccctcctcccactgtttcccccaatcccccaaagtccattgtatcattcttatgcctttgcatcctcatagcttaggtcccactatgaatgagaaaatacaatgtttggtttcctgttcctgagttacttcacttggaataacggtctccaatttcatctaggttgctgtgaataccattagttcattccctttatggctgaatagtattccatgatatatatatataccacagtttctttatccactcattgattgatgggcatttgggctgattccatatcttttcatgagaattataaaggtttgaaagtggaataactcttagggcataatggatataaattgtatattgataaatgacgtgacgtgaagccaggatgagtaagtactactaagtcatgaaattgtgtcattaaaaagatactatgtcattatataagaaagtttttactttattacatttttatcatggtcaaatagcaaattataatttatgtgaggtgaaagaaaatgaaaaagggttttcactagaaacaattttttttttact

SEQ ID NO: 229365 - DNA, 504 bp, Homo sapiens
catttattgaacaggtcagtactgaataaatgtttggaaataaatgttgagtctagttgagttgaattctcttgtgcctaggagcaaacatgccaaacgcccatcactggacagtgggaaggtggaggctgtttgagtgtggcaggggtgtgttggaagaatgtggagctgactgtgaggggccctggactttgtgaatgcactgatgtgtcctaggagtcagagtccatttgtgggatagatgtaaactggtctttgtatactgacgcagaaatgcccatcaaatctgtgatcagagaccattctatgtgctcctgagtcataacacaagtcagaaatccaggaacattttggaagtgcataaaggtacagaagttgttccaggctctgggaaatctcttgtttacagcaagcagataagagctgtggttttcctcctaattgttctgtgaactgtcatccagtaatgtgtaactttgtcaaattaaagaattggaagcagga

SEQ ID NO: 229366 - DNA, 496 bp, Homo sapiens
ctgatatttaatagtaagattttaaacccagagcaagaccctgtcttaataaatggtaagatcttagaactggagcagacctaaaagtttctatggcccagtcacctaaagcaactggggagtgtagcggttaggtgtgacttcccttattctcaggagctagttagtgccagtcccagaaaaaaagaatatgggcttttccagaaacctttggagagaagtggccccacatctgccagtgctcttgacctttagctcagtcctgcctgtcatccctgccgtgcatttcttaactgccttgcagagaccttaagcccacccatatttacctctgtcttcattatcccttggagtaggaaagctactcttggtggtggtggtggttttaatccagattggtgtattctggaggtacaagaagcctacctgtgcacccctggtgcggtggcaggtcacttcccttgctgtggggcaaggcttgtctgctccatcccac

SEQ ID NO: 229367 - DNA, 449 bp, Homo sapiens
gatatcatagcatttattaagagggtcctgtgaggtaggagagtattagccccattttacggatgaacacactgaggctcaaaaatgtggcttgcataaggcctctgggtgggggaagggccacattcccccttttctcagcttatggcatttaattaatagtggccactttttttctgagtatggattcttgacacctcaggaaatactgaagctaaaaaatagagtatattatgctgacacatattctttctcaaaacactcttgatttgttaaccattcctaatgagagcagccactaaagaacggaagtctgcattgctgttattaccacgcatttaataatttgctgttggtgaatggatagcagctgtgatacatccagtttctaccagaatcatatgtgcatataataaatgtatatggtatgcctgttcatgtaacactta

SEQ ID NO: 229368 - DNA, 351 bp, Homo sapiens
tgatgttgtattggggtgtgcgtggcaggatccaaagctccttatagtggattttcctaaaaatctccactaaaatctttcaagtccaacccttataaagccttctgtgaattctcatcccctaaagcagagttgatcattccttcctacctcccacaatgtcctttgaatatatttccattaaattatgcaattatctcattacaatacttttattttttgaatttatgacctgtgagcttttggaggtcagaagtttctgctgttctgtgcgctgctgaatccccattgcctaagcgctgtccccagcatgtggcaaacacagattaatgcttgttgaagaaagaccag

SEQ ID NO: 229369 - DNA, 436 bp, Homo sapiens
attttttcaaatctcagttttattctcattccagcatcctaatgctttccctttggatttttttttctaatcttgagaagtttgtgttttcagtgtagtaataacaataatagtgttcttagcacacgcgttacgccaagggcttttaaaagatacttttcataaaccaactcacttaattctcacaacaacttttgaagtagtccactttctaatcctcattttacagataaggaaactgaggcacacaaggtcagctaacctgcccgaggtctctagctagtgactggaagaggtgttctctggatattatttgaatctcagtctcgctatatttcttcgtcatgactgtaactttccccctgtatttctaaatattttaatctcttgatcatatagcatacgttgatttaataaatcacttttacatgcatta

SEQ ID NO: 229370 - DNA, 461 bp, Homo sapiens
gtcccatcccccaactccaatcattctgaccttggcctgccaaggctgtgagggccgggccttccgaggatacccgccctgggaagcacgggctgagggggtgaggacgcactaggggtatggcgaagggctccaatgccccaggctgcggactcccttagtccttgcagttgcttccgtgtgccccgccctgagtccccatccctccttgccctgccccctgctccatccctcccctgcgccccgccccctgtccccatccctcccctgcgccccgccccctgtccccatccctcccctgcgcctgagtcctccccagggcaggggtaaaagacctggccacaagaaccggagcggtggtgacgccaggtcagcaagtgaaagctctccaattccgtcccgcccgcgggccgcgtgactggcagcggccaatcggaggcaaaagcgggttgttccaaaaa

SEQ ID NO: 229371 - DNA, 204 bp, Homo sapiens
agtggtaggaacattggcagcagaaggccgtatgggataccatggtctacgtttccttacaaggtcccagcttagtgccacagtcatttaaaaatcacttggggaaaacatctgtctccctgagtgtttccaaaactgctttctggaaccattttagattacattgccactgccagcagcctaagactcagggttgctatggca

SEQ ID NO: 229372 - DNA, 358 bp, Homo sapiens
gtgtgtcttcctggggctgatcctagtgttagaatcaaggatacaggaacgttctcagcccccttagccatgactccacctgctgtcctcccagtgtcctatattcctcaggctcagagccccaggccccagcacctcacctttctttgttgaagtccccaaggcctgaccattcacctggggactctgctctctctgttcctgctcatcacatctgggctgtcaacctgtggccgtgttacccaatctgagcctcaggtttgtctcttgtgcaaacttaggacagggaatagaataggctcatgatggacaggcggaggtgagatggggtgagagaaacgcaagagccaaaaggagg

SEQ ID NO: 229373 - DNA, 879 bp, Homo sapiens
aggcattttactaaccaatactcattaagcatagcgtggattcatatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgttcgaagtatggcaaaatggaactttaaaacagtatcttgtcaacaaccaagaggacctgtttcacataaagcccacgcattcatctgcctgtccatcattctgtctgtccacacgggcatcattcgttagtggaactgagtgcccgctgtcgagctgacaagcccataacctccctgttcctagtcacacattaattcttcaacaagtccct

SEQ ID NO: 229374 - DNA, 391 bp, Homo sapiens
cacacacacacacacacacacacacacaaatttgctgggcgtggtggtatgtgcctgtagtccaaactacttgggaggctgaggcatgagaatcacttgaacctgggaggcagaagttgcagtgagcagagatcacagcactgcagcactgcacttcagcctgggtgacagagtgagactctgtcttaaaaaaaaaaaaaaaaattcccctaaaaactaagagtacaataagattgtaacacaaaggataaatgcttcaggtgatagatatcccatttctcctgatataagcattgcctgcctgtatcaaaatctcatgtaacccataaatatacatacctactatgtacccaaaaaattaaaaataaagattaataaataaataaaaaca

SEQ ID NO: 229375 - DNA, 476 bp, Homo sapiens
caaaaatctgttaatattcatttttaaaacactttggctttaaaagaacttaaaatgctacataagtcatccaatgtaccccaagtctttgaagtcaaatacttcaaagctaaatttgttaaatgggaacacacaaagacatagattggtgataatccagcttgggagaaaggacccaagatctcgctgtcctggtggtgaatccaggtttcataggctcatgtggaggatgtatgttgtggatccatgccattgtaaatgtatgtaattaagttcttttcctaaaccaaatgtgtttatatgaatattatatattattttcatttgttggcataacttagagctctgcaatttctacaaaatatgtcaaataaattttagtgatacaaaaaaataaaattgtacatggttgtatggccaacatgtaaatttcaacctgtgcacctaaagtaaataaaataaagtttttaagtttt

SEQ ID NO: 229376 - DNA, 446 bp, Homo sapiens
ttatacattcaacaagtatatttaagatggtctacttatatatactaatcaagatttgtagtctgtacaaccagaattttaagttcagctcagctcctaggaaaatacatgtatagaacaaatatgcttatgaaagacctctagagagccagaacactcaaatcaggaaaacaagccaaatcagtaaagtcaaggacttgcaggtagatagataaatatgtagggagagaaaaagagaaacagagagagagagagagacataaatttaagcaattaaatacaatggcacagtttattccataatatggaatttattattcattaatagcaatcatttacaaatcatacaaagcatcagtaatttggaatctagttgtcactaaggaagacaggaactcaagaaaactcagataaaaaaaaaaccctcaaaatatgtgttgtgaact

SEQ ID NO: 229377 - DNA, 320 bp, Homo sapiens
cagtagcccctgtgtccctgtcgtcccgcgagggattggaggccctggctccgggcggtcccgaggtcccgccgccctcctcccctgcgcagaggacgtggctccccgctatccgtgcggctcgtggtgtcctagtgaaatgagggcgcactggcgcccgacgtgccttggcgacacgggcggcgccgcgccccgcttcgtgcgtcccgtccccgccgtgccctcagctgggcctcgtggctgggccgccctctgtatttgtatttggattcctacgtttgtacttctaatacaaataaatgcacatgttgtcagaaata

SEQ ID NO: 229378 - DNA, 700 bp, Homo sapiens
aatgtaccaactcaaatgaaaacgtgcctactacatggcatggaagaaacaggcttcttgtcttatctcgcacagtctgcccacgcaaaccatctgtccagccaaaccaaaatagcactgtgcttccagcctctgcaccctggctcctgccttgtcgctggcttgaaccaccctcccccaactctctgcttaatgaaacttaatcatcctttaatccgaagctcaactgtcctgtcttctatattgccttcctgattattacagcaggaagtaatttctcttgctcgaaatgcagttaattaaaaaaatgggcgactttggtgccatcatactctgccttggattgtagtgttttgttggtgaattttatctccccaagtaagctgtgggcctgaagaaggcagcaactgtatttcacacatcttagtattcctcacagtcttgcgtatgatgtaagctaaatatttattgaatgagtcaatgaaagtgattttcagtgttgagagctgaattcagaaccccacaatctgatctccatgtttcttctaccaagtcattctgaaagcaatgcagtttctactatgatttgcctctttgtaagccaatcacggttgaaaataggctgtttcatatggtgcagtctaacccaatgcatatggaactgtttggacagaataaaatagtttaaatggctgagctt

SEQ ID NO: 229379 - DNA, 403 bp, Homo sapiens
gtgagccactgcacccggccagattaccattttaattcatgtctttcactgggagaaagtcatacttcggtgttttaattgttctataaaataaaaattaaaagtggtttgggcacctgaggaaggggtacagatgcgtgtgtgtgtgtgtgtgtgtgtgtgtgtgcgcgcgcgcacacctggggacacacgtgcacacagtgtaagaaaagcagatgcagagttgagttctcacgtcctactccaacacagagtagcccctgatacaggccacccatcatccagttgatgacatggtgagtgaccaagatgggtgcatctgaggctctttagatgtgagcttgttggacatacacagtggctcctgaatgaccgtcacctagactggtagagagaggccgtg

SEQ ID NO: 229380 - DNA, 319 bp, Homo sapiens
cagcttgaagtgactgagacaaatgtcctcacttgaggatgaggcatcagcattatcatggaaggactaccaatgatcatggtgactttttttcttctttatttctttaaactgacaaaaattgtatatatggtgtacaaggtactgttttgaaatatgtattgtgttgggaatatggattggggaatggctaaatcaagctaattaacatagacattacctcacatatttatttgtggtgagaacacctaaaatctactctcttagcaattttcatgtactacattgctgtgaattatagtcattgtgttgtacatta

SEQ ID NO: 229381 - DNA, 442 bp, Homo sapiens
gtgaggaacccaagtcatctggaggagtaacatgtaggcaccaggtcaactgtcccagctgagcccagcctgcaagtcatcatagcccaagtgccagacacgagcgaaaaagcctctgggtgttccagcccacagccattcgaatcttccccactgaggcctcagacatcatggaactgagacaagccatcccctttggtgcccatctaaattcctgagacagtgaatccgagagcataatggatggtagtggttttatgcaacgggtttgggatgtttattccatagcaacagataactggaagagcctcagaacagcaatcaaagatgtctgaccgtgaagcatctggaatacaagaagatgaaactgaggaacgctttgcatcagtaaagtagcaaagtcatgatttttcccaatacagaagctcttggaacactcgcg

SEQ ID NO: 229382 - DNA, 380 bp, Homo sapiens
ggctagtgctgcacattccggccagcccctcctcaagaccccattcccaagccccttctcagctccctcgggccggcagagcgggcttttgtcaagtaaaatgctgttgaaggcccacgggcatgactgcacccctcactaattggtcattggtttggggaggacaccactgtcccagtggaaccttgagcacaccttggagccctcctgttcctctccggacctgtgccaaactgtgagtggcacagagcaaggactgtatgtgttctcttctttgttgcatactcagttccttgaccacagtgccaagcacacagcgagcactccctgtgtatctgctgagtaaataaacgaatgaacaaacccaacacaaaaaaaaa

SEQ ID NO: 229383 - DNA, 419 bp, Homo sapiens
gggatgccaccaccctctctagcgacgctctcctgtgtcaccgtaaccagaggtgtcgactgagtgccgggagccaaacaaaggagcatctgtccctctcggcatgaggattcctggcaccgaggattaattgccaagttaccaggcttgccatcatgaagaggcatcttattctcggcagggaatattgtgttcttccctctccttgctgtgagaatgtggtcccgggatgatcatacgtgtggcatcatcagagagaacaccatggccaggcatcctcggactgcggggagtttcccagcattcaagactgaaatgcagccatccgcagacacccagcagcccacaccaccaggccccaaccacagaggtcagcgccacgcagggcccagcggaccgatggtcccattctcagctca

SEQ ID NO: 229384 - DNA, 610 bp, Homo sapiens
agaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatctta

SEQ ID NO: 229385 - DNA, 364 bp, Homo sapiens
tggcgatggtaatagtgagtgacccttgacattcttttctcaaaatgaaagtctacttttttcccagggttggctctagggagagtataccaatgacattcaaaatatttttaaaaaataattcaaagaaaaagagtcaaaatatggtggagagaatgtgaagggaaaggagtggaaaacattttctttataaacaagaaagaagaaagaacgtataaccaatttaggtttggtgtacttggaagtcaacaagtaaaaaatgtaattcattgccagctctcttgaacattttaatactgataactttaaactttccaggcactgaggtttagaaaacataacagtggcattagatacagctatg

SEQ ID NO: 229386 - DNA, 375 bp, Homo sapiens
gagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaatcagttgctcttatctggcagacagactcctgattatccatcaaatcttgaatcctgttctcctctgggaagccctccctgacttcccaagttgacttaagcactctctttttcccccactgtgtcttgcgc

SEQ ID NO: 229387 - DNA, 461 bp, Homo sapiens
aagcacattttcttgttctctgccgtaaaaatataaattcatgcagcttttctgtaggtaacatacaactcaattttaagctgacttaaatagaaaggacatattggctcactttggatttcaggatttgactcagtggctccatagtgtaattaagtgcctaggttttttccatctctttgctctacagtgcacagtgctagcttgttccagggcctagtttccctggtagtatagggaactgccgacagtaattgggttatttgcttcctcagtcataactgctggcagaaataatacctcctcctaaacaatctaataagaattcttggccgggcacggtggctcacacttgtaatcctagcactttgggaggctgaagcaggaggatcacttgcgctcaggagtttgagaccagcctgggcaacatggtgaaagaaaccccatctctacaaaaaata

SEQ ID NO: 229388 - DNA, 450 bp, Homo sapiens
gtacatgaaattaaattcaacatttacattaaatgccttcaaatatggtaaaatggtttcttttggcagtttacctcattatgttttgaatgatttgtctatcatatgaaataacttttataaatatagtaactcaggcctgggcacagcggctcaagtgggaggactgcttaagcaaccgagtttgagaccagcgtggacaacatggggagaccccttctctcccaaaaaatagctgagcatggcagcgcactgctaaaggaaacagagtttctttggtgggtgattaaaatgttctggagttagatagtagtgatggttgcacaaccttgtgaatatattaaggtttccgctctatctaccattcaattgtactctctaaaacgattaattctatagtatatcaattatatctctaaataataaaaacaaaaagaaatggctgggtgc

SEQ ID NO: 229389 - DNA, 212 bp, Homo sapiens
gaggagtgaagactcaaatctaagcaattttactccagtgtccgccacaaatataactctgcatcataatcgaggccatcagtatctctctcaattcagttcgattctgcaagttcaatccttagcttcttcaagcacagggaaagagagggcttttggagaagaaattacctcaggaatcagcccttctgtcgtcttttcgcagcggaata

SEQ ID NO: 229390 - DNA, 320 bp, Homo sapiens
atccagtctgtggctcaatagaaactgtgaagaatcatcttctagaataggcgacttgattagctaatttctaaattatctgacagttgatttcctgcattatcttcactctattcattttttaaaataaagtcataaagaacacagcttataatcattactgcttggggtagagcaataagattttatgttcccacatagtttttgaggcactgactataaagaccaaaaccaaggtcaactgacatcccaaaggccagttacagctaggaagtctttctagagctctaggaggaaaggtgaaaggaagggaaagaaca

SEQ ID NO: 229391 - DNA, 285 bp, Homo sapiens
agggtctgcatttgtgcactctggcttttgtgcacgtgtgtgtgtgtgtgtgtgtgtgtgtgtgcacgtgcatgtatgtataaggccacgtgtccatcttcagcatgtgtgttcatgtctatgtgggctcattgggtctctctgcaaggcgctgggtggaaggggagtgtgaggaagccattagcatgatggtagcctccaaggactcgaaacctggagtcacagcaggaagaagagccctgctgggctcacaaccaattggagctggggcctgggagccctggc

SEQ ID NO: 229392 - DNA, 507 bp, Homo sapiens
gatcctttgggaagacaccgggcactgtctcagcccttccttccagttgttggtggctttcgtgcaggctaaggctttggctcccttagcctgggtcccctatagccttttcactggcttctccaatggtttcgacataaccatcagctagaaatctgggtagcaacagctgttttgggaagctgaggtgtcctttcccctggcccagcccactccctcccatttttttccccagctttattgaggtgtgattaacaaagtagtatgtatttaaggtgtacaaaattttttttttttttttggagacagagtcttgccctgtcactcaggctggagtgcagtggcacgatctcagctcactgcagcctctgcctcctgggctcaagcgatcttctgcctcagccttccgagtagctgggaccacaggcacacgccaccacgcccagctaacttttgtatttttggtggagatggggttttgccattttggccaggctggtcttgaac

SEQ ID NO: 229393 - DNA, 373 bp, Homo sapiens
gataattagagagatgagtaaagaataaaatgtcatatatgcctgaaaacaaagtaagttttgttttctctcctaaaattacccatcagaaaagagagtgctgccttatattgaaatcactaacacaagatgatttctcagttactttatttggacttacttggagaagatatactggcctgaaataaccattgtatttcggatgtaaattcaggctaccaggtagaattaaaatttggtcaaataagatgaggcctgagaattgatccttaaatttttagcattgtctaggtcattggtgatcttgaaagagcaatttacatggagtaattaggaagaaagacttctgggaataggttcagtaaagaacagg

SEQ ID NO: 229394 - DNA, 769 bp, Homo sapiens
actctccccctgctgtcaatggccaggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccgcggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctgactggaccacacaaccagccatcttcgagggatcctctagaacgaccgcagcatcagcagcg

SEQ ID NO: 229395 - DNA, 591 bp, Homo sapiens
actctccccctgctgtcaatggccaggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccgcggctggtgctggaccagcttcgctgcaacggggtcctgggaaacggggcgcggccggaaaggcggccgc

SEQ ID NO: 229396 - DNA, 233 bp, Homo sapiens
acataaatttctatttttctgaaactataaatactccaaagaattcttttagacagaactattttcctcttcttggaactacctttgcaaagattagaacactagccgcagctactcaggagactgaacaggagaaccgggagcttgaaccgggaaccagaggttgcagtgagccgagatcgcaccactggactccagcctggtgacagagtgagtctccatctccaaagaaa

SEQ ID NO: 229397 - DNA, 297 bp, Homo sapiens
tcgggaggccgaggcaggagaatggcatgaacctgggaggcggagcttgcaatgagtcaagatcacaccgctgatctctagcctgggtgacagagcgagagtccgtctcaaaaaaaaaaaaaaaaaaaaaaataccaagtgccaggaagaatgaagggagagggtggctcttccctgagtcacctgtcatctttgctgatggatcccacattctcattcagatcagcaaatctttaccaagtgctggcctcacccccttctgccaccctggcctggctggccacatcttcggaggtg

SEQ ID NO: 229398 - DNA, 489 bp, Homo sapiens
agaagcatctagagaaatttgaattaaagaagattctgtgaaatttgcctaagtacagaatgcacatctattttgaattttcttttatttaagacaagtggcagataatttcacagctgtcagttaatgcacataatgaatgccttatcaaaggatgaaagcatgaagttgtattcatgttccccaagtatgtaaaataaattcaaaaggatgtcaagatcttgtatgaaataaaaaatgcaggaacactttggtttagcaatgtgttggggagaggtgggattgaacattcacccttgtctctctataaattaaatcaataggagagtaggcaatgcagtaactgctttatcactcagatttttgcatcagtttctcaggacttttttatatggcatgtctgtttgacatggtggggggcaactttaataaattgctttggaacactttatcttttaaatttactactaaattctatcaatctttagc

SEQ ID NO: 229399 - DNA, 268 bp, Homo sapiens
acaaaagacatcctggaacttaaatgattgaaccaagaaaatcagtaaaagaattaaagacaagcatgatttaactgtggtgaacacaattagtggcctgggaggtcgagcataggaaatatctcaaaacacaaaacaaaaagaaaaaaatatggaaatcacaaaggaaaacacagactaacaggacagactcaagataatgtaaatggagaaaagggaacaaatggagaaaagacaatagtaagaattattgccaatactagggaaa

SEQ ID NO: 229400 - DNA, 705 bp, Homo sapiens
ccaggtttgccgaccttacgggcccttctccgccagccctggctgggtcacccccacgacccgggactcccccgccgttccctcccgggctgcctgcagtgaggtccgctcctgaggcctcagcctcgccgggggtagggccctctcccgccgtcgccgcagctcctttccgtcccggggcctggggggcaccgtcccacgggtgaggtctcaggtgatccgcccacctcggcctcccaaagtgctggaattacaggcatgaaccacggtgcccggctgacacaaggaactttctatgaggtcctaggaatgaaggaaaacaggcaataaggcaagaatcgctgtcgaaggagtctgcgccacctgctcgcacagctcacttgtgccttctgagcctgctggagcccagtgtacatatgccgtctccgcgtgattagagattgctgctgcacgtgcccaatcccgtggcggggctggaacacaaacggggtggtgttccagctgcaaccatgcagatgaagactataccctaggagatggaggaacaacagacaagaaagaaacctgggttcctgaataaccacgtggagccaagcagcttacttatctcaagccactgttgcccacctccagattgaactgtctgcaaacaaatctttacttgatgagaagtttaaatataattaaatctagaatattacatga

SEQ ID NO: 229401 - DNA, 828 bp, Homo sapiens
ccaggtttgccgaccttacgggcccttctccgccagccctggctgggtcacccccacgacccgggactcccccgccgttccctcccgggctgcctgcagtgaggtccgctcctgaggcctcagcctcgccgggggtagggccctctcccgccgtcgccgcagctcctttccgtcccggggcctggggggcaccgtcccacgggtgagggccgcctccagcgcctggcccagccatgcgaacgcctggagcccgcgagctgcagctgcggccctgaaggtgccgcatatcctgccgagtgggtgaagcgtggcactttggaaaacaaatcggtctcaggtgatccgcccacctcggcctcccaaagtgctggaattacaggcatgaaccacggtgcccggctgacacaaggaactttctatgaggtcctaggaatgaaggaaaacaggcaataaggcaagaatcgctgtcgaaggagtctgcgccacctgctcgcacagctcacttgtgccttctgagcctgctggagcccagtgtacatatgccgtctccgcgtgattagagattgctgctgcacgtgcccaatcccgtggcggggctggaacacaaacggggtggtgttccagctgcaaccatgcagatgaagactataccctaggagatggaggaacaacagacaagaaagaaacctgggttcctgaataaccacgtggagccaagcagcttacttatctcaagccactgttgcccacctccagattgaactgtctgcaaacaaatctttacttgatgagaagtttaaatataattaaatctagaatattacatga

SEQ ID NO: 229402 - DNA, 948 bp, Homo sapiens
gcttacaatatacaaaaaacatatttttctctctttcaatcctcccttgcatattttcccccttttaatccacataacaatcctaccaggtattttcatcttgcagatgaaaaaactgaagctcacagaggttaagtaatttgcctaaggtagcacagccaggaagtgggggagtcagaattcaaaaccaggtttgtctatacaaacaaactacgttagggataacgtatctagtgcctgaatctgttttaaatcagatggttctatatttcagcaattattcttcctcccatgaactcatcaaacggctgctgactaaattttattaactatttgttacgcacctattattttcaataaaggcttcagctgtgtagaaataaaacaggcaaactgactttattctaaaatttgacatacagagaattcccaggcatctctgccatccaacactgatgatcataactagattcaactacctattcagacctctagttgtttccacattatcattcatttgtccactcatgagataaacgaagctactttcaccaaaaaccctccctcatgactcctgatagataatacagcagaggaggcctcactgtaaagcaatttacataaaagttataaaagctctttgttatctgtcatgactaggaaatgggctattctagcaaatcaaacatcctggatagcataacgattctattagagggactaccaatttataaggaatttcaatgtgcataatttcactctaaaaattaaaaaaagaaaagcgggtcaggcacggtggctcacacctgtaatcccaacactttgggaggccaaggtaggcagatcacttgagcccaggaggtcgaggctgcagtgaactatgattgtgccactgcgctctaccctgggcaacaaagcaagaccctttctcaaagacaaagggaaaca

SEQ ID NO: 229403 - DNA, 1489 bp, Homo sapiens
aacactacaaaattttcaagcacagcctatcggccatagatagtatcaactagaggcaatgtctttagtttttattatttttgaacctggagcattttctgttggacgttacaggatcttactgctttaaatcatacattattaaaaaaaatgagggtttattctttgaattacccttttgtatgcaggagtgaagactgcttttttagttgaccattcaaaatcgttgaattttagtttttgcagactactaaaatttgcagtgactttttttttgtaaggggggtaaatgaaacatttagcagcctttgaaatcagcaagttgcttagatagtactttagattttgaaactgaatataacagtgttagaaaagtatgtgtaaggaattgtatttacatgcatactagtagtacaatacttatagctgaatttggttggcaaaagtatgttttcattttattacgactgctagtcaggtaagatatggtgggattctttctgtagtgttttcagtgtctgggcaaggggaggagctcgcctgtgttatatgaggggttaataccaataggataggaacagtttttagactgttaattgtgaattttacatttgggtcatcactgttgtgtagatttgttcacctattaaaataatgaaaaccctcatttgagtgtgtgtgtgtggtggatcataggaattgatttgtggagtgatactttcaatagtcactgaagacagaagtttggtatttggtatagtctacaacaaatgcttagtatgtccaggtattttttttttttaagttaaaccaatgttaagctattactggtaaataatttgtaattttagtgcttcgttataggggatgtgaatagttttaatgtcttgttttttcataagcagattaacatgtaaaaatgtaaaattatattaggctttgttatttttaaatacatttatggattggtacgccttctgttcacctcatttcagcttcgctgagagttggtagatttttttatgaactgtatccctctagttccaaagtgccaaaacaaattgactgtatcttaaaaaactactgcataagtaaaattaaaaagcagattgcttctcctgatcttttttgtatttcaaatggaacaaaacttttcttgtaactgtaatttgtaaagtttagatatcagtttacagatgggggaggggagaaggaaggaaatatgggtgaataatatgtgtatgtacatacatatgtgagtctgaggcccaaggatagaatactgtctccaaccttagccagctgtggccatatacttgtagggaagtttccatgcttcttcagctgcttttctgaattaccaaatcactcctgacaacacatattctgccacatgaagacgaactagaatcaatctgataaatctgagatttatcaatcaaatacatcataatttgccaatcatagtaaaatgaaaatagttttgcct

SEQ ID NO: 229404 - DNA, 1136 bp, Homo sapiens
aacactacaaaattttcaagcacagcctatcggccatagatagtatcaactagaggcaatgtctttagtttttattatttttgaacctggagcattttctgttggacgttacaggatcttactgctttaaatcatacattattaaaaaaaatgagggtttattctttgaattacccttttgtatgcaggagtgaagactgcttttttagttgaccattcaaaatcgttgaattttagtttttgcagactactaaaatttgcagtgactttttttttgtaaggggggtaaatgaaacatttagcagcctttgaaatcagcaagttgcttagatagtactttagattttgaaactgaatataacagtgttagaaaagtatgtgtaaggaattgtatttacatgcatactagtagtacaatacttatagctgaatttggttggcaaaagtatgttttcattttattacgactgctagtcaggtaagatatggtgggattctttctgtagtgttttcagtgtctgggcaaggggaggagctcgcctgtgttatatgaggggttaataccaataggataggaacagtttttagactgttaattgtgaattttacatttgggtcatcactgttgtgtagatttgttcacctattaaaataatgaaaaccctcatttgagtgtgtgtgtgtggtggatcataggaattgatttgtggagtgatactttcaatagtcactgaagacagaagtttggtatttggtatagtctacaacaaatgcttagtatgtccaggtattttttttttttaagttaaaccaatgttaagctattactggtaaataatttgtaattttagtgcttcgttataggggatgtgaatagttttaatgtcttgttttttcataagcagattaacatgtaaaaatgtaaaattatattaggctttgttatttttaaatacatttatggattggtacgccttctgttcacctcatttcagcttcgctgagagttggtagatttttttatgaactgtatccctctagttccaaagtgccaaaacaaattgactgtatcttaaaaaactactgcataagtaaaattaaaagtcgacgcggccgcgaatttagtagtagtaggc

SEQ ID NO: 229405 - DNA, 1047 bp, Homo sapiens
tgcgttaggtatgaaagaaaggtcaggaactagcatcccttatgaatgcctaacaatatgccaggttctacaatataccatgttcacataattctaacaatcaccctgtgaaaatatcatccctttataacggatgtatatcagctcaaaaagagtaagtgtatcggggcgtggttgcacacctgtagtcctagctactggggagggtgaagcaggagaatcctttgggctcaggagttcaaggttacattgagctatgattgtgccactgcattccaacctgggcaacagagcaagattcctgtctcttaaaaatatacccaaataggccgagcgcggtggctcagaaatcagagggcgctaggaaatagggcagaatacccacaaacacacactcctaaggaaacaagaggtatggtcctcagtaaaactgaatcagagtggctccaagatgaggggtatccctcacagaaaagagaagtgaaatgctggtatgaaaacagggagactaggtaaaaacttatgaaatgaatgacaagacttgtagctttcttcccccatgaagcgctagaaccctgtcatacaaactcattacctctgccaagcccttcactatggactgaatcatgcctccccaaaatccatatgttgaagccttaatgcccaatgtgactgtatctgaaaataaggcttttcggaggtaactaagattaaatgaggtcaaagggcacagtcccaatccaataaaattggtagctttataaagagaaaaggaagagatttttctttccattataggaaaagtcatgtgagcacacaggaagaaggcagtcacctacagaccaggaaaagagcccttaccagaacctggccatgatggcatgctgacctcaggcttccagccaccagaattataaaaaaattaatttctgttaagtcacccattctatggtattttattatagcagcccgagtgactaagacacccctcctctctccatcattccacccacaaagagacaggaaaattaaaggacatctatctga

SEQ ID NO: 229406 - DNA, 650 bp, Homo sapiens
cagcaccaggctgtggcaggttgggttttgctctgtgctgtgatttctgttggagttggaaagttggctgtgagtcggcccagatgtgaagcggaaacggggaggagggaggtgagtgggcctggctgggtggatggggatctgctcgcctgcacggtttcctctttggtaaagtggggcctgcactcgccccatctagacaggcatgtggggactgaggtgattgattcccagcgtggaggagcatctcgctcagtgccaggcggaccatggcctggaggtggccggcattttcccttctcctgaggggatttattgatcttgtgctgcaggtggtgtggcctgagggcaggtgtggcttgcagagctcatcactggggcaggtgcagggctctggggtgctgagctgtcactggcgaagggcctcaggtcccccccaacagctcccacctgctcagccacagcgtggatgcgtcccgggctccccggccccgggggataccataagcacagaggtggcctctttgaatcaggggcttcccagggagggtctgaggctgggctgcgggattactccttccttgggaagcaggcaggggtggccaggcacagtggctcacgccagtgatctcagccccttgagaggctaa

SEQ ID NO: 229407 - DNA, 351 bp, Homo sapiens
caaaccttgatgctgctgcaggaagcataggctatgacacccatagcacaatgtcagtcacctgtgcactcctcccagagcacgcagacctttctccccaagatatgtaagccctgggtctggagagttacagcttggagatctacctatcttgaggctgcccaaatcttgctctgttcaaaagttccccaactaataaccctttaccaacaaattggaattggctgcctcattctttggtttcccagctccttctgcatttggggtcgctttatgtatacggccctttcacagaacaccccttccctgtgatgcccccagacctcttgcctgcagcagcaccacacctac

SEQ ID NO: 229408 - DNA, 490 bp, Homo sapiens
attaaaataaaatagataaatgtaatgggataaatacttgtagaaaactggtcataatttcataatttagaatataaagttatattaaattaaataatatatatttcattatttgggtattttccaataaatatatattgtaggaaaatattcttgcaaaaaaaagtgtgactttttaaaaaaaaaaaggtgaaaaatttttgtctaattcgaagcttatttaaaggttatatataaaacaaggtaaaaggaaccatgaaataaaaagagatgtaaagttataaaaataaagaggtatttttgtgtgtgtgtggtaagaaagcttaaagagaaataattttatatgagaaagaatcttacatggtaaacttcagtcctaaaataaaatgactggttgtttaaaaaggaggcatattcaggacaaatcagaaagtccaaatattaagttctggtttgcttagggaaaaaaacctgagattaaaaaaaaaaa

SEQ ID NO: 229409 - DNA, 511 bp, Homo sapiens
acatgaagacatttgagaatctaagaaaactattgggctgtctcccaagaaaaatgcgtgtatgtgtactttcatagaactttggcatatgtgttcacataatccctaaaagtaacctctggcctacttattacagtttagaaagggggctaagaattgatgcttggaatttgaaattttactgaaacttttatttataccgtaatttcttttcataagttcaagaaaacctttttatagatattaacattacactcatttcaatatgaaggtgattaaaagactgtaagtgaatactatgcatactgttatgccaataaattagaaaaattaggtgaaagagtggattttctaggaaaatagaagttttgccatagttaagagtattaggttgaaccaaatgacgttgttgcctttgatggtcagaaatagttatatattgtcagtttcatatgattcagcttaattgaagcattaaaatggaagaactttatgtaactaaaaaaaaaaa

SEQ ID NO: 229410 - DNA, 463 bp, Homo sapiens
tcagtccataatagaataaaactagaaatccataccaagaggaactttggaaactatacaaaaacatggaagttaaacatgctcttgaataactattgggtcaatgaagaaattaagatggaaatttaaaaatttcttaaaacaatagaaatggaaacacaacataccaaaacatgtgggatacagcaagagctatggcaagagggaatcttacagtaataaatgcctacatcaaaaaagtggtagaaatattttaaataaaaaatttatcaatgcacctcaaggaactagaaaagcaaaaacaaaccaatccccaaagtagcagacagaaagaaataatgaagagcagagcagaccaaaatgaaacagacaaaaaacaatacaaagggtcaatgaaatgaaaagttgtttcttcaaaaagataaacaaaattgataacccactagcataattaaccaagaaa

SEQ ID NO: 229411 - DNA, 435 bp, Homo sapiens
ctgaatgggttgtagtggacaggcctaaactaagttaaggcagtgagaatctaagctctattctgcctagatgaataaattggcatgttattctaagtgccactggggaactggctttaggcagaagataacactgagagtggcagattagaacaactaaaactctcagtaaactatcgcaagaacaaaaaaccaaacaccgcatattctcactcataggtgggaattgaacaatgagatcacatggacacaggaaggggaatatcacactctggggactgttgtggggtggggggagaggggagggatagcattgggagatatacctaatgctagatgacgagttagtgggtgcagcgcaccagcacggcacatgtatacacatgtaactaacctgcacaatgtgcacatgtaccctaaaacttaaagtataaa

SEQ ID NO: 229412 - DNA, 477 bp, Homo sapiens
gtgtgtaacccaaacctctaacaagacactgaactttaccaccagcccagggggttcctttgtgtccctgccagtcaatctctgctcccacttcccttagaggaaacaactgttttgattttttttctgctgtagattagttcttgcctcttctaaaacttcatttaaatgaaaacatacagaatacattttgggggtgaggattcttttactcagcataatgtttttgaagttaattcatgtgtcgcatgcatcagtaatttgctccttttcctggcagagtaattttccattgtatgaatatactaaagtatgtttactcattctcttattgacggctacttggaatctccccattttttagctctcactaacaaagtttttatgaaccttcttgtgcaagtcttcttgcaaacatatgttttcaattctattgagtaaatatgtaagagaagaattgctgagtcataggatagg

SEQ ID NO: 229413 - DNA, 515 bp, Homo sapiens
aagggcactggtagtgactaggtaattcactggtaattcctggtagtgactaggcagatgaataccttccttgtccttctcgcctcacctcctccaagagaggacactgtatggtgtcaggactagcattttccatcacatccataggggaattacccagcaatggctctcagtgagtctctctgctagcactgtgccccacagcaaattccaaagtcatgtcccaggcaccaccccacccattcgcgatcgtggtgatcaagcctgctttcttgtctcatctcaggagagaatttaaattgctgaggctccagaggaaagggcagcaggcacattctttgggcagccctccatgaacctggattttttcagcagggcttttcactgacattgagtggcagtgcatttaggataaaactttcagaaacactttgagtgcagtttttcagggttgtcattcagtacagaaaaataacacgttttgcccatgtaccctagaacttaaagtataattt

SEQ ID NO: 229414 - DNA, 165 bp, Homo sapiens
taatgttagtttttttccccttctgttgtccttgctcctgttaggacttcctgcttctaatgtgactcctgctatacttggcaaaaaatttgtcatagtgtacatgaaagttacttgtttaatattcactcctcactctccctctatcccttctgtcgtcttctt

SEQ ID NO: 229415 - DNA, 383 bp, Homo sapiens
ctctgcccctccattgggaagtgggggtgccatgagattccagtgagtacatttaaagcgctcagtgcagtgtctggtgggagtcggcccaatatcacaccagaggctgctgtcgtcattgctataacctttgagggtcagccccaggagagcttcaggggtgctggcggcaccacccaccatcagccaaccttgctggggagggttaaacccccatcattgctgggagttgactgggactgttgcagggagtaggcatttggatgcgtgggacgcggtcagttaccagcctcggtggttgggataggtccccacagactgccgccctccccagacagctctcctgagaagggtgtgtgtgtgagcccacctcagagaggatg

SEQ ID NO: 229416 - DNA, 361 bp, Homo sapiens
cacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacct

SEQ ID NO: 229417 - DNA, 416 bp, Homo sapiens
agatcacaaaaacatttaactctgaaacacccttctccgaaaactactggaaggtatctatcaaaatgagaacctaattcaagacaggagaagacagaagaaacagaaactagaagatccaaaacaggacagaagtgaaatgaatctccaggtgatgctgaaggatgatccaaggatgacaactgagcataatgaacaactagtccagtaaggagctgtttgactcaagagacagagattttgaaggatatcattagcaatcctcttaacattgtatcatcttttcaatcatatgaacctattggaggatgtgttctagtaatgccatagagtaaactgaaaaagggcaagttataaaatcccagaaatagcaaacacatccagaataaaaggcaaagaattccaagaatgacagc

SEQ ID NO: 229418 - DNA, 571 bp, Homo sapiens
ggtgtttgtgcagtgacctaatacagagaacacagagttgaagaggagaggaagatagcctgaaacaccccagaaagttctgtcccctgtttagcattaagaaaattatgttacatgttaatgaattacaataataaccaaatcctcataaggaatctggtgagaagctactaatttatacccatactcagagttttaaggtcccacaggtggtaccagcagaactgagcctgtgagccccagccctggagctcactaacagaagttattaattccagggactaaagcctacagtgctccctctgtaaagcccaattttaacgcattgcatgttggatttcattttcgcagaatatattaataaatgtgtacactaagactacagccaaggagcaggtaatgctcaaagggtggcgtgtggccacgtctgtgtgctgggattgcagtcactgtgctttgctcatcggtgctgtttatgtttcctgcaatatctacacattgctttttgttttgttttgccttcttttgcatccagacgaataatattgcaagttatttttaaattattgtt

SEQ ID NO: 229419 - DNA, 982 bp, Homo sapiens
aaaattggaaattctcccccttctcccaaattatccagatttctatgatggatattttaacaaaactctcttaggttttgtgtgtgccctcataatgcccttgctttataattttgattcactttgtaaaccaagaaaaaagtatgtgtatcattatgtaatctacaaaattattaatggcttcatagaatgctgtcttaaggctatgattatttttatccaaccaatttcctatccatagcaattatttccatttaaaaaagaaagttgtgctttcctgctgtaatattggttacagctaaataccatatctgccattcattcatgtttatttacttagcataaattaatggaagaagaattattgaggaaaatagtatgctttatcttaaagtttggtatacatcaccaagttgtcctccaggaaggctgcatgtcttccattcctacttcttacatcttatttaccttttttaatttcataggagaaaacaatatttcgttttttttttttttggtatagtttcattgaaattgaagtttttatatttttcttttcttctttgtcctttttttggttttttttgagatggagtcttgctctgtcgcccaggctggcagtgcagtgggacaatctcggctcactgcaacctctgcctcctaggttcaagcaattcttctgcctcagcctcccgagtagtggggattacaggcacccgccaccatgcctggctaattttgtatttttagtagagatggggtttcaccatgttggccaggctggtcttgaactcctgatgtcatgatctccccacctcggcctcccaaagtgctaggattacaggtgtgagccaccacgtctggcctatatttttattttcatttatttgtgtagatattattttcttttgtgtactgcttttaaaaagtttagagtgatggcatgacatactttaccctgtgttttctgatgagtagaatc

SEQ ID NO: 229420 - DNA, 928 bp, Homo sapiens
aaaattggaaattctcccccttctcccaaattatccagatttctatgatggatattttaacaaaactctcttaggttttgtgtgtgccctcataatgcccttgctttataattttgattcactttgtaaaccaagaaaaaagtatgtgtatcattatgtaatctacaaaattattaatggcttcatagaatgctgtcttaaggctatgattatttttatccaaccaatttcctatccatagcaattatttccatttaaaaaagaaagttgtgctttcctgctgtaatattggttacagctaaataccatatctgccattcattcatgtttatttacttagcataaattaatggaagaagaattattgaggaaaatagtatgctttatcttaaagtttggtatacatcaccaagttgtcctccaggaaggctgcatgtcttccattcctacttcttacatcttatttaccttttttaatttcataggagtttatatttttcttttcttctttgtcctttttttggttttttttgagatggagtcttgctctgtcgcccaggctggcagtgcagtgggacaatctcggctcactgcaacctctgcctcctaggttcaagcaattcttctgcctcagcctcccgagtagtggggattacaggcacccgccaccatgcctggctaattttgtatttttagtagagatggggtttcaccatgttggccaggctggtcttgaactcctgatgtcatgatctccccacctcggcctcccaaagtgctaggattacaggtgtgagccaccacgtctggcctatatttttattttcatttatttgtgtagatattattttcttttgtgtactgcttttaaaaagtttagagtgatggcatgacatactttaccctgtgttttctgatgagtagaatc

SEQ ID NO: 229421 - DNA, 454 bp, Homo sapiens
tggcatcctgctgtttttgcagttagaccaatatatactagaaaatgctgaggaagataaatgtaaagaaaatcagcataattctggaaccctagacagcctgctgattaattaaaaggcttaacgtttctataatgttttagaatgtaaacggactttcatatattcaatctcatttaattcttataacaatcccagaaaatacataaaatagttactgttttactgatatagaaattttggaatcagaatggtatgaacagcaagtggccaggattaaattcacaggtctgcaaacctcatgctgtcttcactatactttacacatgaactgtacctcttcagctctttacccaaatgattctttccttctcaacaggtggttgtgaaaatcatgccctgaacacaatttatgggaaatgaaaattctctgaaggcattcccctgttaccag

SEQ ID NO: 229422 - DNA, 381 bp, Homo sapiens
tgatgagtgtgtctcactgtgcctatgcacagtgtattgtttgcataaaccatatggtttctgctgaacaccattttggagtctggaatttgggtacataccaggcagagaggatgcttatgtgagcaggcccccataaaaaccttgagccttgagtctctaaggagctactgtggttggcaatatttcacatgtgttgtcacaactccttgctggactaattaagcatttcctctgtgactccatgacttcactgggagaggacccttgaaagattgctcatggcttcctccagattcctaacatggacctttatccttgctaattttgctttctatacttttcctgtcataaatcatagctgtgagtataaatatatgc

SEQ ID NO: 229423 - DNA, 525 bp, Homo sapiens
ccaaatttagtaaaaaacaaaataaataaatgtaacctaaccgtgcatcaaattgttaaacggacctaacctacctataatggttaattgtatgtgtcaacttgaccaggctaagggatacccagagagttggtaaaacctcatggctgggtatgtcttcaaggatgtttctggaagaaattagcatttggatcagtggcccaagaagatccaccctcaccacagcgggcaggaatcatccaatcagttgagggcccaaatagaacaaaaaggtggaagaaggacacattctctcttcttgagctgggacgtccatcctcctgcccttggacattggagaagggcaacctgcttctcaggcttttggactccaggacttacaccagccgcccatcctacacttctggggcttcaggatgggagttacacctctcgctcccctggttctcagacctgcagacttggattgaattaaattatattgtaattatattataaaccaatgtattgagttatacactggtt

SEQ ID NO: 229424 - DNA, 438 bp, Homo sapiens
ctccattctgtcccattgttctaccatccaccatgtcaatgctaccctgtcacaatgactgagactttttccttactgtattctcacgtagagcccagtagaataattacagggcttggagtcccatttcttcagggaatataggtggttggaattctgacaccagataaatcaagtatgctggaaaaagaattcctattttaggcaaaagctttattggaagtttgcggcatcctttccgcattgttcattgctgttcagagtgttgctgctgtggtgctataaatgctcccagcagctctcaggttttctttccttccagctagcctccccctaacttcccactccagccaaaaaaagatgcactgtataagtctctgatgagggataaaaatcctttaaagtgtattattaatcttgagctttcagcaaaaaaaa

SEQ ID NO: 229425 - DNA, 430 bp, Homo sapiens
ttagagtaagatagcatagctgagagtctctacaaggcgtcatttttaatgttcagtatggaatgaaaatttaataacatacgaagaagcaggacaatatgatcatgatcaaggggaaaatgggctataaatgctgacccacagatgacccagatgttagaattagcagacacagactttaaaactgctattaaaaatatagtgaaggattgacttaccagaaaaggatggaatgggtgaatcgcagaatctcagcaaatagatggaaactataaagaaaaaccaaattaaaatcctagaactggaaaatatagtatctgcaatgaaaaggtcattgaatgagcttaacaacagaatggacagaacaggaaaaaaatcatttaattcgattgacaatgcactcaataaacttacctaaactgaaatatag

SEQ ID NO: 229426 - DNA, 414 bp, Homo sapiens
aaatgtatattacttaactctactcactgagaaagtcaagaaacaatgaccaaccaagtagctatgagcatttctaatgccccacaccaggactacttgaagaaatagctgtttcaaaagctgtggcaagaataaaagaatataaaaaagacttttaggttcatgtcaaaaggactcaggatccaaattgtagaggctttcactggtacaagatggtacattttacatcagtatggagaaaacctacaatggattgaaacacacaatgtatgttcaattcatattgagttcttaataacaataaaataatatcttgaccctattggcaaaggcgaaggagatgttataatttcaaagtcttgcaaaaaggcaaaaatttcaagcatatatcctgttgttctttttaaactgtgc

SEQ ID NO: 229427 - DNA, 418 bp, Homo sapiens
gcaccagacactcacaaaggtgactttgtgcccgtgaactcggctgcagcccacagtttgggcttgctgccgccggtgcagacaggaaatagctgctctgcggcagcccgaccccgtggccacagagcagcctctgttccttggtaatcgtcaacatctggcaggcacctccacgcccctccgccctcaccacacgctgctggctggaggctcccgtgcaatgccaggtgtgttgggagaggacaggctatacccacaagctgggctggaagtaaggaaatcgctttaaaagcaggaaaacaaattcgcttccccacgctttaaccactggtacctgtaagaggagccctcctgggtcctcccatcaccagagttcagagattctgggatgtgccacttcttcaggaaaaaaaaaaaa

SEQ ID NO: 229428 - DNA, 804 bp, Homo sapiens
caggaggcagctatccaaggtgggttggtagttttctatgtttgtggaggggaaactctcacttgcttcagcatggttcctttttctctggaactgttctgtcaagcctgccgtcctccagcgctaaggaggggctgagggaggaagcactgccttttgttcttttatctgacaggcacaaagcttgaaggctgactgcactggcagccccagattgtgttcccctaaaactgcagctgtcatctgaatttgggcaaagttgtagtttgctcctgagatagaatttccagaagggtgtgtgtgaaagagataattgtgggttgaaagtgtatatttaataagcaattaatctgtcagcttgtggaccaagaggagaaagccttcttctctgtggaatcagtgctttcatacatttcactattaaactgagaaaaactaccacaaaatagttcaatgagcaagactggcattaaaatgttaaaatgagtggttgtgttgagaaacttgaatacttaatgaagtatatgaaaagcagttacagagaggctcacaaagcagtttttacagagttctgatgaaaagcaggttccatgtgtgcagcttttggggaaaagtttttttaacctgagaaaatcatacttaaaatagtaaaaaggtgaagcacgcatttaagaggggatggtgatttatgaaatccactctgcctgtagccagccctccttgacccagtcatttagtgcagaaactaatatggaaagaggtgtggtaagagttgagctttatttcaaaacccattgtgttctt

SEQ ID NO: 229429 - DNA, 841 bp, Homo sapiens
gtggccctgtgagttttccccagcacgacgcttggcttgagttgactcatctccatgtttgtttgccagatgagcaggcagcaagataatgagttctggtgggattttataagaacaataaagaagaggggtctgtagtttttctgaaatagaacaagcttttggttcttgaacaagtatgtcccatggtagaattaatgagttgtatcattccggaaaagccttggctaatatgaaattttgaaagggacttgagatatgattattgcaggtccttctgctttaagaatccctgtgcaaatcaaaaactgataaataatacatctggattaagtggtattggaaagggttttttcgttttacgggaattcactgctgagttccttctctttgtgtgcaggaatatggattgacctgtcttttctttagttgtttaggtgaatggtttatgataattatctatctaagataattcacaaatggcagcaaatacctcatttaatagctgtctacctgtacatttatgggttggacatgtggatttttacaagcaaatagtgaagtagaggtgaggtggaagaagcatggactttggccccccagatttaggttgaagttgccatttcctcactgtgcgacctggaatagttatgtaacctcattagcctgtttccaagtctataaaatgggaatgatagctgggtgtggtggggggcacctgtaataccagctactcgggaggctgagggaggagaatcgcttgaacccaggaggtggaggttgcagtgcgccgagatggcgccactgcactccagcctgggtgacaagagcaaaactccat

SEQ ID NO: 229430 - DNA, 386 bp, Homo sapiens
atgattgggaatctggagttaagggaaaaaaagatgattaaaagtttaattgttcatctgaagagttgatttttttattcctgtaataaagggtacttttagcagtctctgctcatcttgcccatccggctctttttgtggttgtgtaaggttataacttctgtgtctcagtaaacttgtgcatgcccatttttttctctgttactaccttttctcttattttgttttattattttgatgtaaaattacctgttaattttatttgaaatgagaaattttaaggttcacattattcaaattctgtcagatccctacctctgtcatatggtttataatgtgctgggtattttcagacctgcttattaaaaagatgtaaaacaaaataa

SEQ ID NO: 229431 - DNA, 537 bp, Homo sapiens
tagcctcttgaaatagtatgttaggtaatggatttcgagcttttgttattttcctattcatttgaagcagtaaatttctctctcaacactggtttatcagcattccacaagtttattattatttagtgtaaaacatttcctcattttcactttgattgcttcttggaccggtgggttatttaaaagtgtaacattgaatttttatggagttctgatttgcttgttatctttttgatactgacttctagtacacttctgctgtgccaagacatactttgaatgattcaatcctttgcaatttgttgaagcttgctttacatcctacattataatcagttttggtaaaggttccatgtggacttgaaataatgttgtaaccacaattacttttgcaccaacctaataaatacttagttcaaccgtatgtcaattaggtcaggtttgttgactgatttctgtacatcttccctgttcttagtgtttggtcgttatttgtttgcttggttttggtctatttgtatgagaggggtgttaaag

SEQ ID NO: 229432 - DNA, 388 bp, Homo sapiens
ttgtgagtgagccatgtctgccttcagcaggtggcagttgttcagcctggggcttgcacatcagcattggctggagggcctgggagagagtggcagcgagttcccggttcagctcaggatacagggatgactaaggcacagacctgccctcagggagctctctgcttttctagaaaaggggaaacacaggagatgtgtggcaaacatcataaaaggaagaagtaccaggcacacaaggggtgaatgattaatcatttcggatggaggacaggcgcagtggctcacacctgtaatcccagcactttgggaggccaaggcaggaggatcgcttgagcccaggaaggagttcaagaccagcctgaacaacatggcaaaacctgtgtccaca

SEQ ID NO: 229433 - DNA, 604 bp, Homo sapiens
tcttcaccacaaagtatagttgtttgcagaagatcatgccttatttatcttcatatcccaagttttagcacgatgcctaaccttcaagaaacactcaagaattgagttaaatatttcttatgcttctcaagctcctattctaccaccttactacaggtgacatgggccccagtctcactccagaattaaagaatgttataaaatacgaattcctcagcttcccatccccacctggcctctaacctaatctggggactccaagaatgaaatgccttccccttctcctctcatccaaacctaatccctccgcctgtgctctggaccattcctcatacaactcccctgagtccttttagctgtccccttctctcttccagcttcaactttcccccttcagcattcaaaataaatcaagtcactcccatttttgagaacattttttcaatccacacatctcttcttctaggctttctagttccgttcataaggaaacattattggggtatttacgcttttttgtgttatgaaccactgtggtagcccagtgatgcctatagaccccttcacagagtgtttttaaatgcacagaaccacaaagaaataa

SEQ ID NO: 229434 - DNA, 549 bp, Homo sapiens
tactgtttttagcattctatcacatctgtgagtttcgagtgggaagggggaagctttccaactcacttcagtctgctgttgactggaagttcgctggacagttttgttggattaaattgtgtaggtgacatgtcatacctgttaagagatacctgaagcattgctgctttacattgcttccagacatatagtatagagtctaacgaagttttctgtatctcagcatagcaaaggcagggaagcaacacagaaagtcttgatcattcaaggtcgacacaagcaaaatagagagctacaatatttgaagaggtcctgaggaaggaatgaaaatggtgaattatgtagagcagtattactagaatcatgtggacctcctccaacaactctaaggtgctttgtaagcatctttgatcttagacacaccacggaaaatgcagcagatcctaaattgattccatttcagcacaacaatgggatgagaagacaaaatataaattatgagtattgctatagaaaataaaagctggatgttttatacacttgggtttg

SEQ ID NO: 229435 - DNA, 698 bp, Homo sapiens
cagcaagatggggctgattaagagtaagactgtctcctggagtagctgagcatcctgggactcatcagggcccagaaacactagccagccactctctggccagtccacccctgaagttcatttcttccttcccagctgatgtccatccctccatcattccatctgtccattcgtgcattcattcattcagcaagtatctttgaaaacctactaggcgcaagcacggacgatttttttaaaggaggccttaaaagggagtccccatgctgactcttggttgacttgcattttcccaaaatgaaattttcctgtgtcaaattttctttctgaatcaatgataggtttcctagtcccttaaaactggccgttggcaattggaagaagacttttttgaagatttgtgggggaaacattccctttacttttcaggtaacattacttggttaatattcagttactaaatctcttcaagaagtactggctacttccattactattcagagcacagctgatgtgacgcccaggggcttccgtggggcagggatcggggtaggagggatcctgcatgagaggctgtgggtcagacaccagtcagcagggggcgcggtggagcacccattgatttctaggccctcttgggctagcatcgtttcttcccgagtgggagctcaggcccagtgtggatttgaccagtcttc

SEQ ID NO: 229436 - DNA, 644 bp, Homo sapiens
cagcaagatggggctgattaagagtaagactgtctcctggagtagctgagcatcctgggactcatcagggcccagaaacactagccagccactctctggccagtccacccctgaagttcatttcttccttcccagctgatgtccatccctccatcattccatctgtccattcgtgcattcattcattcagcaagtatctttgaaaacctactaggcgcaagcacggacgatttttttaaaggaggccttaaaagggagtccccatgctgactcttggttgacttgcattttcccaaaatgaaattttcctgtgtcaaattttctttctgaatcaatgataggtttcctagtcccttaattccctttacttttcaggtaacattacttggttaatattcagttactaaatctcttcaagaagtactggctacttccattactattcagagcacagctgatgtgacgcccaggggcttccgtggggcagggatcggggtaggagggatcctgcatgagaggctgtgggtcagacaccagtcagcagggggcgcggtggagcacccattgatttctaggccctcttgggctagcatcgtttcttcccgagtgggagctcaggcccagtgtggatttgaccagtcttc

SEQ ID NO: 229437 - DNA, 524 bp, Homo sapiens
ggaagaaccatgggagatgagctgagtctgtcccatggaggctgacttcagactgcatgtcagattctggaagtagctgcagcacagtggagacccatggaaggctgtcttccttgaggtagacaggaggaagacagctctagctttaggtgagtgtgtactaccttgaggtgatatttcacatgcgctacatggaggagttttggagttcagaagattggcagctgaaactctctccatcaggttgtctcactttgtgtatttttaagatctcagtaacataagctaaataattatccctgtgcacaagaaaaacacagttaaagaaatatcctttttacttgctatattactaaatttgaaaattcaagtttttcattaaaaaaaggattcttaaagaaatccaagctttgttagatgtctttgaagcatatcatattgtaaatgtattatggaataaagactataactgaaggttgtattttattacacacacacacacacacctctaggatttaatctag

SEQ ID NO: 229438 - DNA, 387 bp, Homo sapiens
gcacacccattgcctctgctcacagctcactggccagagctcatcacctggcctgcttcaccacgaggggaccaggaagtgtctggaaggccaagagcctgaaatatgcagtgaacggccctaatgacagccacaccacttaccagctcagagaccgtgggcaagttaccttcctctgcctctgctcccttgtctagggcgtggagatgaggtgtccttcctattcacagggttgctgcgaggacagagtgagttggcacacacaagcacagagcgccctgcttggctccgctgaaagaaagttccttctggctgaggtgggcagatcacctgaggtcaggcattcaagaccagcctgaccaatgtggagaaaccccgtctctacta

SEQ ID NO: 229439 - DNA, 242 bp, Homo sapiens
agggtaggggacttattttctgagacagggtctcactctgtcacccaggccaagtgcagcggcactatcgtggctccctgcagcctcaccctcctgggctcaagcgattctcctgcctcagcctcctgagtagctggggttacaggcacaccagcccggcccaggccgcgcctcaccccctgcagccggctcccacgcagggacacccccgagatctacggaaacacagaggccctcaaacg

SEQ ID NO: 229440 - DNA, 396 bp, Homo sapiens
agcagcaactgtgattttttaaaattagctttttattggatccatgtttgttttacagttaggattctgctatggactaaattgtgcacccctggtccccacgctcaaattcatatattcaagccataactcccagtacctccaaatgtaaccataattgaagataaggtttcgaaagaggtgattacattaaaatgatgtcattagggtggggccctacttcaatatgtctggtgtcataagaaagacaacaggagcacaagtgcataaagggacgaccatctgcaagccaaggaggagaggcctcagaagaaccccagactgccagcacttcatctttgacctccagcctccagaactaggagaaaataaatttctattgtttaagccactcat

SEQ ID NO: 229441 - DNA, 401 bp, Homo sapiens
ggctattctgtgctccatgtgtgctccttggtgcagtggcctagagaagagaaggtatgaaaattgttgctttgcaatcagaatttgaactcactccactgtcttcttgacttcttctgccttccagatgcccttctgctttcacagtgagatgtgtcaagataatccaattcttcattcactaatgatggttatccaggagaataattttcaatcactttcgaattagaatgccctttctctttctgtcatacacacacacacacacacacaaattaaaagatttggagaggctgaggcaggaggatcacttggacctggagttcaaggctgcagtgagctattatcacatcactgcactccggtctggacaacagagcaagaccccatttctacaaaaa

SEQ ID NO: 229442 - DNA, 532 bp, Homo sapiens
agtttctttattcctaaatacctaacttggaatcttcatattttctgtcctcaatagtttaactttttaacacctaagtatatagataaatacaaaactttcaaaagattttatcaaaatgactttattttgttataatagttgttacatgaaactatccataatttttcaagataaaacagtgactttcctaaatatacatgtaaagtagtctttactctttcagaaatgaccccttttacaggaatttctccttgaaatgtatatagtaagtttagcaatgtctaaatacttttagtcccaaaacaagatatagccttacaaaatatcttatgatttttgttatgcataattttacaaatatatttaaaatgctctacaaagcagtgctctactatttatactataatcaataaatgctgtgtgaaacttttacaatctggttttcaaatcttttgtttttgcacaactaacaagcaaactgacattttgcaaggctttccaagctgcactggtgattactatatcactt

SEQ ID NO: 229443 - DNA, 275 bp, Homo sapiens
ggttgcagtgagcccagatcatgccacactccagcctgggtgacagagcaaggctttctcaaaaaaaaaaaaaaaaaaaagaacatccgtcgtggacaagactttgcactctttgcatgtattgtcacaactggttgctggaggtattaagcacatcctgtgtaactccattgggagaggactcttggaagctttcacctgattttgccccatgtgacttttcctttcttattttgctttgtatcctgctggaataaatcttagttgttaatatt

SEQ ID NO: 229444 - DNA, 1197 bp, Homo sapiens
gtgataattttcatagtacgtatgttatagttgaatattattaacctaatttaataataaggcaatttataaaatcagtaacaaaactattttctcaggtggttgtgagacaacttcagcaagaagcagctgacagcctaaaaaaattaactatgttagagtctccactggaagtatatcacattatcacattaatttggatgagacacaggtcccaaagaagaaattatttcaagtggaaagtcaagtatgtatggaacttagcatgtcaacggttattctgtagctagttgaattacataacatgttttaggatactaattatggcagaagcttgattttttattttcattacaatgatttatttccattttactatctctataatgtacttatttttttatatagtgactttcattctaccattttgaaaaaccattgcataccttttctcttacaatatgtacccttggaaaagttgagaattatacatcattcctcatagaaaactgacttttgtcctgttaaaacagtatttttaagtaatttttgtattgctctgatgaggcaggccagattaaatcagagaagaatgtttcatggaatgttccagaaaattgtcttatttcttcacttttgtgagtggacacagaatctgtgtctatttatttcacagattctaggttaacttgtacagaaaggccattatactattcttttaaaagtgcatgttttaggttaatttacaaactatttgaaaagttaggcattttctttatcttttatttaaaatatactataaaactgtggaaatatttaaatttgagataacatgtacatcaaaaattgagagttgagaaaattatcttgatcctgcctttggattttaaagacagtttcactgagatatcattcacatttgagagagttcaaccatttaaaatgtacaactgagtatctattagtatattcacagcattttcatcacctgaaaagcaaccccacatctcctaggcatgactgcagccttcctccatgtccctccacctacctctgttgtaggcaaccaccatctatctacttttgtctccatatgtttacctgttctgcttatttcatatacatagaattatacaatacgtagtcctttgtgactggctttttcacttagcataatgttttcagaattcacttagc

SEQ ID NO: 229445 - DNA, 1121 bp, Homo sapiens
gagagagaaagcagaaagagtagtggttgtgagacaacttcagcaagaagcagctgacagcctaaaaaaattaactatgttagagtctccactggaagtatatcacattatcacattaatttggatgagacacaggtcccaaagaagaaattatttcaagtggaaagtcaagtatgtatggaacttagcatgtcaacggttattctgtagctagttgaattacataacatgttttaggatactaattatggcagaagcttgattttttattttcattacaatgatttatttccattttactatctctataatgtacttatttttttatatagtgactttcattctaccattttgaaaaaccattgcataccttttctcttacaatatgtacccttggaaaagttgagaattatacatcattcctcatagaaaactgacttttgtcctgttaaaacagtatttttaagtaatttttgtattgctctgatgaggcaggccagattaaatcagagaagaatgtttcatggaatgttccagaaaattgtcttatttcttcacttttgtgagtggacacagaatctgtgtctatttatttcacagattctaggttaacttgtacagaaaggccattatactattcttttaaaagtgcatgttttaggttaatttacaaactatttgaaaagttaggcattttctttatcttttatttaaaatatactataaaactgtggaaatatttaaatttgagataacatgtacatcaaaaattgagagttgagaaaattatcttgatcctgcctttggattttaaagacagtttcactgagatatcattcacatttgagagagttcaaccatttaaaatgtacaactgagtatctattagtatattcacagcattttcatcacctgaaaagcaaccccacatctcctaggcatgactgcagccttcctccatgtccctccacctacctctgttgtaggcaaccaccatctatctacttttgtctccatatgtttacctgttctgcttatttcatatacatagaattatacaatacgtagtcctttgtgactggctttttcacttagcataatgttttcagaattcacttagc

SEQ ID NO: 229446 - DNA, 851 bp, Homo sapiens
gtagagccaaggactctctttttggccaggctggtctcgaagtcctggcctcaagtgatcctcctgtcttaacttccccagaagtgctgagattacaggtataagccaccatgcctggcctcagagtcaagacttctttcgactgttctttactgatgtggagtttcaacaccaagtaaccagttatggaattaatttgttatcaaattgatagtagagaaatttaatctggtggatttcacatttggtaatttcaggataagcattaccttagtgcacctttgttttccacctgttttgtgttgtgtagcatcagatgctataaatggcaaataaccactgaacaaatttgctttcatggtgctaaaaggaccaggatttaaataaaattgtcatcatctatttatttatttatttatttttggagacaaggtctcgctctgtcttccaggctggagtgataaagtggaacaatcagggctcactgcaacctcgacttgctgggctcaagccattgtcctgcctcagccccccaagtagctgggaccacaggtgtgtgccaccatgcctggctaattgttttgaattttattttattatcattattattatttttgagatggagtcttgctgtgttgcccaggctggagttcagtggcacgatcttggctcactgtaacctctgcctcctgggttcatgcgattctcccgcctcagctttccaagtagccgggattacaggagtacaccaccatacctggccacatggtgaaaccccgtctctactaaaaatacaaaaaaaatgagccggcatggtagcaggtgtctgtatccagtagaggtgagcgaat

SEQ ID NO: 229447 - DNA, 983 bp, Homo sapiens
  misc_feature (119)..(119): n is a, c, g, or t
  misc_feature (123)..(123): n is a, c, g, or t
acctgttattgtgtagtgtagcatcagatgatataaatggcaaataaccactgaacaaatttgcttcatggtgctaaaaggaccaggatttaaataaaattgtcatcatctatttattnattnatttatttttggagacaaggtctcgctctgtcttccaggctggtctcgaagtcctggcctcaagtgatcctcctgtcttaacttccccagaagtgctgagattacaggtataagccaccatgcctggcctcagagtcaagacttctttcgactgttctttactgatgtggagtttcaacaccaagtaaccagttatggaattaatttgttatcaaattgatagtagagaaatttaatctggtggatttcacatttggtaatttcaggataagcattaccttagtgcacctttgttttccacctgttttgtgttgtgtagcatcagatgctataaatggcaaataaccactgaacaaatttgctttcatggtgctaaaaggaccaggatttaaataaaattgtcatcatctatttatttatttatttatttttggagacaaggtctcgctctgtcttccaggctggagtgataaagtggaacaatcagggctcactgcaacctcgacttgctgggctcaagccattgtcctgcctcagccccccaagtagctgggaccacaggtgtgtgccaccatgcctggctaattgttttgaattttattttattatcattattattatttttgagatggagtcttgctgtgttgcccaggctggagttcagtggcacgatcttggctcactgtaacctctgcctcctgggttcatgcgattctcccgcctcagctttccaagtagccgggattacaggagtacaccaccatacctggccacatggtgaaaccccgtctctactaaaaatacaaaaaaaatgagccggcatggtagcaggtgtctgtatccagtagaggtgagcgaat

SEQ ID NO: 229448 - DNA, 868 bp, Homo sapiens
tctctccctctgcttccctcagtgcctcttccatctgtgttttcttcttctcacctttcagagaaaacaaactattatagaaagaggctttgattcaaccacaggttcaagtctcagcttgctgtttattgagtgtgtgaccttcagcagagcatttcgcttcactgggcctttatttcctcatctggtaaacaacgaaaatagctcctccctcctgggttgttgtcaagacacttgagagagtgtacataaagcccctgacacacagtaggccctcagcatacattagtcactcttatccttaaataccctggcagcttgtcagcaactacctctccttttaatggcacttatctttactgatcatctgctagtaatctgcaagtcccttgctctgcctctcttgctggcccccagcacaatatctaagagacagtaagaatggccaaatgattagcctggcatggtagtgcatgcctgtaatcccaactactcaggaggctgaggcaggagaactgcctgaacccgggaggcggaggttgcagtgagccgagatcatggcactgcactccagcctgggcaacagagtgagacaccgtctcaaaaaaaaaaaaaaaaggccaaatgaatgaatgtgccctgtcctgtcagggctctatgaagttaagacacagcacttgtctgtgagaagcaaagagacttgttcgggttgcttccctatctctttacctaaagggtagctattccacagtcttcctcaagatgtcacctataccctcgtgatcaatgcagaacaagatggatgggagttgacatcaaatgaatggcaggcactgtgatggattcccaaaagaacatgtcctaaaac

SEQ ID NO: 229449 - DNA, 2079 bp, Homo sapiens
  misc_feature (580)..(580): n is a, c, g, or t
gagatgggagtctcgctatgttgcccatgctggagtgcagtggcgtgatctcagctcactgcaacctctgcctcccaggttaaagcgattctcctgcctgagccccccagcctcctgagtagctgggattacaggcgcctgccaccacgtctggctaatttttgtattttttagtagagacggggttttaccgtgttgtcaaggctggtctcaaattcctgacctcaggtgatctatctgcttcgcccccccaaagtgctgggattacaggtgtgagccaccgcatccagccaagaatggcctctttaatgtctgtgagctccccaagggcagagacaccctctagtgcctggcaccgcctccagggctgaggaggtgctcaccaagtctgtgatgcaggaatgaagccgtatcccaagtagggggctgcgtctgcccagtttaccagtgcgttcttgtcacccagcacgggctggccagcgagtatcgacacagggtttgctgagcggaggaatgagccctgctttgtggtggaggggagcaggtggcaggaaagccggaccccactgcccctccctgnccctctctgctcttttattgcaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctccatctttgcatagtttctggcccctcactttgttgctggggctgtttctgggaccctctgtagggcctggaaactgcaggatgcctgagggtctcaggggctggggctctacctcccctggcctgggtgagttgggggtggggcaccagcacgccaaggcagtgtcctactgatccaggctatgagaatccaaacattctttcccaggtttggcattttatagttagaagcatttctgcaacagcagtttcatggaacctctcttagctaacctggtccatggggcagcagttacgctctaagaatccatgtggtaagatcatggtgcggcaaatggaggcagggtccaacccaggtctttgtgcttttgcctttacccttgcacagctggaggaaatgagtaggaaagaaatcaaggtaaagaaatgcgctggggctgtttgggcatctgtggagggtggtgctgacagggctaggcctgcacctctctggcctcctcaagagctgcttgttaaatgtttccgtgtaaatagaatgaatagagaccgccatttccacatggcaggcctaaacacatgtgttcgtctcagttttctcttaggatctctctaagatgatagtaaagaaaatcaaaaataatacaaagggaaagaaaacaggagggaagacagtagaacacagagcctgaccacattttcttttttctctctgttgccggggctggagtgcagtggcacgatctcggttcactgtaacctccacctcccgggttcaagtgattcggcctcccgagttgctgggattacagacacccgccactatgcccggctgattttttttttttcttttttgagacggagttttgctcttgttgctcaggcaggagtgcaatggcgtgatc

SEQ ID NO: 229450 - DNA, 738 bp, Homo sapiens
ggcagtaataccggcccttcctgtgcctgctgcttcatgccgccggcgtcctgctccacgtctctgtgctgctgggccctgcactgtcggcctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctcca

SEQ ID NO: 229451 - DNA, 1333 bp, Homo sapiens
ggcagtaataccggcccttcctgtgcctgctgcttcatgccgccggcgtcctgctccacgtctctgtgctgctgggccctgcactgtcggcctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctccaaaaaaaaaaaaaaaaaaaaaaaaaaaacgcgtttttttttatttttgttctgtttttctaaaaaccgaggagggcggcgctttttattgtgtgtgcccccccccagaagagagcgcgcccccccccaacatgttgtgggggaggcgcgtgtgagaatagtctgccacaaacgagagtgaatcgacctccccaaggagggactattaaaagacacgactgttcttgtctgcgacaagagcggctgtgcgagagaaccaaatgaagcccgcctataaaaagcatgaagggagaaagggtggggccccccgcaaaaaagagggggcacatccatgcgaggggctctccaagaaagaattgttcgcgcccttttgtgggggggggggaggcacacaaacgcccggggaggaggaggcctacccagcgaaataatttttttctctccaagaaagagaggaaagtttcgggcatgcgacccgaggtctctctacgaagcaccttttttccacacaaacggggggtggtggtgcacaacagaagggaatcataaacggatgctcgtggggaagtagagggagagaaagtttcgagaagcgcg

SEQ ID NO: 229452 - DNA, 418 bp, Homo sapiens
aatgactcaaggagagatctgctgctgtgtaacaagtcatcccaaaacttagtgacttaaaacaacagtttattatttcttaagaatttgtgagtttgttacataagccccaggcttatccaggactggaacgtacaagatggtcttatttatatgtctggggctttggtgctgccagttttctgggggaccttgcttctcatctctgtggcttctgtctccatcatttagtagcataattcaagcttttttacatggtagccagcttccatggaagtggaaataaggctgctaggcctagtaagacttagactctgaatacctttgagtgcttcggagtactgtgccatctaccagagtaaccaagccaaaacaaaacaaaaacccattgatgacttagtgtaagagttgtttatga

SEQ ID NO: 229453 - DNA, 645 bp, Homo sapiens
tcgtgtgaccacagctgtgactcagggaaactgcggggtagcattttggggttcaagagagcttctgactcaggccgaggggtcagggaagcttcctggaccagctgccttttgagcgagggctttgaggagacgttccagtggagaaggcaggggcagagtttcaggcagaggggactatgggaggaaaggctcgagggccagagatagcaggaggtgctggggagtgaggttctgggcatcccaggcagaagccacagtgtgggcacaggcccgaccccagtgaaagcgtgagaagcagctctagccgctgcagccctgggtccccattatggctctaagcacactggaaggagtgcattttctatgtgacaacgtcctttttcgtctcttccacttacagggcctgggtccgtgttattgtctcctaggtcccaggcctctgtcacaggctctggctcagcatagatgttcagtacctacctgcggctcaattaactggggccagttttcagttgataattattgagcacttctctgccattcagtgggtcaggggctggggaaatgtcagtgacctaaaaacacccctgccctcatgggctgacatgctacagtggagggagagacaactaaaacataaag

SEQ ID NO: 229454 - DNA, 215 bp, Homo sapiens
acctcctgctttctttgccaccagatgttccagtgcacaaaaataactaaaacccaattttaatcttgtgttggaaattaaaagaccaggaaaaaaaaaagatggtatgtacagtcatgtgggtgaagtttagacaagtaaatggctataacgatttgattagcaatttttttttgagtcagaatcttgctgtgttgcccaggctggagtgcagt

SEQ ID NO: 229455 - DNA, 507 bp, Homo sapiens
tctctgaccagctgccttttccacttccttgcagctggcaggaggtgcctccttctttgtccagaaagaagaaagagtggctgcttggcccgggggctgtcaaagggcaaaccaggtcaatggtcccacccggcccacagcgtcagaggtcccccacgaacgacttggctgaggcatccctccaggggtggggattggcccctccatcctcatggcaagcatgctaataggcctcctcctatcactgcctcctgtttcttggatgggataaactgtttggcctttggacaagattacttttgcaccaaacaggattgttatcacttaattgaaaataattatccaatgcaaattgagttcaacttatctagctggaaataaagaagtgagtattttgggtggtttcactgctgcaaaggcaggtattttaagcaaatgaaagtaacgagatgcaggctgtgttttctgcaggaggccctgggaaatctgggggcctttcttgagttg

SEQ ID NO: 229456 - DNA, 827 bp, Homo sapiens
catgcctttgttgcctcatctgttgttatgaaggttatggcaaggattggatgaaataatagacataaatggcttaatacaatgtcaagcatatactgagtgctcaataagtggtagctagtgctatcattatgttatgctttctggattttgtattttaagctccaggtccagagacatagatctagtaaggggaggatagacagttcaggtattaaactgcttgactcaagcatgtgcttactggcaaccatgttactaccctatgcattacacaagacaatctcagatctactccatctatcccaggtgatggtcttttccaaatagaggaagacttcctctatcagtaatgtaaagtactacacccctccctaacttgtatttccaaataagttattgtgtttttattgtagaatttaacatttagattaaaaatacttagtgcgatctcagcaaactaccatggaaaggtaaccacttgaatctgacaaagggtatgtgcaagccatgttgaatggtgaaatacttaatgctttcactctgatgtatggaataacacaagcgtgccctatcactcttattcactgtcaccttatagcatctatcactctgtcatctgtattcaacaatatactggtagtcttaccaggacactaaggcaagaaaaagaaagaaatgttattaaaattagaaaataagaattggccaggtgcattgcctcatgcctgtaatcccagcactttggggggctgaggcaggcagatcacttaaagtcaggagttcaagactagcctggccaacatggcgaaatcctgtctctgcca

SEQ ID NO: 229457 - DNA, 696 bp, Homo sapiens
cttggacccgtcatcttggctaatttcctagattagacgttggtagggaggccgataagtcaaagtggcaagtgtcagtgtcacaccaaagggagcgaccagaacagagtaaagcccataaaccgagtaaaaacaaacaacaccacagtccctcaaagctgtaggccacgtagtatgagggaaacagcaccaccgctggggcagtgtgtcatcagaagagcattaggaagaggtccgtatcttgcagtttatgttgaagtttctggtaaagatggtcagaagcgggaacctgacacttcaaagtggaagcttcagttacctgggcgcccaaggggaggtgttctccccagtgatgccgggcaaatgaaccaacagctggatcatacttctcatttgacatgctttttgggggacctacgtggggttcagcactgcgccgggccacagatttgcagggccaatgaggatgtggtccctgccccggagcctgatgctctaagtgctgagggtggagggcttcccggaggaggtgttctctgaggagagtgaagtacccggcagagtggtgctgaagagcctctgagcagagagactggggtgacatgtggcttggtgtgagctctgagcacagaagtcacttggggatcatagcagttttgtttgtgagggacagtgtgggggagagccccccctacg

SEQ ID NO: 229458 - DNA, 643 bp, Homo sapiens
cttggacccgtcatcttggctaatttcctagattagacgttggtagggaggccgataagtcaaagtggcaagtgtcagtgtcacaccaaagggagcgaccagaacagagtaaagcccataaaccgagtaaaaacaaacaacaccacagtccctcaaagctgtaggccacgtagtatgagggaaacagcaccaccgctggggcagtgtgtcatcagaagagcattaggaagaggtccgtatcttgcagtttatgttgaagtttctggtaaagatggtcagaagcgggaacctgacacttcaaagtggaagcttcagttacctgggcgcccaaggggaggtgttctccccagtgatgccgggcaaatgaaccaacagctggatcatacttctcatttgacatgctttttgggggacctacgtggggttcagcactgcgccgggccacagatttgcagggccaatgaggatgtggtccctgccccggagcctgatgctctaagtgctgagggtggagggcttcccggaggaggtgttctctgaggagagtgaatgtggcttggtgtgagctctgagcacagaagtcacttggggatcatagcagttttgtttgtgagggacagtgtgggggagagccccccctacg

SEQ ID NO: 229459 - DNA, 643 bp, Homo sapiens
cttggacccgtcatcttggctaatttcctagattagacgttggtagggaggccgataagtcaaagtggcaagtgtcagtgtcacaccaaagggagcgaccagaacagagtaaagcccataaaccgaggaaacagcaccaccgctggggcagtgtgtcatcagaagagcattaggaagaggtccgtatcttgcagtttatgttgaagtttctggtaaagatggtcagaagcgggaacctgacacttcaaagtggaagcttcagttacctgggcgcccaaggggaggtgttctccccagtgatgccgggcaaatgaaccaacagctggatcatacttctcatttgacatgctttttgggggacctacgtggggttcagcactgcgccgggccacagatttgcagggccaatgaggatgtggtccctgccccggagcctgatgctctaagtgctgagggtggagggcttcccggaggaggtgttctctgaggagagtgaagtacccggcagagtggtgctgaagagcctctgagcagagagactggggtgacatgtggcttggtgtgagctctgagcacagaagtcacttggggatcatagcagttttgtttgtgagggacagtgtgggggagagccccccctacg

SEQ ID NO: 229460 - DNA, 525 bp, Homo sapiens
aaagagccattaaccaaggggtggggggtgtgaatttctaggaaaaaaaaaagaacaacagaactaaaatctcagtgtcagccctgccttacctcacagggacaagtcaggggaaaggtgccaactgagaactctcagaagacctccaggctggacaagggattcaggatgagggcctggccagtggggaagagttccgttctactggagtttaaaaaaaggtcggggggaagaaaagcacaagtgctattaacttttaacctagtcttctcccaggtggacattcaagcatgtcaccaaatcgccagacaatttgatttctctaacgtcaaaaagcagaacccaattggatcagcatggtgatcccgatgcggagttttctttgtgtggtatggtaatttttcaattaggttggagacagattaaaagcaaaatttggagctcagaattcatgctcatctttcagaaagagacaagaatctttgcccagggagtctgaaagttactttagaagcaggtgggttg

SEQ ID NO: 229461 - DNA, 338 bp, Homo sapiens
ctggcttcttggtagttgtggaaaatagatatagagattgctttatatttagctggatgtgatgactcacacctgtaatcccagcactccgtaaaaccgaggcagctggatcacttgagcccaggagctcaagaccagactgggcaacacggcagaaccctgtctctacaaaaaatagaaaaatcagctgggcattggaagcacacaccagtagtcccagctactcgagaggctgaggtgggagaatcatctgagcctgggaaagtcgaggctgcagtgagccaagacgatgccactgcaacatgctttgggcaacagagtgagactgtctagaaagg

SEQ ID NO: 229462 - DNA, 606 bp, Homo sapiens
atttaataaatcctttattgttgaacatttagatttttcccagtttcttctatttcagtgacataatatatatcctgacacataataagcacttctaccaggaaatagaatcagtaggaatatatatttaataaaagccttattacagggacttggtcttatgcaattatgggaactggttatgcagtctgtatggcgtcatctttgcatcttatgctagagcttgaagtctgcagggcaaacaatcatgaaatgaagttgaatgtaaagtggaagagcaacaaggtgaaaaccatgaagatggactggaagccatgtcagttcttgctgcctctaaccttgataaagtgtaggtatcctacaggaaaaactggcacccttcatcaaggagctaaatagacatctggcccaggagatggaaaaggtgaaggaggattcaagggaaggtggagcagttgtaggcctggctgttgcgtcatgccaaggtgagcagcagatatctagcagtgtttataaactataaaaatgcctgctccaaccttccacctggaaaaaacaaaatgtttcaattctgttctctaaatcttacacaaatattatctcctg

SEQ ID NO: 229463 - DNA, 427 bp, Homo sapiens
atcgattcgtaaagcagggtttaatccataattattcaactgaagggacatttgggaatcatggatggggaaacagctcacgcaatcaaccctggagggtgatggtaaatactgtgtgttctaatatcagctcagttatgcgtgtcttctgtgcataaaatgttttttcacttgtatctgagatttcctgccccccaaatgggagtaaatctgttgactcatttatcaggagtcctgtgaagtgcagcattgtttgtaaagcgtctctttcctctgataaacagcaacatgaagagaccagtgtaactttcctcatgaagtatgtttaagtcacggatctaaaatttgagagaagcaaaagaaatccgataaattttgaacttgacaaaggtgaccttttgtccttgaaccaagtggtactaattta

SEQ ID NO: 229464 - DNA, 438 bp, Homo sapiens
ccagaaaaataaatcatttaaaaatcatgatttgcttctgaattgaatattgttttaagaactttttgatgattccagttgctactgctggtctccagcagtttcttagaatagtcaatggacacaagttatgttaaaatctctattaggccaggtgcagtggcacactcctgtaatcccagcactctggggcaccgaggtgggtggatcacttgagctcaggagtgttctagacaagcctgggcagaatggtgaaaccaccatctctacaaaaaaaaaaaaagaaaaaaaattatccaggcatggtagcgtgcacctgtcatcccagctacttgggaggcttaggtgggaggatcgcttgaacccaggaggttgaggctgcagtgatcttagatcgcaccactgcactacagcctgggtgacagaatgataacctat

SEQ ID NO: 229465 - DNA, 477 bp, Homo sapiens
ttaattgactttacttagagtctgctgatttaaattttaatctcatccaaaaaaaaagcaaaaaacaaaaaaccttcatgaaaacgtttagaacaatgtttgagaaaatagctgggcaccacagcccagccaaattgacacataaaactaaccatcacgctactgttacaggtgggaatgtcatgtccctcaggtgtttggggccagaaaaagagttcaaaaccaatgcagagttttgaagtgtggagaatcataaagacaggcagaggcatctcttcctttttatttgtcaaagaaaactactggttatattttctctgtgcagccatacgtatgtcagtgtttatggctttaatcctgcttaaatagaagaacataattttatgagaaaaaatactggttgatcaccttctgttattctgcgtgtttcaggtggaccctgggggtataatttggaaaggaatggaggtagaaaca

SEQ ID NO: 229466 - DNA, 450 bp, Homo sapiens
tgctgagttgagcagagtgacagactccacactggagccagccccgcagctggccataaggaggagccacgagcaggtgctgggaagacaggctcttgaacgcacactatgctgatgtctctttctgtgaagttttctacatgagtgacgttctcaaagtctgcaacacagtctgccatgagatgccttttttcctctgggaacacaatgctactttcgtgattggctgagtaatggcccccaaagatgtactcttcatcctaatccctggaacctgtaaacatgttaccttatatggcaaaagagacttcgggcaggcacctgtcatcccagatactcaggaggctgaggcaaaagaatcgctcaaacctgggaggcggaggttgcagggagccaagattgtgccaatgcactccagcctgagcaacaaagtgagactctgtctctaaa

SEQ ID NO: 229467 - DNA, 496 bp, Homo sapiens
aatagaggagaacttaaaaaatgctgaaggttaaagaggacaaggggttatttgagaagtattttctattttacagacaaaggaaaggagtgggaaaaatgcttgtctttagaataaactatgttcctaggttacatgtgagacgtgtctgggataatgaacaaaatcagagccagtaagtgtaattgggaaagtaagctattttagaagttattaccaagtctacacaacaaggagaaaagagcttaagtgtttgacattctttccaaggtatgaggaagaattccaagggacagaattaatatttccctctattgacatcctgaacagtgaacagtgatctatttatataatgaatgttaagttctagaatccctaactgtaatagtcacatacttatctgattttctttaatttgggaataagtctgctacatttaagaagacagaaaccaaaggacatttcaacataaagctcggtataagctaagaattta

SEQ ID NO: 229468 - DNA, 1052 bp, Homo sapiens
taaaattgccacccgaaatgtagaggaagaataagaggccaggattataggcctcatcttagagagtcctccccttgggtttacttgggtgatggtagccacagcagatcctagggcagccctgattttgccttggaagtccattaatggactttccaacacacaggtttggatgaagtcttcaagatgctctggaggcagcaggcatcaagtcacggatggacagctggaagggacctttgagatactcctatcctgagcctagaggaagtcaggaccccagacgaaaggcacttttcccagggccctagagttggtggtgaccctgagaccagaacccaggtctctcagctcccagtgagacatcagtgaatatcacgtcacgttctatgagagtccagatctctgccattcattagttatatggcacagggtacatttcttcatttgttaaactgtactgttagtctgagccacacacatgcattgaagtccaggcatctgaggttctcttcttattaaatagtttcctatataacacgttcctatattaacattccaattatatgcccgtaattttccacttcccttccaacatgttttccctctaagacgtttttaatagtttcctttagcaaaaaaaacgaggagcatttttatgggactatgtatgagtaattacaacattctctgagattcccaggtggaaatgataatgcatgtggaaagtagcattatgggctaatgtatattagaatttcatgtttaatatacatcaattatattaaacgtaggaatatcagcctaacttcagtgtttgtatcttcattgttcaaactcgtggtatattactttaatacctattgaagctgatttcagtgtaaaccataacaggaagtaagcaatttccttttattcactaaaaaataaaagggtgtattagtgtgctcatatacatgaaagagcattgtatcttgtagtagccctgaatcgacgtcagcttcctaaatttaaaatgctgactgaacctgtgtgaggtggtggaaagcaaa

SEQ ID NO: 229469 - DNA, 1136 bp, Homo sapiens
cccttatatattatgaagatacattttttgtgactatcctctttatatgtattgtgaagataaggttttttatagtgaatatcctcctaatgctactagtattgtttgcaatctgtcattattcttagtgtaaaattaaacttcaacagagtacctgtgtgaactcttaacaatttttgaattagtgaagccccaaattaatgatgctttactagatataagggaactggaaaggctgaaatctcaaggtagagtcaaggcagtaattcctagcagcctgtgtttctcggtgttcttcatgcttcacagaggttggaattcagcttctggtttaagttgtcttaatcttgaccacagtggtaattttactttcccactcttttttcctcaactagaatgactcggagagttgagctaacagaggtagaatattgattcgtgagataggttcttagagatataagtgtgcgcatggaagaaggaggaatggcgtggaagagcaggtggagacggccacagcagggcttagaaattccctctatccaaagcctggttgtgaggaatttgatagaaaggattgtgtgggctaagacatcagtttttatggtaatatttgagggagaaaattgagatcttggaatgcatttgaaaaaaagattagttttaatacaattatcactttacctgagaccacatctcaaaatcaaaatcagtgataatgtctttgcattaatgttggaaagacttatgctacttctgcataattttctggtaaattatgtaatgagtggtcagtataatagcatggttattgtgaagggtaagatagtatgtcatttttttccctcttaacatgtaaaggctattttccatattatacatacattaatatttatatgtgaatgaacaaatagaaatatcatcaagtaaaactgaaggagttgatttgggttatttcttgtgtgaaacggatgaaaagaaaaatattagaaaatttgattacgttatgaagtaaacaaaatacagcttaatgaatgtgaaaagataaactagaaatagacatttgtaatgcatataactgacaatggattactatctagaatagaaagaattctcacaaatacatgtaacccagt

SEQ ID NO: 229470 - DNA, 436 bp, Homo sapiens
ctttcaagaagctgcccccaagtacttagcagtatgggagataagtcacctgcactaagaccaccctcatgatttgggtgctgacagatgcatcaagtctcaaggcatctcagttttattatcagtttttgtttttttaaaagaattgggctgggcgcggtggttcacacctataatctcagcactttgggaggacgaggcgggcggatcacctgaggtcaggagttccagaccatcctggccaacatggtgaaatcccatctctactaaaattacaaaaattagctgggcgtgggggcacacgcctgtagtcctagctactcaggaggctgaggcaggagaattcttgaacccaggaggcggagggtgcagtgagccgagatcatgccactgcactccagcctggtgacagagcgagactccgtctctaaaaaaa

SEQ ID NO: 229471 - DNA, 509 bp, Homo sapiens
gtaatttggaccactgtgtggcattccttggcatggttttagcacgctcattttgacccagtcctctgcttgtgggcattacagttttcagcgttcagctcttctaaacagcacacctacaggaaagtccttccttagaatctgaaatgtttcctcaggatactttcctagaaatggccttgctaatgtaaaagtgtgcagatttttttttttaaataggatttcactctagtgcctagactggagtgcaatggcctagtcaaggctcactgcagcctcaacctcccgtgctcaagcagtccttctgcagtctcctgagtaggtgggactaaggtcatgagccaccactcctggctaatttttaaattctttgtcaaggcagcgtctcactatgttgcccaggctgagatgggaggatcacctgagcccagagggttacggcttcagtgagttaggatcacaacactgcagtccagcctgggtgacagagtgagaccctgtcgcaaaaa

SEQ ID NO: 229472 - DNA, 593 bp, Homo sapiens
aggggaaatgggctggtctattactgtgacattgggaagggaggggctaggttttttagaatatttgaaaatagaattgatagggtatgtttatagatgggtagaaggaggaacttggagacaaaaatgattttgagatttccagattgagagaaaggtaatgctgcttatccacgacagaagacttaggaaagaggaagaaagtttgaattgtttaaggactgggggaagatggagatttataaataattaataatatagagcttgagttgtctgctttatattgccctaaatattatcttatttataaataaaatcttgcttagtatcctgtaagtattagtaatggatgtttgcatttttctattagattcagaggcctcagtctggaaaaagtactgagatggattagtgatgtctgctatgatcagaggagtgtgagttggtagaatttaacttaacacttactgagtacttaatgaatgccaagtactgttctaggtgctgggatacaacagagaataaaacaattttaaaaaattccctgccttcatgaaactaatgtcctagtgtttgtttggagaccataaaca

SEQ ID NO: 229473 - DNA, 223 bp, Homo sapiens
taacctggaacagaattacactgccatatatctgtatgatgggctcctttaaataccttagggcattaagaattgcttgtgtttgcagaagaaaacaaggaataatctccctctaatggggagtgagggtcactgagggtggaggactccaccttaggacacggtcagtgttgccaagaggaaggggtacaagccagttacttctacattctccagggttctg

SEQ ID NO: 229474 - DNA, 588 bp, Homo sapiens
tacccaagtagagtggattcataagaaaattctaaattatagcatatgttgaactctgagaagcctctggaatgaagtcatttttccctaacccctgtttcctctttatattggcagtggataaatggaaagtaagttaactctactgtaccaaagctagttcaatatagaaaacaggttctacaaggattaaggaacatctcttggcccacagaagattcatgtggatcctgtgttaaacccgtttcatccatgtatgaaagtgattcaaccgttaagttagccatttattatataaattgaatacttcttccatattgtggcttttagatagattggcagacctgtccccaaccccttccctgttgaccatggacaatggagggtttgctgtataaacttgattgaagggtttgcctttagctggggtggattactcagggacctcaaaggtattggtgatgatttatttcttgagcttggtggtgagtatgcaggactgtgttttgttttgttttgttttttagcaagccttacacattttcttttgtatgcaatatttaataaaataattttggataatttggt

SEQ ID NO: 229475 - DNA, 457 bp, Homo sapiens
agaggcagagaatgggtttatgctgccgcaagccaaggttggagctgccggcagccggaaaaggcaggaaagaattcttcccaagagccttctgaggaagcacggccctgccaacaccttgatttcagacttctaacctccagaactgtaagaaaaagaaattctgtgttctaagccacccaggtttgtggtagtttgactctcttcactccaccctgtgaggggcatgatgacccctattttatggataaggaaattgaggggcaccagtatttttctgcttcactcctgtgggttatctcactacctttctgtggagaccactgttctagatgatgaattcctggaaagtaagacctcagcctttccatctttgctgtcgcccagccccagcacagtgtcccaacagtgcttgtggaataaaaattatgattgtataaattgaattcatgattcc

SEQ ID NO: 229476 - DNA, 414 bp, Homo sapiens
tttagtatagacagggtttcatcatgttggtcaggctggtctcaaactcctgacctcaagtgatccacctgcctcggcctcccaaagtgttgggattacaggcactagccaccatgcccagtctatcacacacattttaaagcctgcacaaaatgttgaagttttaaaaggaaattattaaatattaaattattaatctgatttaaattattccacaggggcaccagtatttttctgcttcactcctgtgggttatctcactacctttctgtggagaccactgttctagatgatgaattcctggaaagtaagacctcagcctttccatctttgctgtcgcccagccccagcacagtgtcccaacagtgcttgtggaataaaaattatgattgtataaattgaattcatgattcc

SEQ ID NO: 229477 - DNA, 401 bp, Homo sapiens
agtattacctccagttcactatttccaaaactgcttcatatcagctcctcgtgttctccctgccattcccaacctgaaactcagtgaatggtgccatggtttattcagttcacaagttaaggcctggtgcggtggctcacacctgtaatcccagcactttcggagccgagatgggtggatcacctgaggtcagaagtttgagaccaacctggccaacatggtgaaaccccatctctactaaaaatacaaaaattagctgggcgtggtggtgtgcgcctgtaatctcagctattgggaggctgagatgggagaatcgcttgaactggggaagtagaggttgcagagtactgggatcgtgctactgcattccagcctgggcgacagagagagactccgtctca

SEQ ID NO: 229478 - DNA, 477 bp, Homo sapiens
ctatgttggtctgcgagaaatcaaacttcgaacaggacaagcccgaagcccgcttctccgggagacggggtgccacaattgcaagatctcaggtccgggaggcccaatttgatgagctcttgaaccaaatgaggcatcgaagccatgaggaaatactaaagtttcatctaagaaaggccaaagattttctgaagaacatgaaatccaggtcggctgacgagatgccaaaagacagaaaaggctggcctgaaatttataattatggtcacaggcagcccactcaggtgcctagcagcttagtcagcaagctaaggactaaagttttgcctctaacttaagggagtcttgtggtcctttgtagctttgctctcagcccacatagaagctttaaaagagaatgttgaaacgtttgtagaggatggttttaaggcaatgtactttaaagtgtgacataaattgtgtgttgaaaaaagtaaa

SEQ ID NO: 229479 - DNA, 464 bp, Homo sapiens
gagaatcaaaaatatttgggggaaaaaaatggatggtagcatctgtactgaacatgcacagatttttttctcgtcatgattccctaagtaatataacaactatttatataacatttagattgtatttggtattataagtaatctagagatgatttaaagtatatgagaaggtatgcataggttatacgcaaatactacactgttttatgtcagagacttgggcatccgtgcattttggtatctgaggggaatcttggaaccaatcctccatggatactaagggacaattgtaatgactctcctcacctttaatctgctctatagagatcctcagggccactttttatggcagtcacaagcaaagctgtgctttcagaagagtgaagtcttgagttataatccaacatttagcttttgtgctcagcttaatacagattatttcccttagcaatctaagttttgtg

SEQ ID NO: 229480 - DNA, 101 bp, Homo sapiens
agttaatctgtatactagtggactcagacattagagccaagtttgccactaattaaatttggaaacttgagcaaaatacttagcccttctgtcgtcttctc

SEQ ID NO: 229481 - DNA, 328 bp, Homo sapiens
tatttgaaagatcctaaaagtggtgaagatggagtaagtgtttggtagggaatccctgccctggctgatcattatgtctgccttggctgtacatgtgatcttggtggcatttctggactatcacccagagaggtgggttaagactggttaagaccgcagagtcagaccgcttggagttgaatcctgacaccaccgcattctagctgtgtgactttagaaagtcccttagcctctatgaaatttagtttgctcaatcagaaaaagagaataatgacactgttcatcttacagaattgttgcaaggattaaataaactatcagatggaaa

SEQ ID NO: 229482 - DNA, 655 bp, Homo sapiens
ttattgaaaaaaatttataaatctagtgtagcctaagtacagtgtttaaaagtatagtaatgttctaggccttgacattcactcaccgacccacctcaagcaacttgcagttctgcaagctctgtacaggttaagtgccctttacaggtatctcatcttttatcttttatacggtattttcactgtagcttttctgtgtttagatatgcaaatacttaccattgtgctacactcacctacaatatttagtgcagcaacatgctgtacaggtttgtagcctagggctatatcatattgcctgggtgtgtagtgggcagtcatctaggtttgtgtaagtacactctgatgttcccacaagggtgaactcacctaacaaggcatttctcagaatgtatctgtgtcaagcgacacatgactgtaatttagttttgcctacttttgaactttaagtagaaccatacaatttgtattttttcttctttgaagggtaattttttctttgaaagctgaaaatgattttctcttagtcactaaacagaaataatgtgagattcacccatgtcgctgatgtcattgtaattttaatttgttcattttcattgctgctgttacatgccattgtacaaatatatcacagtttgtccattctaatgtc

SEQ ID NO: 229483 - DNA, 294 bp, Homo sapiens
ccccccacccctccccacttagtctctggtaattactgttccactacctgcttctacaatatcaacttttgtatttgtttttctgtgtttgacttatttcacataaaattatatcctccaggttcatccatgttgtccaaatgacagggtttcattttcttttatggctgaaaagtattttattgtgtatatttaccacattttctttatgtgtttatccattgttggacactaatttgattccatatatgagctattgtaaataatgctgcaataaacatgggagtgcagata

SEQ ID NO: 229484 - DNA, 426 bp, Homo sapiens
ttttaatgaaatccaaattatcaattctttctttcatggattgtgtctcttagtattgtattcatgatatcatttgtttatctattctgcttaggtcgttttgccttttttgcctttatttttaggttttctttatgtgaaatgtttattttaaattttgttcattttaataacttagaagactttcattttctgaaacttttatttattagtattattattccactttcttagtgtttttattgttttggaaatgatgggagtctgaagtttgctgtttttctctggatctcacccttggagatcatacacacacacagacacacacacacacacacacagacacacacacacacacagcaggctggttaaagaagacctgagaaatgaatgtagacattcatttctcactggaggaagtcctca

SEQ ID NO: 229485 - DNA, 565 bp, Homo sapiens
ttgctcatcttcgccacacggtggcggtcttatcacatgcttagtgcctgctcttttcctgcttgcgctcaaggcggtttcggaggggtagggtatgccgtttgtcccttgcaaatcccaggatgccctacatccagaaatctggccatgcaaggcaaagcccacattttgtcaccagccagcctgggttcaaatgccgtttaagagctgtgatcgtctctgggtctcttcagcagtaaaatgggactgcaaacccagatcaccatgcacgtggtaaaatttgtaggagataagttatgtgaagctcggggctgaggcccctgtgtagggcccagttcctagttcctaagacggcttcctcgagctgaaaggaacccagcccagtgtagtcttatggggaagagggtggggacccagtcttaagagcagaaccaagaatgagagcctgagctacgtgcagagtgcagagtccctgctgtgagctctgccccaccccaggctggaaaggttgcctgtctgcccctggggtgggagggtggcagttaggctagaaggcaggtattag

SEQ ID NO: 229486 - DNA, 80 bp, Homo sapiens
tggcacccttgtctgatgagtggcccctatgaagaggccatgaagttgaggccgaaaacattgtcacatatggaagaaca

SEQ ID NO: 229487 - DNA, 415 bp, Homo sapiens
catggagtactatgcagccataaaaaagaatgagttcatgtccttgcagggacatggatgaagctagaaaacgaaacaccacatgttttcactcataagtggtagtagaacaatgagaacacatggacacagggaggggaacatcacacactggggcctgtcggggggtgagggttaaggggagggagagcattagaacaaatacctaatgcatgtggggcttaaaacctagatgacgggtagataagtgcagcaaaccaccatggcacatgtataccagaaacttcacattctgttcatgtatcccagaatttaaagtaaaatttaaaaaaagaaacgtactggaaaatctgaatagaccctctgctggaagcattatgaaaagtaaataaatggatatactgcatcatcctca

SEQ ID NO: 229488 - DNA, 431 bp, Homo sapiens
cagtttggctgatttcaagctaccaatgtgaatttactgcaagtgaattaggaagagatacatgtagcactctattatgtagtgtttccactctacaaatacaataggtgcaaataagcttaaagagtatagataataaaagtataagggccgggtgcgctggcacaagcctgtaatcccagcactttgggaggctgaggtgggtggatcacctgaggtcaggagttcgagaccagcctggccaacatggcaaaaccctgtctctactaaaactacaaaaatttgccaggtatggtggcaggcgcctgtaatcccagctacttggaaggctgaggtaggagaatcacttgaacacaggaggcagaggttgccgtgagccaagattgcgccactgcactgtagcctgggcaacagagccagactccatctca

SEQ ID NO: 229489 - DNA, 463 bp, Homo sapiens
tgcacttctatatgaatgttagagtcagcctcccaatttctatttaaacatttctggaatttgatttggattgcactgaatcttccaaaaaccttgagggaaaatgacatcttaatattcagtcttttgactaatgaataaagtttatatctctatttacttagtttctcattaaatttatctctgtaatgttttatagttttcagtggacagatcttatacatcttctgtcatatttatccatttaatgtttattttaaattgcattgttttgtctcaattgccaattgctcattgctagtataaaaatacaggtataatgatctatatccagtgccattgctaaactcttattagttctagaagcatttttaagattgatagaattatctgcatatgctcttattttctgtaaataaagacagttctacttgtctttttccaatctgaaggccttttttga

SEQ ID NO: 229490 - DNA, 269 bp, Homo sapiens
agggccacaccatagttctagtattttttggaggtggggccaggaatgtacattttcaataagctgattcttaccagcttataagattctgacacacattgaagtttgggaatcactggttgaaaggacagtgctaatgagagcaaagtcacagatttgattccaaataggctaggtaggatccattgtctaacattggccatccaacttgtgtcataaggttctaaggcgctaaagaaaggataacagaagaccccgagaaaaaaaaa

SEQ ID NO: 229491 - DNA, 187 bp, Homo sapiens
ggtagaggttgcagtgaaccaagatggtgccagtgcactccagcctgggtgacaaagtgagactctgtctcaaaaaataaataaataaaataaaatttaaactgaaaaaaaggcggggtgtgatggcacatacccagaaatcccagccaccttggaagctgaggtgtgaaaaatttcttgagcccag

SEQ ID NO: 229492 - DNA, 536 bp, Homo sapiens
gtattgaaaaagaaaatgctgaaaaaatgatggaagtatcaaaagctgacctaattaaggataaaggaaactcacaggattatgtggcctggaagcttttgcaaacattttacattttaaattttgtttgttacctttgtaacctccttgtttttccttcttcctagagatgaatcattttctgaatataaacacgtttctggaggtactagttaaagactttaagcagtgaaatatgcgaatactgtgtctggtttgagtctttgagaaatgcaaggatttagctacattaacaattctctagccaccactgaaggagttattttttttagactagtttattgaagtgaggaggaaaagaataaagtttttttttttttcctttgagatggagtcttgccctgtcgcccaggctggagtgcagtggcacgatctcggctcactgcaagctccgcctcccaagttcacaccattctcctgcctcagcctctcgagtagctgggactacaggcacccgccaccacacttggctaatt

SEQ ID NO: 229493 - DNA, 365 bp, Homo sapiens
cagatacttgagttgtttctaccttttggttattgtgaaaaatgtagcaatgagccctggtgtaccagtatctgtttgagtccctgttatcaagtcgtttgggtatataactaggagtggaattgctgagtcatatggtaattctaagttctaagaattctaagagcattccaatttctccactttgtcattaatacttgttattctctctgtttttgattctagccattctagtgagtatgaggtagtatcttattgtggttttgatttgcattttcctaatgactaataacgtcaagcatcttttcatgtgcttattcagctgcctattttcataaataaatgtttattgaaacatgtccaca

SEQ ID NO: 229494 - DNA, 412 bp, Homo sapiens
ggagaatcgcttgaacctgggaggtggaggtttcagtgagcccagattgtgccactgcactccagcctggtgacagagtgagactccatttaaaaaaaaaaaaaaaaaagaaaaagaaaaaaagaaaaaaaaagaaaatacacagaggagacaaaagaaaaagaataaaaaaggttgaagcacacctacaggatctagaaaatagtctcaaagggcaagtcaaagagttgttggccttaaagaaaaatctcatgaagaaaagcccaggagcaaatggcttcacttgtgaattccacaaaatatttaaagaaggattaagactagttcttcacaaactcttccagaatgtagaagagaagctaatacttcccaactatattttgtgaggccagtattaccctaattgtggacc

SEQ ID NO: 229495 - DNA, 590 bp, Homo sapiens
tcaagcattctcacacttagaggtaaacaaacacacaaagccacaggcatgagactgcccacactgtctcatacgggctcttaatctctgacaagcaatgggctatgggcaagcattcctggcttcaggcctgggtcctcatgccattgattgggcaacttggctttctcccaaaaatgaatgcgggcaatcttttatcagaaaggccacagcagcagatgtgaaactggagcatcctgggtcaacccgcttaaaaacagactcccctttcagatagaggcagagagagtcctgttgggatccttagccctttgtgatgtcatgggaatctgtggcaacgtggtggcctttttgagtccccctaagccacatcctcccacccctgcctgtgtgaaagccaggacagcctgtgcagagtcagacttgcacgagttgctgagtgtgctttctaagggatacacctgcctcaggtcctgtggctccctgttgagcagtctgcccgttctggtgacctccatctgccagcccaaggcggtaaactacctagagcctttgggaggactcctagtcctgcagtaaaaccttgtgta

SEQ ID NO: 229496 - DNA, 548 bp, Homo sapiens
atatttttttaaaagtacaactacaagtctgcaccttcaactctcattctgaaaattcctgaatatttatttaatttcaagataaaaatcagcatggtgtttctaggttgactcctaggccttctcaaaccagttcaaaccagagtttaatgcgagaggctcagcagatttctgctttgttgtgagtcactaaaacgtgatgacctcagcagccataaaccaaaggtaatgagtatcccacagagagaaggcagatgaagggaatgtacaatatgatcctcataagactttctcattctaaaatgcagttctattctcattttctttctcctatgagattctaagaagcaatcccggaagaaggcaagaatcaagatactaagctctatcttccctactcatttagggtaaaataatttcctacacagttctacagtttatgtgtgtgtttctaactgacctatgcaaccatctgccagttgctgattttacacctttttcttcgcataaaatataataaactaactgaaatgcagccactttgaaaa

SEQ ID NO: 229497 - DNA, 319 bp, Homo sapiens
gtttattttaatgtttgtgcaataacgtccagttttaccaagcagaatgatgtgcataggagcttttatgcagaactcactgttcttcagttagagcttattactctaatagtgaaatcaaatccatcttcagttgctacatggctttgttaaacagttaaacttgagttggagatgctctgtcgtagggaggaattttcgctccacagatgtgttcatataatgtattttcccctttcccctatggaaactttgtggaaagattatttcagtgttaaccctgattgatattttagtaattaaacaagtgtctgttact

SEQ ID NO: 229498 - DNA, 377 bp, Homo sapiens
tctatgtgtccatatgtcctcatcatttagctcccacttataagtgagttataccattttatactttttgatgtatatcatataatagtacaactcatttttatatttaacatctttaaaagtactgtgactgatttttcccacttattcattcaagatattaatcatctgaaacccacctacactgtgtctctacgcttatgcaggctctaagatcagagacctaaggagaataggttatgctctcctgctgaggggatcaatgtctcagttatttcaggttgccataacctagaagctggcaagtccaatatcaaggcactagcagattcagtgtctgctttatgcacattctggttcatggagtgacactgtct

SEQ ID NO: 229499 - DNA, 387 bp, Homo sapiens
tctatgtgtccatatgtcctcatcatttagctcccacttataagtgagttataccattttatactttttgatgtatatcatataatagtacaactcatttttatatttaacatctttaaaagtactgtgactgatttttcccacttattcattcaagatattaatcatctgaaacccacctacactgtgtctctacgcttatgcaggctctaagatcagagacctaaggagaataggttatgctctcctgatgccataatttgggtagtatataaataccagaagtttattttttgtggttctagaagctggcaagtccaatatcaaggcactagcagattcagtgtctgctttatgcacattctggttcatggagtgacactgtct

SEQ ID NO: 229500 - DNA, 761 bp, Homo sapiens
aatcagatgcctagagggacctgaatgctacaacctcggagagagaataggggagtgttggtgtttgtggtgaatcggaaagcacgtgtttaaagaggacaatcacattaattcagttccagctatgagattacattgtcaaatcatctgatttttcaagagaaatcacaaatttgaatttcttaaaatgagaaatctactttttaaataatgacgggattttcaagtatgttaaaaatactgtaggctaataccgaataagctaagcaaaacttttgtggatcaaaccgaaaccatgggctattttcttctcctcctcttcctcctccttctcataggaataaaacaactaaatataatcctgtctttataatttccatataccaagctttaattatatttaatacccatcaaagttagttaaaatgaactctgagtaatttataccttatggaaaaattacggtgttctaagtctgaccaaatgtgtagaaagtaccatattatctttggatatgccatctatgtctgctttgccccactatactacatattgctttagatcagccactattttacatttatttcaaaagaaattttgcatacccttcaacacctagcactgttatatatgtggtcagtgcttaatgacttggagtaaattagtggtaaagtaagggaatttaaaagtagcattttcttctttccacctccacaaacaaaatcagaatctaacttcatggaacatttcatctaatttgt

SEQ ID NO: 229501 - DNA, 473 bp, Homo sapiens
ttcctctctctgccccttactaaaaaaaagatgtattcaggcaagttatttaaaatcatgtgccactgttttcttacctgtaaacttggacaaacaatgctttttctgttcacctcaagattatgagaatcaaagcagtctgtagaggttcttggaagatataaaaagtgttttatgacttttatatagaatcattcttatacaagttgttaatatttaacatataatggacaaataagtacttcattttatattggctgaatttgtgctcaagtagaccttgaatgttatttgaacatttttggaaggatgttgttagaggtattggtttgggaataaaagtcccagtgaaatatctattatttgcactttactatgtttcatttcaatgttattactgtactgaaacaatgcatcaaaatacacatttggacaatctaaacacttgaataaaatatataattaacagcatt

SEQ ID NO: 229502 - DNA, 552 bp, Homo sapiens
ccagccagtccacagaggaggcaccattcaacctcagctctgtctaacccacgtctcgctcctaactagtgtgccctgctgcctccccctctagcctgtggccttcttgtgggtggtaatatgtcttgtccccagctgtgtcccctgatcccagcccagaacctggtataggacaggcagtggggaaatgctgtggaagtcatggaggcctgcatggaggaggtggtgtcttagtgggccttgaaggatgaacaggatttggatgtgtttcagtgagatggtgatggagcagcagtcatgaagccatcaatcctgaggcagtgagtgctgccactcactcacggggatgaccaggctacgtggtcttttgtcccccagcaggcgagcctggactcatgcaggtggcatctcggtgggaagtgcagagggccgcatgaagtctgggtgaaactgccacggcattctcttgcccagtggaatcagaagggttattgctgttttgttccctgctatgtcctcagtgcttaaaaaggaacataataggtgctcaaa

SEQ ID NO: 229503 - DNA, 567 bp, Homo sapiens
gagtagctgggattacaggcgcatgtcgcaatgcccagctgagaatatttgtatttttagtagagacgaggttagagtcgtagaataattttttgtgtttttagtggagacggggtttcaccatgttggccaggttggtcctgaactcctgacctcaagtgccttgctcccaaagtgctgggattacaggcctgagccacggcaaccagctcagtgtcctgactttgatattgtactatagctatataaaatgtaaccattagggaaaactgggtaaaggatacaggggacctttctgtattatttctgcagcattctttgactccatacttattatattttttaagccaaaaaagcattccttcatgcctagcttgtagctgcacttttttaggtgcagtgatgaataccagagtgatcaaaagatgccctcaaggatgaaagtctcattagagagagcagttttaacagacagcaataacaatgccttagtgctataatgaatagttattctatgacatactttttagtattgtttgaaagtttctacagatgtgctttgcaatc

SEQ ID NO: 229504 - DNA, 448 bp, Homo sapiens
  misc_feature (18)..(18): n is a, c, g, or t
atgaccttggctcactgnaacctccccctcccaggctcaagcgattctcctgccctcggatcctaagtagctgggattacaggcatgcgccaacacgcccagccaatctttttttatttttagtagagatggggtttcatcatgttggccaggctgcaaagacatcgatctaaaggcagtttggtttcccacagcactgatgccagcaatgttctaccagctaccttgctctaaatttaaatatcaggcaccttaagaagacaagtaggcaagacccaacgctatcagtttattgaactgccaacttccaatactaaaaaaatactaaatactaaatacagaatacttacaccaactgataaccaagtttgaccttgaaaattatttatttcccaagtagcattctgacctaaaaaaggtcaatctgagccttgtctttttttcactc

SEQ ID NO: 229505 - DNA, 133 bp, Homo sapiens
actgcctaaagcaatctataaattaaatgctatttctaataactatcactgaaactcttcacagaactagataaaactattttgaaattcatatagaatcggaaaagagtccaaatagccaaagcaatcctaa

SEQ ID NO: 229506 - DNA, 1148 bp, Homo sapiens
ctcccagggacatgcacaccaggcttgccctttggagcctctcctgaccttggccagcgtgggagctgctgttcctgggaggatccgccacctgccccaggcgctcaccagcctggcttccacagctgctacccacaggggctgccggggcctgcatggcgtggcgagggtcagggatggtgagcgccccacccattccttcatccatcacctaataaatgtgctctgagggtcccagtccccactctttaggccacagactgtggggatgtgggaggtcagatttaagctattttagtgcaaccaaaggtgcaggttgggggatgtggctggggcgcctgggccctgggacccgcaccctgtgcagccgaggctgttgcccgcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggc

SEQ ID NO: 229507 - DNA, 1199 bp, Homo sapiens
  misc_feature (191)..(191): n is a, c, g, or t
taggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtncaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggc

SEQ ID NO: 229508 - DNA, 492 bp, Homo sapiens
  misc_feature (191)..(191): n is a, c, g, or t
taggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtncaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgcc

SEQ ID NO: 229509 - DNA, 3047 bp, Homo sapiens
agcgggtcgagctcctggttgccttagtaacccctcggctttctgttcctggacggtggcggccgccggctctatgatggagcccccgaagcccgagcctgagctccagcggttttaccaccggctgctgcgtccgctgtcgctcttccccactaggacgacgtccccagagcctcagaagcgccccccgcaggagggccggattctgcagtccttccctctggcgaagctgacggtggcgtcgctgtgcagccaggtggccaagctgctggccggcagcgggatagcagcgggagtgcctcctgaggcccgactacgtctcatcaaggtcatcctggacgagctgaagtgcagctggcgggagccgcccgccgaacttagtctgagccacaaaaacaaccagaagctgcggaagcggctcgaggcctacgtgctgctgagcagcgagcagctcttcttgcgctacctgcacctgctggtgaccatgtcgactcccaggggggtcttcactgaatcagccaccctcacccggttggccgccagcctcgccagggactgcacactcttccttactagtcccaacgtctaccgtggcctgcttgccgacttccaggccctgctgagggcagagcaggcctctggggatgtggacaagctgcaccctgtctgccccgctgggacgttcaagctgtgccctatcccctggcctcacagcactggcttcgcccaagtgcagtgctctaacctcaacctgaactacctcatccaactcagccgtccaccagagtttctcaatgagccaggaaggatggatccagtgaaggaattgaagtccatccctcggttgaagaggaaaaagcctttccactggctgccctccataggaaagaagagagaaatcgacatcagttcctcacagatggtgtcgctgcccagctatcctgtggcccccaccagcagggcttccccctcgcctttctgccctgagctccggagaggccaatccatgccctccctgcgtgagggctggaggctggcagatgagttgggccttcctccactcccatctcgccccttaaccccgctggtcttggctacagagagcaaaccagagctgactgggctcatcgtggctgaggatctgaagcagttgataaagaagatgaagttggaggggactcgctacccaccactggactcaggcctgcctcctctcctgggggttgtgacccgtcacccagctgcagggcatcgcctggaggagctggagaagatgttgaggaacctccaggaggaagaagcctctgggcagtgggacccccagccccccaaatcctttccacttcacccacagccagtgaccattactttgaagcttagaaatgaggtcgtggtccaggcggctgccgtacgggtctctgatagaaacttcttagactctttccacattgagggggccggagccctgtataaccatctggctggtgaactggatcccaaagccattgaaaaaatggatattgataactttgttggcagtactaccagggaggtctacaaggagttgatgagccatgtctcttctgaccacttacattttgatcaagggcccctagttgagcctgcagcagataaagactggtcgaccttcctgtcctcagcctttctacgtcaagaaaaacagcctcaaatcatcaaccctgagctggttggactttactcccagagagcaaacactttacagtccaatactaagaagatgccctccctcccatcactccaagctaccaaaagctgggagaagtggtcaaacaaggcctccttgatgaactcatggaaaaccaccttgtctgtggatgactacttcaagtacctcaccaaccatgaaacagatttccttcatgtcatctttcaaatgcatgaagaagaggttcctgtggagattgtggcccctgccagagagtccctagagattcagcaccctcccccattgctagaagatgaagaaccagactttgtgccaggagagtgggattggaacactgtgctagagcacaggctaggagctgggaagacaccccacctgggagaaccccacaaaattctgagcctgcagaagcatctggaacaactgtggtctgtgcttgaggtccctgacaaggaccaggtggacatgaccattaaatatagctccaaagcccgcctgaggcagctgccttcattggtgaatgcctgggagcgggccctgaagcccattcagctgcgggaggcattgctggcgagacgagagtggtttgagggacaagcttccaatcccaaccgcttcttcaaaaagaccaacttgagctccagtcacttcctggaggagaatcaggtccgaagccatctccacaggaagctcaacttaatggagtcttctttggtttccctcctagaggagatagagttaatctttggcgagccagtgatcttcaaggggcggccctacctggacaagatgaagagtgacaaagtggagatgctctattggctgcaacagcagcggcgggttcgccacctggtctcggccctgaaggatccccaccagtcaaccctgttcaggagctcagcagccagcctttagtagctcctgggaatacccctattactccttgaccaggcccagtgccctcaaatgcctccctcacccctaaatggccagcagctcatctagacctctttactgctttggaagaagaaatatttgtctatatctgggagtggagggttcaggaacattatgcttccaactatgaagggattgagactaaaactattgttttcttagtgaaattctcatgaaagaatccccaagcctagtagtcccattatgtcaagccttgcacaatacaagccaaatctcctatatcaaaagaactgagaccttggagttaattgtagtgggaagggtcagaggcaaaggtgatctttggaacaactcactttagcattcctatcacactacattaaattgtcacctcttttagttctcaaacactattagaaga

SEQ ID NO: 229510 - DNA, 837 bp, Homo sapiens
  misc_feature (788)..(788): n is a, c, g, or t
  misc_feature (805)..(805): n is a, c, g, or t
agcgggtcgagctcctggttgccttagtaacccctcggctttctgttcctggacggtggcggccgccggctctatgatggagcccccgaagcccgagcctgagctccagcggttttaccaccggctgctgcgtccgctgtcgctcttccccactaggacgacgtccccagagcctcagaagcgccccccgcaggagggccggattctgcagtccttccctctggcgaagctgacggtggcgtcgctgtgcagccaggtggccaagctgctggccggcagcgggatagcagcgggagtgcctcctgaggcccgactacgtctcatcaaggtcatcctggacgagctgaagtgcagctggcgggagccgcccgccgaacttagtctgagccacaaaaacaaccagaagctgcggaagcggctcgaggcctacgtgctgctgagcagcgagcagctcttcttgcgctacctgcacctgctggtgaccatgtcgactcccaggggggtcttcactgaatcagccaccctcacccggttggccgccagcctcgccagggactgcacactcttccttactagtcccaacgtctaccgtggcctgcttgccgacttccaggccctgctgagggcagagcaggcctctggggatgtggacaagctgcaccctgtctgccccgctgggacgttcaagctgtgccctatcccctggcctcacagcactggcttcgcccaagtgcagtgctctaacctcaacctgaactactatcaactagcgtcacaagttctatgancagaagatgatcatgangatgatcatcctcgtgagagaaaagcttcatg

SEQ ID NO: 229511 - DNA, 744 bp, Homo sapiens
gcccgcagcagtcccctcacggaattcccccgactcgacacccctcccgcgaggataacgatgattcagactcttagcgttacagattcactctgcatctggcttctcctgcttagtattatgttgagttcattcttgctgcccagcattccatcatgcgcttataccacaatttgtttatttcttctacttttactctgtgcgcattaggtatttccagtttggggttattacaaatagcgctgctgagcactgtctagaacctagctcctggtgagcatagaggctcatttctgttatacccgttcctcacagcagcgttgctgagcacagggcgtgtgcatgttcggagtgagtgggtgctgcctgagcacctgcagcagtggttgatcctcagtcgtagttttttctgtttttaacataagatgaattgacatgaggtaacatgcacagatcttaagtggaccgctggatgaattttcacatacgtgtgcatctgtttcaccgcgcatctcttccacatatgcgtgcatccatttcaccgcggctccgatcaagacatagagcacttccagaagactccctgagacccctctccagtcatgaccccccaccctggggatgacgtctactctgacttctgacagcgtggattatttttgcctattctagaacttcacctaaatggaatcgtatagtctgttctcttctgcatctgccttttttcacccagcgcaatgtctg

SEQ ID NO: 229512 - DNA, 471 bp, Homo sapiens
  misc_feature (263)..(263): n is a, c, g, or t
  misc_feature (273)..(273): n is a, c, g, or t
  misc_feature (281)..(281): n is a, c, g, or t
  misc_feature (283)..(284): n is a, c, g, or t
  misc_feature (286)..(286): n is a, c, g, or t
  misc_feature (289)..(289): n is a, c, g, or t
  misc_feature (294)..(294): n is a, c, g, or t
  misc_feature (297)..(297): n is a, c, g, or t
  misc_feature (301)..(301): n is a, c, g, or t
  misc_feature (303)..(303): n is a, c, g, or t
  misc_feature (309)..(309): n is a, c, g, or t
catagagacagaagtaacaaaggcaatttgatgaaatttattgagacagaagactaaaaaatgaaaaaacatggtaaatataaaaatatgacggcagaagtaatccagatatatatgcatttgtaatgtccatttatatcattgcattaaatctaaatttttctgctcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaanaaaaaaanannanaanaaaanaanaaananaaaaanaaatacattacactactatttctattaaaaaataactatagtggcgtctcattatctcatatcatatatatctttctctatattatactctgctctctacttcgactttggtgggatatgtccctaaagcggctctttataatttattccgtttaataaact

SEQ ID NO: 229513 - DNA, 377 bp, Homo sapiens
  misc_feature (263)..(263): n is a, c, g, or t
  misc_feature (273)..(273): n is a, c, g, or t
  misc_feature (281)..(281): n is a, c, g, or t
  misc_feature (283)..(284): n is a, c, g, or t
  misc_feature (286)..(286): n is a, c, g, or t
  misc_feature (289)..(289): n is a, c, g, or t
  misc_feature (294)..(294): n is a, c, g, or t
  misc_feature (297)..(297): n is a, c, g, or t
  misc_feature (301)..(301): n is a, c, g, or t
  misc_feature (303)..(303): n is a, c, g, or t
  misc_feature (309)..(309): n is a, c, g, or t
  misc_feature (351)..(351): n is a, c, g, or t
  misc_feature (355)..(355): n is a, c, g, or t
  misc_feature (357)..(357): n is a, c, g, or t
catagagacagaagtaacaaaggcaatttgatgaaatttattgagacagaagactaaaaaatgaaaaaacatggtaaatataaaaatatgacggcagaagtaatccagatatatatgcatttgtaatgtccatttatatcattgcattaaatctaaatttttctgctcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaanaaaaaaanannanaanaaaanaanaaananaaaaanaaaaaaaaaaaaaaaaaaaaaaaaaaaaaaaaaaaaaaaaanaaananaaaaaaaaaaaaaaaattaa

SEQ ID NO: 229514 - DNA, 414 bp, Homo sapiens
ggcggagcttgcagtgagctgagatagtgccactgcagtccggcctgggtggaagagtgagactctgtctcaaaaaaaaaaaaataaaataaataataaaaaaagaaatgaggggatatgcttcttctaatttaatgggaaggaggagggcaagattgggcacagataaaatcaggttgtagttggctggtagaaggttgaggaaccagtcatctcatggtttttatcctcagagcagagaaggcagagtcatcatccattgagaataacagaagaaatgtggcagggcaggaggtgtgagggagaggagagatttgaaagacctattatggagaatgagacaacacagattagggacacaggaattatttcttagccttcagggtggttgagattgactatcatgaaattgaa

SEQ ID NO: 229515 - DNA, 784 bp, Homo sapiens
aaaaattacttcataaacaattttactaaaatttattcactctataaaaatgagaaactcctgtgattttaatggacacttaagcaaaatataagttaagagataagctaaataatggaatcatcatagcgtgcattttaaagccagtttaaaaattctcctttattgtgaccatcatgctgttcctcccctctgtcatcatggccaatgcagagatgattgtcaaagaaaagcaaatgggtttgtgaggaattctaatcttctagtctcctggggcccactgtggtggcttagatccaccccactgctgctgagatcagagtctattttggagctctaggcaggttctagagccttctctaattaccccaactggaattaaacaaactttacagcgttaatgaactgtgtgggccacatctgcctctgccagacacgttacagccctgctgcatgctgttaggctaccacacactaattatcctttgagttttctgcacattcttttccaaacaaggcagccctgccaacttgtcaacagggcatttactctaaaaatgaagttactttattttttgcctgagaatgcccacagtcactttctcacagacaggaatggaagcaggattgtatctttctttttttttctgcctctttaaattaaggaagagggggaaaaaaacctctgtaagctaatatataccttctctggtggttgtagtgctgcaagtttttctgatttagaccagagaagaagaaatgtcaccattctcagctggtaggg

SEQ ID NO: 229516 - DNA, 309 bp, Homo sapiens
gcattattcataataactcagatctggaagctatttaaatgtctagcaactagtgaattaataaacaaaatgtgttatacttttataatagaatattattacacaataagaaggaaaatgaaaaacatgaaaagaagtcagatgcaaaaaacaacatattgcatgattctatttatataagtgtccagaaaaggattatagatacagaaatcatatcagtggttgcctaaggctggggttagaaatggaggttaactgtgggtagccacaagggaactttccatcaccccagaaagttccctctagttc

SEQ ID NO: 229517 - DNA, 270 bp, Homo sapiens
tcggagggtccccagcagcatgaaggtccagattcccccaatagtaactccttagcacatgctcgttgggtttcttcctttccctgtctgattttccctacttcttcgcttgtacttactaggattgtctcccaagtaagctacctgcaccaaagtcctttcaccaggatctactttggagggagctctttatcagaaaaagcaacttgcttattggcatccaggttgaaaatgttttcttccagtaggcaggaatgttgataccatata

SEQ ID NO: 229518 - DNA, 408 bp, Homo sapiens
cattaatatttgcatgcacagggtgatgaattcatctttttcctttgtccagagtcacgatctctgtcctcatctcacagaaataatgtggagatgtcatggaagacaataaagaactgggatttattctccctagattcctattattgagaagatattgtatatgatcccaactctgagaagcctttttatttcagcagtaaaatggcaattgcgtttgtaaaagcagcaacttttcttaacatacaacatctttgatttatctcttatttcctggcagcttgcttttcgggtgaacttgtagcatatgctctgactggccattgaggaagtatccatagacatcctaaagtagcagacttcacacttccagttgtataggagttataaaattgactctcacaaaga

SEQ ID NO: 229519 - DNA, 231 bp, Homo sapiens
acttgcttcttgtcagagggatcttacaaagatgaccttagtgatgaagacattgtgaattaaaatcatttgttctgaaaggtgggaccaagatgtaagcttcaggaaacgttgcctcatctactttcaaggtggggctttctcattaaagtgcctatacgatgtttctccttcccagagatgaaggataaaaaaagaataaaaccatcaggcatttttgtttaactatgt

SEQ ID NO: 229520 - DNA, 487 bp, Homo sapiens
gagaaacagaagagtcagtcaaccacatttacccactttcccatttattttgtggagctaacaccagagacaaggtctgattgggcactgctttcattcaggatgatttatcattccccatatcattctccttcatcacgatggaggagaaaacttagtttctttccagctgtgcccagcttcagacatttggtatacagaacaccttcacctccattcctttcccccatgttttgggtggccttatgtcccatgttgcccaagctaatccttgtggccctggatgcacctctctttctctcaaacatgttctaaattatatggtcatcctacctgtggtgccataggcaggcatgcaaataaaacatcaacatcaactgaaaatgacattatttgttttgctaccatattatgttcacctttactctaagtatattcacattgtttgtgacccaattaataaaatatctgagactactttgtttgt

SEQ ID NO: 229521 - DNA, 547 bp, Homo sapiens
tccctagtagctgagactacaggcatgtgctaccatgcccagctaatttttaaatttttttttgtagagatggagttttactatgttgcccaggttgatcttgaactcctgggctcaagtgatcctcccatcttgacctcccaaagtgctggggttacaggtgtgagccactgcacttggttataagttgaattttaaagtagtaattttggggcatttgaaaatcctctgtggagtataagtactttttttcaggtgctctgagtactgctataatcaggggtgctaaatgtatttagtgctgacagaaatgctcatttattattgcagacttagaggtaaactctatttctataattattcatcttaaagtttaacaaaatcggaagtttttttgctgttttagaaaagtctataatgactatttgatttttatccacaaaaggctatcaagaaagagagaaaatatatttgtgtctttggctgaagagatttaaattaatttgcttacttttcagcccaaagttaaatcatggaaagggcatga

SEQ ID NO: 229522 - DNA, 643 bp, Homo sapiens
taaaggtacaaaaattagccgggcgtggtggcgggcacctgtaatcccagctactgaagagcctgaggcaggagaatttcttgaacccgggaggcagagcttgcggcggtgagccgagattgcacgccattgccctccagcctgggcaacaagagcgaaagccagtctcaaaaaacaaagaaagaaagaaaagcacctggggtgcgtctggagccgcgttctgggagccgcgcttcactcgctggtggtacagctccaaggctggagcttacttggcatttttgttgccacagaagcagatgggaaaattctaggtctgtaccttgtgtgaaaaaaggctaagtaaaattttgcatttacgtgacttctgtgtggagagcagcgtcggcttttgtttgtctttggttctgtttggagcacaactagggtagagaggggtttggaaggttaggacagcgccctcggacgccagtgagacccagaggcgccaccaggccctgaacctcatgaacctgcgcggccctaggcatgcggtgaaaacgggacgttgccctcgtcctagcaccagagcaggcaggggcaccgctgctggagagcgccaggtggctcctgcggaggacggtggcccagatcctaccctgac

SEQ ID NO: 229523 - DNA, 607 bp, Homo sapiens
acttacaggtatttttgaagttcattgattttcttccagtctcctagcgttgcagaacgtggatatttatttggtttttgtttttcaattctactcatttctctatatggtatccagaattaaaaggaagcaacttctgatggaggcagtggccctgtcagattttcacaaatgcttttaagtgcaccttgatttattttttctactcagtttaagtcagaaatgaactgagatatgaaatgatagaagcaatctttcatcacactttaatgtcatgaaaatcatctttaaatgttcttgtgtgattttctgctctgaaggtttatgtcataattttcttacaactattctgttaaatgctatctatgccacagattatattaatgcctagaaatacctagtccacatttccatggaattaaatggctttataattgaagcctaagtaaggatttaattttttagagctctcttgggccagacgttcagcttctagtgataccaactgtcatttgactctcacagttttctgtttcagtctccatttttgcaatagattgcaaaaagaccattttgtccttttcaactttgggagtgaagagacgga

SEQ ID NO: 229524 - DNA, 280 bp, Homo sapiens
aattcccagttcaccgacaccagcctggggatcacctccttgtcagaagttggaaagaggaaaaactcagccaacctgggaaggactttatcgggtgctcctgaccaccgagatgacggtcggaaagggccccatccctggagggatcttggaccttcactccaggatcaacgccttccaaattaacattcaaaaaggtttaatctgtctcttccttctccctgtagccgcccaaggacgtcttattatcaatataaggtgatcaccctttccccagcta

SEQ ID NO: 229525 - DNA, 607 bp, Homo sapiens
tgtacatggaactgcggcagactaactcctgtcaaggtgctcatctaaatcacctgtggggtttcaaaaatccatacctgcctgggtcctaccccagtgattcagattcagtatgtctggagtggagcccaggtacctgggtttctttaagttctctgaattgtcctgagcacatgaccaactgagaccactgttctcacaacagtcagacccccaagccgaccaaactggccaagcttctggcaaggatcagtgcacagttggaagtactcagccgggttctggagacactgtaagaagaccgctgcaggggtgcctcatgggaagagatggacctcctctggtggtcgcaacaggctttgtctgataatcacagcatccccctctcagggcatccggctgggtgcatggggcatgtgcaccgacaacttgaacaaccttccccagagggcagtgactgcagaaccaggacctgccctgagcattttagccaggctgtgagagggtgccctctcctggacatgctgctgctgctcacatagttccttcacttaaaaccaagtctctgaaatgataagaaaacttcaataattattctaaaaacata

SEQ ID NO: 229526 - DNA, 656 bp, Homo sapiens
atacctgattgtatttgtcttaaactgattacaaatgagaattctgaatttgaagagacttgcctggccaaggatataacaactgccaataagtggtatcacagacaaagcccaagcctctgactccagagcccgggcttttaaccagtagcctatagtcattacaaaaaatattaatagactttatttttcagaacagttttaggtttacaaaaaaactgaacatacagagagttgtcaattaccacttttcccctgcacacaggtttcctatatattttagtcactttaaaaatacctttctttgggttcttttagtattagcttttcatgcatagaaagagtgcctggaagtgaccagatggcatgcccagaagcttggtgtctgacactgctcttgatgcctcccaggcccagggcttggtagacaacctgtcctgtctcttcgagttccttgagaatcatacgttcctctggctctatctggagctgctggtccaacttccctgagtgaattggctaattcagcctaactcatgccacttgagatgaatcattcttgactatactttctaattgacttgggatgagactagtaaaggtaccgcccacatcgaaggttggaatttccttcagtggtctttctgtttgctttg

SEQ ID NO: 229527 - DNA, 400 bp, Homo sapiens
actacaggctgggtgtggtggctcatgcctgtaatcccagcactttgaaaggctgaggtgggaggattgcttgagaccaggagttcaagaccatggcaagaccttatctctactaaaaataagaaaaattagtaaggcatggtggcatatgcctgttgtcccagctacttgggaagctgagatggaaggatcacttgagctcagaaattcaagattgcagtgagctatgatcatgccactgtactccagcctaggcaatacagcaagatcctgtcccccaaaacaaaaaaggtacagaagtcttctattgtataattcgctacagccagcatgaagttactattggagaatagtctgaatgaacactatctatttataagaaatataaatatgatgccat

SEQ ID NO: 229528 - DNA, 528 bp, Homo sapiens
ctaaatatgaattcttactgatgtctccaagtctaattcattaacacaaagatcattgtagcctccttcccttgcttatctgtgacctcccacttcaacaaaatgtcatgtaattggaatcatacagtatgtagcctttcagactagctttttccaccattggccatccatttacttaatcctagtatacccctataggaaaaaactttattaactacagtacagtgcttttgtacagttcttttttactttattcttacattctccactcatttccaaagttacttaggtcagcaccttatttctccattcctttcagtgaggttcttttcatacatttgtaatatagttattttgttgtattctgtattccatcttgggcttcctgaacctcctaaataacttttttttcaatttgcataccttaagattccctcttttgtgttgtatagttttatagattttgacaaatgaaaatagtgtcgtgtgtccaccattacagtagtatacatagtagtttcactccct

SEQ ID NO: 229529 - DNA, 813 bp, Homo sapiens
ggtgctgactgccacaggagagcagaggcaaggcagccactgaatgttccagaatggagaggagggaaaacgttgtgtttaaaacttcttgtgggaaatggctacccggcacaggcacaacttcaaaagcaggatggtagaaatggaaacccgagggagagactccaaggttattgaggaaaagaatcacaagatgtttttctctgatcgtctctttattgtcctcgttcctggttgaattttgagctgaccagcagagcctgaagtctgccgattgtcgtctctacgaagcagatgactgaatacggagtttgataaatgcaagaagtcaaagccaacatctgaagaaatttcagctgggatgctgatgcagtctctcttagacgaaatgcttgctttgcttctatttcatgctcctaccaagcaggtgaaattctaaggatttagataccattaccctagagatcccagaataaaattcgagtatgaaattacagatgatcgccactgggaggccccagtgatctgcaaaatgaacttttccttctggataaataagtgaaaataaaagacatgatttaagcaagtgaattgaattataaaagatgatatgcaaatgcatcaaaagcggcaaagggtaaatacacaacaatgtaggaaaaaaaaaaaaaaaaaaaaatttttggggggggccgaaaaatttaacctttttggggggcgctgggtatgaatggtcaggtgccggagacacgggaaggggggttcccaaaaaagccgggccggggtgaacaccagggtggtctggtaggccgg

SEQ ID NO: 229530 - DNA, 425 bp, Homo sapiens
agttgctatcatgggggagtttttcaaaattaaaaagtaactcttcattctcccttgctcccagccctggcaccagcaaactacaacttcgtcactatagacttagctatctgaattcacttcacatacgtggaatcatacaatacgtgaccttttgtatcatttagtataatgttttcaagactcatctacgttttagcatggatcaatgtctcatttggtatggctgaataatattccactgtatggctgtatcacattttgtttattgattaattagttgatggaaatttgggttgatttcaccttttgtctattgtgaatagtgcttctatgtacatttacatgcaatgtttgtttgaatacctgttttcaattattttggatttatacctagaaataaaactgctccatcttctgacagg

SEQ ID NO: 229531 - DNA, 181 bp, Homo sapiens
actgagaaaatttagaaaattataattcagatgagagttgtatggccatttatatactagaagcacctgataacaaaattatttaaagtatattcctatcctaaacttctctttaaaaatcagcttctagaaactaacatttgaaaaatatttttgggcaggccaggtgcagtgactcacg

SEQ ID NO: 229532 - DNA, 930 bp, Homo sapiens
actacttggcttgggcaactgcaggggaagttgcccccaaagtgtctgtgaggatggaacatggtggaggacgtgggaagtggcgacagggaacgggaggctgattgtgaagtgcagagatttggaattgttctatcattccctaccaacaggttggaagagctatgagatgactcccgccagaggggttcccacaccttcttgtgatataggccacttctccagcaacacctccttacccactccactccctatctacaagctgaaggagggagggccctccaggggcagagagagggccacacacagctagaacagaatcctgccaatgcaggtgaagggcgctgggcactcaccagccctgagaaagaggggggcatcaggaactggcattggcaggccccaacgttgctgttgagaggctgtaactcctctgccctcctgactcttcctgagagaggggctgctttctttaaccagtcctgaatgtctctagtctgaacttgtagctgagtgactagagattttgaagttgcatagatgagtgttcaaaccttagttttttcagttgctacctgtttaacatgaggcaaattacttaacctctctgagcctcagtttttgtagctgtaaaataggggtgagtacagtaccgaccaacaaactgtttcaaggattaattgagatcgagcacataaagtatgtaagacacaatgctggcacataacaagctctcagtaagtcggtagtattatagttattattgctattgttatcatcaccgacgattatgtcactagaagacctagaggctgaacacataattgagagacttagaagaactgagaatgataaaagaaacctcagcatgtgatctacaatatggtattatttttgtttttaaaaaaatgttaactggatatctctaag

SEQ ID NO: 229533 - DNA, 152 bp, Homo sapiens
agtgtattttatttcaatttttgattccatggaaccttattattaatattgttttaactgatatttcttttgatttggtagcatatttaacattttttaaaatttctttttgcatcttaaacttcctaactgggctaacttggctcatgcct

SEQ ID NO: 229534 - DNA, 365 bp, Homo sapiens
tatgggcaagcatttaagttgagtttattaattctacagaggttatctccctaaaagggggctaggaatgacaggattagggtttgtgtttggtgatttcaaaagaaacaggaaattgttctggcttagatgctgtcagaaagatgactacttcttaatcttatctagaaggagggagaaatgaaatatggctaaagctgtaaggtaacaagattttgaagtttgtctaatttcatcacaaacacaggatgaccttgtttgacactgattttctgtgagatagtttatgttcaacaagagtaccatggcctaactatgggcaacaggccagctcccagcaacaccaaagcctgccagttattgtc

SEQ ID NO: 229535 - DNA, 385 bp, Homo sapiens
tttactaaaaatacagacattagctggtgtggtgacatgtgcctgtggtcccagctacttgggaggctgaggcgggagaattgcttgaatccaggaagcagagattgcagtgagccgagaccacgccattgcactccagcctgggtgacagagtgacactctgtcttaaaaaaacaaaaaaaaagaatccagtatactttgcaatgcagaatattgggttagatgagcctttagagactaatccagtttaacccctcctttttacaccttagtaaagtgagtcctagtgttttcaagacttgcatgtggcagagttattttttgagctcagatcttctaattcttaattgataataaactgctttggtgaattaacacccacaga

SEQ ID NO: 229536 - DNA, 2178 bp, Homo sapiens
  misc_feature (1)..(1): n is a, c, g, or t
  misc_feature (1513)..(1513): n is a, c, g, or t
ngaaaaacatgcagaacctcttcagccagtggctcccagggagtggcgggacagtaaagccccagaaacgggtgagcccaagactctccccacctaggacagttttctgactttggcatagggaggggaacttaaaaagaggcccatcatcctgcaggtcgagatggacaccagagtccagggaggctaaggtggctggaattcgcatcggaggatgaaggagaggaaggagctaaacagagagaagggccagaacctgcccaggggcgcctggagtctagccgtgttgcagtcggcccgtggaaacttactcctgaggctgggaggctctaaactgaacagctcccaaagatcaggtggggctggaaatcactgaagctgccaccagccaagtaacaggccccactgagtattcggggcgcccagggcattccccgaagggccatgccttaggagtggggctggactcggccaagggtaaagacgctgtcagactcgtcggaaaagtgcttcaagaacaagcttccaaaggtgggaaccagccgggcgcggtggctcacgcctggattcccagcactttgggaggccgaggcaggcagatcgcctccagagcagcctggccaacatggggaaaacccgtctctactaaaaatagaaaaacttagccgggcgcggtagcacacgcctgcggtcccagctgctcgggaggctgaggcgggagaatcgctcgaacccgggaggcggagcttgcagcgagccgagaccgcgccagtgcactccggcctgggcgacagagcgagactccgtctaaaaaatatatataaccgtcaccgggagaaaaaggtgatttaaacaggcctagagagttcgatcgggagcggggagcggggagcgggtcccagagagccctgggcagccccaccgccgctgtggcctagttgccaccacagcccgggaggagcccaggcaccgtcacccccgccgtttggggaacaaatggttcagggtaagcaacagatacggtttcatcaacaggaacgtcaccaaggaagatgtgtgttcatcagactgccgtgaaggagaaccccggggaggaccctggcggcgggggagctgcggaggccgcggagtccgatgttgagggagaaaagggcgaggcggcggcaagtgttccagggcctggtggggcccaggtcaaggcagtaaacctgcggccaccgtaaccactgcagacgcgggacctccccgccgtcaccggcagaatcaccagaatcctccgtggggaacggaaggagggatgagacagcgctgccgcgggccaggcccaccacgcgggccccaccgcagagtcccactttcctccatggaggccgcagttctccagcctccggggcggccgggagcagcgatgcgggggtgacagcgcggggagcggggacaccagcggggcagcgagtgtaccggggacgcagaccacgattccgcaggacccacctcacccaagacggcctgnagaggacagcgaggaagaggataaagacaatccgggagatgagacccaaggtcaccagccacctcagcaccggggccgccgcaacttcgattaccgacgcggtcgcacagaaaaccctaaaccacaagatggcaaagacacagaagcagctgatccaccagctgagaattcctcgctccaggctgggcaaatgcggctgctacctctaccatcaccccgtttagtcatcaaacaagaactaggaaattccagcgataagaaatgaacgaaaattggagctgaagaccctaagtgcttgcttttcgtccactgaccagataactagaactagctgcattatctgtggggcatggggtttccaattatttttacctaaagacgtctctttttggtaataacaaagtgtttttttaaaaagcctggtttttctcaatacgcctttaaaggttttaaaattatttcatatctgctcaagttgagatttttaagaacttcatttttaatttgtcataaaagtttacaacttgattttttcaaaaaagtaacaaactgcaagcacctgttaataaaagtcttaaataaaaacgaacaggcctagcaatgaaaggatggaatcagcacacgccggtgttgaaaacggctttgacacataggctcaatgtgct

SEQ ID NO: 229537 - DNA, 423 bp, Homo sapiens
attctttccctttccagtaacttagatttagaagttagaatagaaggtagatttaggaggtagaacagaaagttttgaactctgtggccacccttcaagtcaaaagaattaaatgcccaggaagacaacaagtcataatgcggccgggcatggtggctcacacctgtaatcccagcactttgggaggctgaggagggcagatcacgaggtcagcagtttaagaccagcctggccaatatggtgaaaccccgtctctactaaaaatataaaaattagctgggcatggtggcacgcacctgtagtcccagctactcgggagggtgaggcaggagaattgcttgaacccaggaggcagaggttgcagtgagccgagatctgcactccagcctgggcgacagagcaagactctgtctcaaaaaaaaa

SEQ ID NO: 229538 - DNA, 473 bp, Homo sapiens
ctcagcctcccaaagtgttgggattacaggcatgagccactgcacccggcccatgttgtggtttatatcagtagttcctttgtaaatagtgaacagtattccatggtatgaatagagcacagtttttttttttatccattcaccagttagaagacattgggctgtttccaagtttgggtgattacaaaaaacagctactgtaaacattctcatacaagattttatgagatcacatgttttcatttctcttgggtaaacagctaggattggaatggatgggttatatagtaagtgtatatttaatctaagaaactgccatggctgggcacagtggctcacgcctgtaatcccagtactttgggaagccaaggaaggaggatgactagagcctctgaggtgaagaccagcctgggcaaagtggttaagactcaaccgcaaaaaaagaaaaacagaaaacctgaaaacaaaccaaa

SEQ ID NO: 229539 - DNA, 442 bp, Homo sapiens
agtagagatggggtttcactgtgttagctggtctcaaactcctgacctcaagtgatctgcccacctcggcctcccaaagtgctgggattacaggggtgagccactgcacccggctactctctgctgtttttaagaatcatttccatcagttttaaaacataatgcatgttatcctatttcaaaacaagcaacaaacaaaaaacataccattcttggtaccaaatcccttcagttactgtaccatttctctgctttcttttatagaaaacctcttcaaaataaaataaataattcaacaattcaaaatgaataagaatgagtcggccattttcctgcctcagcctcctgagtagctgggtctacaggagccccctatcacgcctggctaattttttgtgcttttagtagagatggggtttcatcgagttagccaggagggtct

SEQ ID NO: 229540 - DNA, 513 bp, Homo sapiens
gagggtcattagaatatttttgtaaaacattttaaataatattatttaaaatatcaatttttaaaaatatatgtgatgtagttatacataggtactcctttgttaactgattatgtaagatctaataggtctacaatcataaggtggatgaacagaaatgcagtgttgaggtgtctgcaatgaatataatgtgattgaaagtatctggtatctatcagtggccaagtcacatgtactgctagggctactgcagtgtgttgtctatatttataatgagaggaaatgttaaatttccatttgaggttagtgaaaaataaagatgtaaattttttgtattatttgaagttcacataccaccccccgaattcgatctgtggaaccctggggtaatccaaattaattgcctttatttacaaagttattttagtaatcacaaagagagaagactgcagtatgaactggggtagctgcaatagatataacaggaagggagccaaatttgagatatctttg

SEQ ID NO: 229541 - DNA, 687 bp, Homo sapiens
cactggggaggataatctctaactaatagtggtagagcaattagattaccatattttaaacaaacgaacctcaaactttacctcatactatataaaaaaaaaacaaaaacacagtagccccccatctctgtcccttatctacagtttcactgcagtttgtaacctgtagccaacagggtcaaaagatattaaatggaaaattccagaaataaacaattcacaagttttaaattgtgtgccagtctgagtagtgtgatgaaatctcctgctgtctctttcagtcctgcttggacatgattcatccctttgtccagcatattcacactgtttagtatacctgcctattagtcaatcagtatctatctcagttatcagactgtcagtctcacagtgtgtttaagaaacccttattttacttaataatggccccaaagcacaagagtagtgatgctggaaattcaggtatgccaaaaagaaaccataaggggcttcctttttaagtgaaatggtgaaaattctcaatttaataagggaagaaaaaaatcgtatagtgaggttgccaaaatcaatggtaagaattaatcttccacctatgacattgtgaagaaggaaacagaaattcatgtggtaactgcagttttaggcatccactgagggtcttggcagaggggatcactctagactcga

SEQ ID NO: 229542 - DNA, 501 bp, Homo sapiens
ttacggaataaatctacttcagcaaataagttttggaagactcaaaagaagtaattgattttgagggttaccagggagtagaatgttgaatgaacttgaatttctattcaaaatgaataaagccccagaacaaagtctgacttagtccactgttatgtttgcttaagggtgagagatttgcccctaatagtgtggagagaccattgagagctaatgaaagagcccccagcagtgcctggtatattaccatgtgacagtaagtgccaccactggatccagaagatcttggactttcaccagaagctccacgagagaacttaaattaaagttgcagattgaacatgccaaatctgaaaatttaagatccgaaatgctctaaatctgaaactttttgaataccaacctgatgcttaaagaaatgctcactggagcatttcagattttgggtgttcggtttagggatgctcaaaccataattataatgcaaatattccaaaatcc

SEQ ID NO: 229543 - DNA, 393 bp, Homo sapiens
  misc_feature (30)..(30): n is a, c, g, or t
  misc_feature (80)..(80): n is a, c, g, or t
ctgcccggggccgggggaaggaagccagcngaggagacgcaacgtgcctgagtccgggagcggggagcctttttcatttntccatcctccctccgcgggcgccctcaaccgtcctggtccgctcaccatgcacctcccctccaagaaagggccacatgcgtgccagggacgcgagccccggccacagggacatagcagcctagaaggtataccaggaacacttaatcaacatcctgcatggttccagcaaagacattaagacagttgggactgttggtgaggacagatgatcttcacaaaccctctgactcttaagaacctgggagacctgctggagtttaccccacattcccttaattaaaaagccattaaaatagtcaactttgctgggca

SEQ ID NO: 229544 - DNA, 322 bp, Homo sapiens
tgggacaaaagagtctgaacaacagtcttcagccctagacctttcctctgacagagtctaccaaaatgagaaggaaccagaaaaccagccctggtaatctgacaaaacaagacttttcaacaccccccccaaaaatcacaccagttcatcaccaatggatccaaacaaagaagaaatcactgatttatctgaaaaagaattcaggttagttattaagctaatcagggaggggccagagaaaggtgaagtccaatgcaagaaaatccaaaaaatgatacagcaaatgaagggagaaacattcaaggaaatagcttaagttaaa

SEQ ID NO: 229545 - DNA, 302 bp, Homo sapiens
ggccggctttccaaaggcaaacaaagaacagtttgtcttttccctccccccaccaccacccgagcaggcggcgggaataggcctaggggtccggatggccccggcgcggcgcggcgccggggcactcccacggcgccccccaaggtcccgctgcgaatgcgcaggtcggggcgccggaggccgcggcagacagcgcggcgccactccggcccggtctccgtggcaacgggctggtgggaggggccgggcggtgcgggcgccttggccgctgttcctcgcgggcacgtcgctatggcaacgat

SEQ ID NO: 229546 - DNA, 506 bp, Homo sapiens
cgccttcagatcagctgtctacctgaagctcctttcctcctggctggtcactgacttctggccaccaccaagctcaccacgtggctctctttacaaacctgcttcacacacaggctgcttcacacgcatggtccattagagagcctgctcctgatggcacactttgggacacagacacaagctgtcatttgttcagacagtatgggagtgctcagatttagaaccactcaaaaatcatccacagttattgagcacctactctttgttggattctgggtcagtaaaacctgtataggacggaggtagacaggctgtgagagtagggtgactgatggaatcccgtagtcgctgtgtccagccatctaactgagctgtaggtagcgtggtaactcagtttgtattcaaaatattgcttctctggccaagtgcactctgaggtccaaacagtgagctgagatcgcgccattgcactccagactgggcaacaagagcgaaactctgtctca

SEQ ID NO: 229547 - DNA, 615 bp, Homo sapiens
atctgggggtggcagataacatcatctcaaattttcttatgttgcaactaaataagaaagttcctatttcaactatcttagaattgtgtaagaatgtatacaaatatttgatatttcccttcggtatataatgagatgagtaataataatttctatatttctcctaattacaaatttgtatattaaagttataatgcgcacttagaaatgaaccaatacaaaactgggaaattccacagtgtatcataaacactcaagtaactatgatgaagggcaagacaaggaacacctaaaacaggctagatccacctccattccactttccaagtccctaaacccttcttcgcatctcctgatataagcaatatccataatttataatggttatttcctcaattttcttcatactttaccaactaggtatgcaaccctaaactccatcgcttggtctagctactttgaacgctgtataggtgcaatcctacatgttcctcttgtttgtggcttcctgaactcaacattatgtttctgaaatttagtcacatagtgcaagcacatgtgattttttttcacttctctatactgtcccattgcatggaattactgtaatgattc

SEQ ID NO: 229548 - DNA, 836 bp, Homo sapiens
ctgttcagctaatcagggcacgaggcaaactccatcttcattcattaacaaactaatccgtggcccggcctggtgactcatgcttgtaatcccagcactttgggaggccgagggccctggagcaccaccgtccctcccctaggcccaggatgtgattctgaatctacagtcagactggaccacctctcccccatgcccccagaatgtccacaggggctccctcgcctacaatagatggattagattcctccctactcttcccacactgtcagagtctgactggtgtgaagttccggtgtttttgtgtgtattttactaccagggtcggctagataaggaggagctttcattacatcctggaagtctgtcccccgcacacacgcacagccgtcctcccttcccccaacatctgatctaattctctctctgctttgctgaggctggcctggcctaagaggattagagcatttgctaaacgggaccaggacaggcagggtcagagaacccgctgtggggagacccagggccaggatggccactagggggcggcagaggaagcgagacgcggagaggggtgtggagtgctgaggagaggcactcgtcggcttagcagcaatcaatgtccacaaagtaaccatgaagttttattcatttttaaatttacaatgtccagctaagttatgagaattcaaaagaattgaactaggttcctggaaacaaaataaacagatcaactgaattctatgtgcaagacaaacatttttttaaaataagaaatttaaaataccatgtaaaatatcagacaataataaaaatgaagtgcaagaaataaatct

SEQ ID NO: 229549 - DNA, 391 bp, Homo sapiens
aatgtggagagttatatgggctcaaccctgggttgagtaaccccattctctagcacaggaaaactttaaaaagacactctttaactgtcttccttagtttgcctcaacccacagcttctccccattcgttgaattcccagagcgaggactcaataggtcagagttttgcattttggttctttagtgtattgaattagcttcattgtgtttttaaatttctccctctttataaaattatgttattcaataaccagaagatgttctgtgacgttagatcagtttctgtcaaataatatggtttaattcacaaggtggataattaagagaaaaaatgtgatgagaaatccccaaacaaataatttttgaataacttttagcttttttattaaaa

SEQ ID NO: 229550 - DNA, 397 bp, Homo sapiens
ctattttttctattttttgtacagttggggttttgccatgttggacaggctagtcttgaactcctgacctcaagtgatccgcccaccttggtctcccaaagtgctggtgttacaggcatgagccactgcacctcgcctgttacgtgctttttaatgtctagattgaggatggtttgtcatagatgttgtatatatttacagagtccttaccacttgagaatttttaatatgcaaagatgacagtggtccttttaacttatcctctaaaaagcccaaataggattttttcttaaaagacacaagctaaatttgaagtaagtaactaaaaattaaatatacctctcattttgtttgatgttaaaatctacaaagatttaataaacattttttggttcat

SEQ ID NO: 229551 - DNA, 414 bp, Homo sapiens
ttcctatctcctcttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctaaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgtt

SEQ ID NO: 229552 - DNA, 363 bp, Homo sapiens
atgtgctagtttgatgataggtatttttcagaatgtctctcattgaattcttaaaataatcctaggaaatacgtactagtattcttcattttccaggtgaggagactaagacacagaaaaattaaataacttcaggtcaagtggtaaagccagttgttcaataatgtctatctgagatagaaatttttctccaaatttttaattattctccaacactatgattaattaaggtttaagaatgtaaggagggttaaaactagaaaagctattttggtaatccataacattaataagctaataagataaaaaacattatcttcagtgttgctgaaaagacattcaataaaacaacatttattatgg

SEQ ID NO: 229553 - DNA, 391 bp, Homo sapiens
agatattctgcttaccgtcttccactccccattccttttcctttgctcatgttgtacatctagaatggagcatttaggacagctggacctttgctaaccatccctcttctgtccttcagaagtgtgtcgcttaccagaatcctgaatatatctgtagacacagccctgggttctgtcctgttagccacgaatccgtgtggcccttcctattagtaatatatgtaccctccactaaatcccaagtttcagttacccctcacatatatttgatgatacagcaaagccctcatcataaagaatcatgctgtaatatagattccattatgctttgaatcagagcctgtcctggtatatgcagtggcgtataacatctctttttttctggaacaca

SEQ ID NO: 229554 - DNA, 388 bp, Homo sapiens
tttatgacttagccccagaaatcccactttgtaatttctgcagtgtcctggttatacaagtcagccatattcagtgtgggaaggccaaaggcatgaatgcaagagatgtgagcctcaaagaataagaacaaatagttattatttattaatacttatttgtaagacaatatattaaggtattttcatgctatatatattttactcctcagaattactgttttataaaagagaaatgaggatttttacgtaagtatcagagtaggatttgaattcaggcaatctgacttcagagccaagctcttaaacgttatgccattgtatctcaatctttagtattcttggaacacaaagaatatagaagcacaccactaatttttgtaagtttaaa

SEQ ID NO: 229555 - DNA, 342 bp, Homo sapiens
attaagaggacattggggttgtctctggctgggggagcagagaaaagggttcacaaaggaagtgacattagaacagggttcaaggtttcagctgcattgtgcaggtttcaagggattttagaggggggaagtaaaaaaaaaaaaaccctgctgttcttttttagaaagagatttggggaagaaactgctcatctaataatagtctagtgaacagatgaggacctagttggtgtaggagaaaccacatttggaagatatttgataggcagaaacattaggccttggttatagatttaatgagggagtgagaagaaggagtcaaaatgacatttaggcctttaa

SEQ ID NO: 229556 - DNA, 439 bp, Homo sapiens
ggcctcaaatgatctgcctgcctcagcctcccaaagtgctgggattacaggcgtgagccaccgtacctggtctcatgatgtattttaaaaatgtattttcttgttcctccactaaaaaggcttagaaataatgttcagtccagtggcagtgagcatccctagtgctcagattgtggtctctaaatattacttcccagcaagaggaactaggctttctgggagaaatggctgattccagctctggagtggaaaatataaatgatgaatcagaaacagcttgtcaaaccagaaaacaaggaagctgtcaaagactagtgaggttgtattcaaaaggattcaggagtctctcattagctataaatgtgacagtttggagatcaataaaaataacaactatagagggttgaaacacattcagtatattaaaatctataacttc

SEQ ID NO: 229557 - DNA, 615 bp, Homo sapiens
tatgcatttataatatggatatattataatggactatattataatatggagtattttaggaaaatttttgggcaaagatcagaggagatgccctttaccttgccaggcccctaagtaatacattatttttaagtcaatgaatgagaggattagaattctgaaaatcatttagaagtattgtttaataagtcctttttttctactcaacattaagtagtaatcaacttttacctccgccagtttttctgcttttttgctggtacgatctctctttctaaattgaatcaaagacctaggtggaactggaaacttaggagggaaagacaaaatgaggcttgttcatgatcaaattctgtgtactctagttgcttctttcccttggagtgacaggtacttttatatccaggatgattacagtgatgacatccattcttttttgggggcattgagaaggtgggcttcctaattattttacaaaggtattacaaagtgttaatatactgttttttcctctaatagttgtaacttaattacttcaggagactacgacagtgtagaatttgtggtaacatgatcttctagtgactatttatcaaatccacctgtttctagatg

SEQ ID NO: 229558 - DNA, 487 bp, Homo sapiens
tagaacctgacctcagggattttttttaaaagctatccaggtaattacgatggttgagtacattctagatgagtgtttttcaacttttgcttacaacacttggatagtttttgttttaaagagcaacatctaggctccaccaacggaaaacccaattttaattagtttagaatgggtactaggcaaaaatatttgtttaaatttctccaagtggttacaacatactagctgggtaaagaagcattggctgacacttttgaacttagtactctgttagctcctttctccacagtcttcctgatcagctggtaacaggcttctaccttgtttccaagacccacttcacaaactataccctcagccttttacctggttgcttgtttttgttcctctgcttgaccctacttcatgtctagctagtattccatgtccataggtctgcagtcctttgccttgctgggttttctctcgggcactagaattctcc

SEQ ID NO: 229559 - DNA, 519 bp, Homo sapiens
cagaccctcccacagctgctttccctgccgagcacaccttgctcatttctgtccgctcacataccacctcctccatgaagccctctgggctcacacagtcccctgggcctccctttcccagccctgatccctctgcctatgcctcctagggagagaagacggtcagtctgaaaaacaattaaataggtccaagaaagcgtcatgaatggtgaacacttctaaattggaactagagaaatctaagctgtcccactcctgctcaaaatcagtgctgtgattagctggcagtgcttgctgctggcagtgcctaatgatgggttcgtctctcctatttgactgggagacctatgacggcaggtccaggctatctaactcactgccatgtccccagtaccatggagcataggaaagtgcatagcaggtgctcagtggccagttaattaatctattaattcaactaatatttaatcaataatgacttgctgacaagccctgctccagaaactgagattgcaggaa

SEQ ID NO: 229560 - DNA, 128 bp, Homo sapiens
taaactggaaattaaatagaagtgtagtgattcttcaacatattgagaataaggacaggagatatcactgttatgggcccaaacctggcctaggaattgtttgctgtcaggaattggaactaagtagg

SEQ ID NO: 229561 - DNA, 379 bp, Homo sapiens
ggcttcattctagaaccaacttcaagatggctgcagcagtgccaggcattctgcccagatctgcactattcggaggcagaaaagggctgccagtttctagggcctaatgagtaaggaaatctttcctggaaactaccccctccctttacatgtcattggccagagaaggtcacatgcttagcctggcatacccagtccctggctaaagaactgagtatacaaaactagcctagaataatcaggacccacctgctggtgatgaaactgggagaagaatgaaaactggaacaaaaaggaggggaaatggagtgttgagtatgcagccaacagtgtctgctatgtcatcatttcaaaataaatggatattattttgcttaga

SEQ ID NO: 229562 - DNA, 567 bp, Homo sapiens
gaagaaagtaactctttcaagggaaatggcccgagctgtgggtcaggctcagacgtgggcgctgcggtcaagctgtggtgtttccatccatttgctgcaggcccaagcctgggtagggttcatcctccctggagacagaggtgggagatgtgctttgctgtcctctctggctgaagtcaccagggcagaactgcacttctgtggccggcgtaagtcacactgagagtcagtgtgacccccatgcctgcctctgttgcccgggtcctgtccctggcacctccggaggccccttcttcacctttgtgatgcaggctctccccagggtctctacagcccacaggccccaagcttcttccaccaatgagtgtgcagaatttggtggcaaaataatcattctccttatttttattatgtactcttcaagcaaatgtggtacattgaagaatgggaatgacagatcccttccatgcttctaaactctctctgatggtcagtttggagaacgttttacggtagatacagtttaagtagttttttcccatgcaattattaaagacaaggaataga

SEQ ID NO: 229563 - DNA, 162 bp, Homo sapiens
gggtttctttatgttccaatagaaatctttatagtgctattcctgtttgttaaaatttacctattgttcataaagcaaaggtcttatgtaaaaaaaaattaaaaaataaactacatagtttgaatttcagaggtttgctttcctccattatactcacttgga

SEQ ID NO: 229564 - DNA, 425 bp, Homo sapiens
agataactatagtagaaactatgaaaatatatgaaaactagttttataacctatgtcaggcctctgagcccaagctatgccatcatatcccctgtgacctgcacatacacatccagatggtcggttcctgccttaactgatgacattccaccacaaaagaagtgaaaatggccgttcctgccttaactgatgacattgtcttgtgaaattccttctcctggctcattctggctcaaaagctcccctactgagcaccttgtgacccccactctgcccgccagagaacaacccccctttaactgtaattttcctttacctacccaaatcctataaaatggccccacccctatgtcccttcgctgactctcttttcggactcagcccacctgcacccaggtgaaataaacagttttattgctgactca

SEQ ID NO: 229565 - DNA, 475 bp, Homo sapiens
cgcacattatcaggagcaactgtgggggtaagcgtcctttctctggcaattcgctctatgcccttgtacgctgttgtttgtatttctcactgtttgtaagtctgggcaacagatcgagaccctgtctcagaaagagaaaaagaaaaaaaaggaatgcaaagcacttagggcagtgcctagcactaaggatccactaaatactgttcttgcaaattgaagcatgctgcctctgacaaccttgttaatataaaagaggcccatttcccttctacctgtacctctttgccatttcttataaaggaagctgagctgttaatagtttaatgtgattggcctggcacggtggctcacacctgtaatcctagctactggggatgctgaggcaggagaatcgcttgaacctgagaggcggaggttgcagtgagccgagttcatgccactgcactccagcctgggcaacagagtgagactgtca

SEQ ID NO: 229566 - DNA, 553 bp, Homo sapiens
aagagcgaaactccgtctcaaaaaaaaaaaaaaaaaaaagaactatgaatgaatggtaaatcccccccccaaaccaaagtagataagagtaagaatcacactttttctttaatagtataattgtcctgttatagccctcaacacaagcattttactagacattttacttgaaaaatgtcttacctgtccatgccaagaaacagagaaagtatgtatgaaaatgaacaactggagaaaaaaaagtctagcccagaattgaggaagggatttataaaagtaaatatgaactgtttggtcaaatttacatatatacagaaaggaatcctagaaataaaaattgtaaatatatttttaatcataattcattatttagtaacctctaacaagtcagagattgccaccagaatataagcatccttagggaagagatgtttagggcagagacttgagccatctcattcactgctatatccctactgactaaaacagtctgtgaaatatagtaaaaatgaagaatgagacgagaaagaaaatgaattgtatttctagctca

SEQ ID NO: 229567 - DNA, 444 bp, Homo sapiens
caagtgataatgagcaatgtgaaacaaagagattggcattaaatgtaatgaaggactagaggagtgtacctaaacctgaaacaaattccaagaagtggccttgacctaaaatgtttgcatcctgccagagacccttacttataagtcaggagatacctgatgcccaggagaactggtttttgtactctgtcttacacagactaagaattaagaatgcaggtgagaagtttagaaaacttcctgatgatcatatgaaaagacattaaactttacctggtaaaactatgaaatgttgcctgtagatttctaagaaaaatgagtaggaagttggaaatatttcagaattaagaatgtttttatataattagaactctttaagctatgtaattctgaaatctgtgtgacagacttctgtgtaaacataaagaactagttatttttaca

SEQ ID NO: 229568 - DNA, 484 bp, Homo sapiens
caattgacactgaggcagctaagagtccatgaaaaattgaagagttaatgaatggaagagtcaggattcatatccaaggtcacctgatcaaggccaagcccttgctcctctgctgcctcagtagaacatcatttctttaattaagatgctagaagttgtaaccgaaatttatcacggccacacaatactacatacttcaggatttcagctacaagacatttcagaacaggcaacgctatagctttagagagcagacgggcggctgccagggactgggcttggaagtgcgttgagtgcaaagggcacaggagacttttcggcttgtggaaatggcctatgtcacgatttggtactggagttcaactgtacccatttgtcacaacaaaatgaactgtatgcttcaaaaacgtatgagtaatcatgtatgtaagttatatcttaataaggctgatttttaacaaatatattgtgaataagcttcaac

SEQ ID NO: 229569 - DNA, 430 bp, Homo sapiens
atagtagctaattgatgtaagaagtagctaagcttgagaaggtgtaagtagaatttctttatctgtgtccctcctccaccaagtaaaacgaagccatttcataatctaccatttataacttaactaattatgacacccaagtcagttctgggcaagcaagaagtatctctgggcaaagagtcctggcgtaaggttcctgggcacatctttgagtgcctgttaaagttaaacttcatatcatttccgggtaggattcagatgattataatacttagatgatatttataaaactaagtattttagctcttgaagatatctgctgtcattactgaaacaccactggggagtgtgtgtgtgtgtatacatgccagtgacacttccagtcccctttgtattccttaaataaactcaatgagctcttccaatccta

SEQ ID NO: 229570 - DNA, 507 bp, Homo sapiens
atttggttttatattttataatttctctttatatttgtgtggtttgtttctttattcttttttattctattttcaattttcaatgttttccttcttgccattaatgaaatgggattttatcaaaacattgacataaaggttcatattgctatttcctatatatttataattgtggtttttatttccttttgggtattaaagttatttaagacagttctttttaaactcccaggaggctgcttttccaattgtttgtacttgcactttgctagtcttattacattatagatattgagtgaagttttcataatttctactattggtaatttattgtttactttgttgccatacatatagccatgtttataaatgttccacatgatattcttcttttgtagttgagagaattggtagcatcgcttatccttatcctttctgttttaaattcaccataaaaatgtctctttccaaaaagtcgacgcggccgcgaatttagtagtagtaggc

SEQ ID NO: 229571 - DNA, 652 bp, Homo sapiens
ataaaaaattagccaggcgtggtggcaggtgcctgtagtcccagctactcgggaggctgaggcaggagagtcgctggaacctgagaggcggagcttgcagtgagccgagatcgcgccactgcactccagcctgggcaacacagcgagactccgtctcaaaaaaaaaaaaaaaaaaagtagcctcagtatctcattttaccttacactaaggcaatctggattcacagcagttgcatccaataactttaaaaaaaattagttttacaattgcaggatgccttttaatttatctaattaggagctggcaaaaggtaagatgattggctggattcagaatggaatctgttggcttctgggacctcctcatcctcctgcatagcaaggactcaaggagggactattgccggagtttatatcttcctcccagagtagaaaatactttaaaatgtatcacataaagcctgggcattgttaggttttcattccaaattttaaaacagttactttgaaattgttgacactggcccactttggtacaaatggtaacactgtaaacccgaattctccaaatgagcttttccacttagtaaaataagatagaagtagaaccaactgaagaacttgcaaaaaaattgagtgatcccatggccgg

SEQ ID NO: 229572 - DNA, 292 bp, Homo sapiens
gcagagagaccacacacacgcagagagaccacacacatgcagagaccacacacacccagagaccacacacccagacacacacacagacagagatactacagacacccatagacagagatatcacacacagaaacacacatgcagatacacccatagacacacagatgccacagaggcatacacagagaaacacccgtagacacaccaggatacacatacacacatagatacaccactcatagacacacaaacacacacccataggcacacacccataggcacacacacaaag

SEQ ID NO: 229573 - DNA, 1085 bp, Homo sapiens
ggaatgtgaagaaacatgagacagtagccagacacccaggaacaccttctgtcccatgctctgaaattcttttacggctctactttcccttcagtgatctttcttcaagatgacagtgacagccaaaggctttttcatagcttggaacagaccgtatgatctgattgttcttccattgctttggggacacaggaatatctgtgtatttttgagaaactgtttgttaagctattttttaagttccctttttgcattatgtctaaggcgtgtaagagcagtgggatttggctcagaatcccaggaacaccagaacagatgttacatgttttctgctttgtgatttcccattctatagaggttttaaatgtcattctatagaaatttatactcagtaattttataagaacactagacatctccctaaatgtaagaaactgttattttttattaaacatttattgttttagtataaacagagactggtaatttaaactctgccccaaattctcaactgtagtgtggtttagtgtatctgttcacttctgtattagtcagttttcacactgctaacaaagacgtacctgagactgggaagaaaaagaggtttaactggacttaactatttccacatggctggggaggcctcagcagcaagagaaaatgaggaagaagcaacagcagaaacccttgagaaagccatcagatcccatgagacttatttactatcatgagaatagcacgggaaagactggcccccatgattcaattacctccctctgggtccctcccacagcacgtgggaattctgggagatgcaatttaagttgagatttgggtgggggcacagccaaaccgtatcagcttcctagatttcttaaatatgctgtgtatttgggtagcttagagcagtgctcagcatatgtttaacttccacttgctaccttagtttataataactgtaattttataattttgtttggaatgaccggaactgttattcatatatatgttggtgtgtatacatttgtgtatatatgtacatgtgtgtaacatggattttttcacaaataaaaagtgtgtaagta

SEQ ID NO: 229574 - DNA, 199 bp, Homo sapiens
tgcagtcctagctcctggtggtgagatgccccaatctacctccttgtattctagaacacgctctcccactgcacaaggctcattattcaatggtacaaatgtacattcaagataatcacatcattattatttaattcaatagtactccagcacactcctccctccaacaaaaccagcttttctggatcctctaagaagc

SEQ ID NO: 229575 - DNA, 546 bp, Homo sapiens
cattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgcc

SEQ ID NO: 229576 - DNA, 349 bp, Homo sapiens
tgctttgtaggcctggtggtaacagccaggttctccaagctggtctccaagtcactggcttcagaaccggccctcccgtctcagctccttgaccctccaggagcccagcagactccaagcccgtcttcggatggggaaaggagacgtgcctggctgtctcaggcccctattaggtcacaaggcagccctgcctgtctgccgactaaccctgccctccctgggctgaaaaacacagagaaaggagctcggctccatctccatccctggcactcaggagccaggagccagggtgtcctgtggtgatttatgcctaatgcagcctgttttcccctctccctacggcatgaga

SEQ ID NO: 229577 - DNA, 520 bp, Homo sapiens
agtgaggtgtgtgaactgagactggtcctggggctgcagccttgtgtgccggaaccctggttagccagtcatctactctgtgaccccagtgaagtttgtatatgagtttggctaagttaataccaactgctgtatccaacaaactccaaaatttaaatgattcacacatgaaaactctttttcactcataccaaggtctgtgtgggtcagcagggaactctgtaccacacagttattcaggacctagagtccttctgtcatcaacctgttgctttaaggttgtcctgacatcttcttgctggtagagaattaagggaataaggaaagtcatacccacttccagacctcccctcacatctcacccatgggaactgggcatttggctgtacttgggtccatgagtctaggaattgtggctgagctgcctgtccaaggagaagagcagatggtctggtgagcacctactcagtccactacactcagtctgttcctgaaaaatgatattagaaattatttttat

SEQ ID NO: 229578 - DNA, 438 bp, Homo sapiens
ctgactcaagggtggtctattactcccttaccaaggtcctcctctgcagaactgtataagtggcactccaggatgttggcccttcttgctagccatggcctttgaggctccccagacacatgctaagcactttaaggaaaggggccatgtcttctctttgtatcttctcacagcaaccactgcatgaatcaactttctagcattctcctgtcactagctgtgtggcctgggacacattacttaacctctctgggctgcaggctatttgtctctaataagcagataatagaagtacctgcctcataggcttattatataaggaataattgagataatgaacgtgaaacatttagcacagtacctgacaacacacactaaataaatattacttttaatggtgatattattcaccacaataaatatattgaaaaggcatta

SEQ ID NO: 229579 - DNA, 469 bp, Homo sapiens
tattatagtagtcttggtagtgaaacatgtagatggttttgctcattttttcccaaccaatataagcttaaataaaatcctattaccaaaatttgagtcttatgtacttttagttgtctagtgtttcagatggttatctttacatcctatcttctcaaaggtatatcttgaaagcaaacatttcagccaggtggggtggttcacacctgtaattccagccctttgggaggctgaggtgagactgcttgagcctaggagttcgagactagcctggacaacattgtggtaccccacctctacagaaattttttaaaaattagctggccatggtagcgcatgcctatagtcatagtcccagctacttaggaatctgaggcagaggattacttgagcccaggaatttgaggttgcagtgagctatgatggcaccactacaccctagcttggacaacagagtgagaaccatttc

SEQ ID NO: 229580 - DNA, 312 bp, Homo sapiens
  misc_feature (24)..(24): n is a, c, g, or t
  misc_feature (27)..(27): n is a, c, g, or t
  misc_feature (118)..(118): n is a, c, g, or t
ctaaattcgcgccggcgtcggacnccnagtcagaaatggcaatcagaaaaataatggcactatttttaggagagagttggaggattcgtgggaagtaggagatggccagaacaattcnccatttttagctcccccacaaaccacagactccaacacccaatttcccttcctttttctccctcatgcccaggtacaaaatagaaatctctgtgtttattaatggatgggagggaaagagaaattgaagtctcactagcagcttctgggtcaacactttgcttgtcagggatattcaatattatctgtcgacgc

SEQ ID NO: 229581 - DNA, 530 bp, Homo sapiens
agcaagttacttaatctctgcctcagtttaaatgtcctaagtttaaactcttgttagccgtgtttgacagaggaggaaattgaggttcagagtggttaagtagcgtgcccaaagtcacctccctgcagggaggtatgaggcacgatgtaaacagatcatctccctgttcatctcctggaggactggctccccagagcgggatctccaaactcaggacaaagaataacatggagttatccaagtgaaggggaggaaggtggtggcatgaaggcagtgtttcaggcagaaaatatcgaaaatcacacgtgcaactaggcactgaagcggttccgagcgacctggagcactagatctgagctggggctggaaaattgggtgagtgggttgtgaccaggttacagaggccttataaacctgattaaggcattcagactcatgggtttttttgctgttttggggggttattttttttgaaacaaggtatcgctctgttgccctggctggagtgcagtggtgtggtcacagatcac

SEQ ID NO: 229582 - DNA, 424 bp, Homo sapiens
gtcgctttttgactatcagatgggtgaaaatgaaaatgtatgacaacgtatctggttcaagcaaggctatgaggaaacagacattctaatacattgctggtgggaatgcaaactgatacaacctttctgaggagcagtttggcaacatttaacaaaactattggtgcctcgacctgttcaccgaacactttaaggaaacctgccttaaaagatagacttctaggcctgtaatcctagcgcttcggggggccgaggcgggtggatcacctgagatcaggagttcgagaccagcctgggcaacatggtgaaagcctgtctctactaaaaatacagaaatcagctgggcgcagtgatgcatggccgtaatccaaactacttgggaggctgaggcgggagaatcgcttgaaccccaaaggcggaggtt

SEQ ID NO: 229583 - DNA, 357 bp, Homo sapiens
cggcacgaggataattcttgccacaattcagttttcttcctcgctttgaataataacctctttaaacctgtgacaactttttagtattctatagcagctgctttctgggagagactctagtgaaggaactccaagctggttattctgtgatattcatgagactttgctgggatagactttatgctgcatggggtgatactgtttgagaaactccaccgtagtgctccaacattagtgtgcttttctaagtgggtaagttactgttgcagtatgccaaggagacctggacacagtgggagaaaaatgtccagtgaagggtgttcatctgagttccactgaccgagacatttagcttaa

SEQ ID NO: 229584 - DNA, 456 bp, Homo sapiens
agctcttctttaattcccctttgcaatttttaaattttcaatgtacaggtcttgcacatctttcattagatgtatttctaagtaattctggtatgttgatgctattataagtggaattggttttataaatgttttcccaattgtttgtcactagtgtgtagaaatacagctgattggctgggtgtggtggctcacagctgtaatcccagcactttgggaggccaaggtgggctgatcatgaggtcaggagttcgagaccagcctgaccaacatggtgaaaccccatctctactaaaaatacaaaaattagccaggcttggtggcggatgcctgtaatcccagctattcaggaggctgaggcaggagaatcgcttgaacctgggacgccgaggttgtagtgagctgagatcatgccactgcactccagcctgggtgacagagtgagacgtcatctca

SEQ ID NO: 229585 - DNA, 552 bp, Homo sapiens
gatgctaggaaatgtcaccatgcaccactgtttttttatgctctgtataatcaagaaataatgtctgtgtcagtctccttacatttgactccatagtgatctcattttttctctaaaacatcgagaataaaattaggacactttggatttttttcctcctgttttcattttacccaatttcttcaactattgaaggtcagattataaaataatttatcattctgatgcagaactatcagttgagtgagttaaatgtattctttttaatgtgctttttttaaaatccatttccatcagaaactagagcttatttttttttaaatatatttctgtgctgagaaactactaatattttttatggcttatctacttagaaaaaccataggtttggccgggcgtggtggctcacgcctgtaatcctagcactttgggaggccaagacaggtcgatctcctgtcctcaaatgatccaccacctgggcttctcaaagtgctgggattacaggcatgagcaccacacccagtcctaaatgcagaattatttacagcacga

SEQ ID NO: 229586 - DNA, 198 bp, Homo sapiens
gtgggaatcataaccttgaattggttgattttccccttatgtaaaagacaaaagtcatcttgcattaatatgtcttttgactggatttatattgctcttggggatgataaaagctcagtgaactgagcatctaacaggcaatgaaagttctctgtgtatttaagactctgaattggctgtcattttactatccacacc

SEQ ID NO: 229587 - DNA, 602 bp, Homo sapiens
ggtgattcgcctgccttggcctcccaaagtgctgggattacagctgtgagccactgcacccagccattttttaaaagtctcacttttgagaaaagtaaggtgataaagcagcctgcctttttgaatcaaagaaaatctgttaattgaagtgattataacatagtttatgctattgcaataagttcttttcacaatttttttttttttttttgaggcggagtctctcatctctgtcacctgagctggagtgcagtggcgcgatctcggctcactgccacctctgcctcccaggttcaagcgattctcctgcctcagcctcccgagtagctgggattacaggcacgcatcaccacgtctgggtaatttttgtatttttagtagagacaggattttgccatgttggccaggctggtctcgaactcctgatctcaggtgatctgcccgccttggcctcccaaagtgctgggattacaggcatgagccacctgcccagcttacacttttttttttttatttttggaataatcttaaatttacagaaaagttacaagtagagtgcaactctgtactcataaactcctcatggtttcttttgttaaagt

SEQ ID NO: 229588 - DNA, 237 bp, Homo sapiens
ccttacttgctctctggattgggttttatttgatgtggggatgggaacaccacgtctggatgacctgggaccctaacctctcataaactctgagtcactgaggtagaggtgggaagagcagggcttcttcctgactgccctatttgggctttcttgctttgtttctttccttcctttctttctttctgatggagtttctctccagccttggtaataagagcgagactctgtctcaga

SEQ ID NO: 229589 - DNA, 664 bp, Homo sapiens
tttattttgtgtgtccccatgttattagttttactgcccattaatcattatatattaccaaatatagtaaagcgtgcttacgaggagatagcaaagggtccggccatgacagtcacaatgaagccatgccaggaggaagcctaggggtagcaggcagtgccccctgtcccgtccacccagacacataaccctgagcacctcctggctcccaagtgcattaagatatgttcctgcaccctatccctcctcgtcagagaaaaacctggggaaaatagttctgttcattttgaggacagatgactaaccatgctaaaaatgtatatgaagaaattagaagaaatttgaaattgtaaaaagaaaggaagagcaagagattttattagcaatgagttccattgctgcaaaatataccactctctttccctttaatttattctatgtgtgtcttccatattattttttctctgaataccaatatcatcaagcgtttactctggtaaaaaaacttcatggctttctattgtcccctaatttgggccttgccttcttagccagatttcaaagcccttcatgcctttactttatcctttctactcatgtttatttcccaccaatctctaccacattgttttttgttactagtcactccatcctcccggtgtcc

SEQ ID NO: 229590 - DNA, 429 bp, Homo sapiens
agtaaatctctgaatcaaagagattttttggagtcatcatttctccaatgagtgtcttttagatggtaagctcatcccagcctcatttttactcacatttccccccaccccgacatgcaaacagtaagtgatttcaaatacctagagaggtatttttcaaatcctttgctgttttcatagttagatagctgactgtagctacagaaagctctgctgaggtcaatattggttgttgatttcatgccggtgtctgctggactctcaggctaccttgcacaagggtttctcttcctgtgcaatggtttgtactgtgaacctcttatctgaaatgatcatcagtccttgtgtggtttgtaaagaaactagttcattttgaaatagctcaagagaaaagaagcactcattcttaggaacaagagtgctcgctaa

SEQ ID NO: 229591 - DNA, 407 bp, Homo sapiens
gaaaaaataagtagttgattctacaatcagctccaaaatcaaaccaagaggcataaacgttgattgagttgtttgatatcaggagaaattgcatatctaatcaaggcatattattagcctcaattaatctgtgaagaaaaaaataaaagtaatgggatcatctgacactgaatgatgagacaaaaaagagactgatgaagcaaaaagatttgggtgaaaggtcatgattagggtgaaaagtcatatccatacttattaaaaacctatattaattaaaattcagggagtggaggttgcagcgaggcgagatcgcgacattgcactccagcctgggtgacagagtgagattctatctcaaaataaaataaataaataaaattcaatagagggttactgcaatgctggtt

SEQ ID NO: 229592 - DNA, 400 bp, Homo sapiens
atccacacagcagaggtgacatgaaagcggtgttcctgacagaagcatatatctgaaaacagggctgcaaagttacaaatgaggcatgaccaaaaaggggacatctatgaagggtttgacttatcaggtgccttttcttgggatacaagaaaccccgtatttagcatggagctatacatttcctctttctatactagaattccaaaattttatagctttatgtgatggtttttggaagaataagagaaaaacgcagtaaaaagatgcatggcctgcctcaagtttaactgtttaagtttaattgcctctaaatggcaatatctaggagttcactcactagcagctgagttaatacaagaccaaagcagaatttgtatggttccaactcaaaatcttacca

SEQ ID NO: 229593 - DNA, 167 bp, Homo sapiens
aatatctgagaatcagctttcttatttaatctgagtaaatgaaaggtatgtgatacctggagtaatttgtttgatctcctttctgtaactgttggttttaacaattccaaagaccaatgtttttgtgaaacaatgtgaaggaattagaagacttaagacagtaagta

SEQ ID NO: 229594 - DNA, 426 bp, Homo sapiens
agaccactgctcttttataaaagttattttttctcagtgggtttttggggaaagatcaaaaacatgaaaactagccttcggtaatgatggaactgatagattagagaaaatccactttatttattgacttctcttttcttcctactccattacctccaggacaataagttctgcagtgaaattattatgtaaaaaattgcagacagacagagtaaagcttgactggaaggtggagcataaagatagcacttttaccttctccctcaaactcattgcttttctcattgtcattacatggataaggagttctaaaagtaaagcaagaggcaagatatttattcattaattttctgttcattaatcatcttctattgtgatgggggccctggaaatacagaatgaataaagcaaaattataacctagga

SEQ ID NO: 229595 - DNA, 617 bp, Homo sapiens
ccagtgcatgcagcccccagtcatgtaccccctgcttgctcaatcgatcacgaccctctcacgcagacccccttagagttataagtccttaaaagggacaagaattgctcacttgggaagctcggtttttggagtcctgagtcttgccgaagctcccggctaaataaagcccttccttctttaactccatgtctgaggggttttgtctgtggattgtcctgctatgctgtgggacaaaagaatctgaacaacatccttcagccctagaccttccctctgacagagcctacccaatgagagggaaccagaaaaccaaccctgacaatatgacaaaaccaggctcttcatcaccccccaaaaattacactagttcaccagcaatggatccaaaccaatatgaagtccctgatttacctgaaaaataattcaagtggttagttattaagctaatcagggagggaccagagaaaggtgaaatccaatgcaaggaaatccaaaaaatgatataagaaatgaagggagaaatagtcaaagaaatagatagcttaaagaaaaaaaattaaaaattcaggaaactttggatacacttttagaaatgcaaaatgctctggaaagtc

SEQ ID NO: 229596 - DNA, 283 bp, Homo sapiens
ctgtcccatcccccaggtatatctttcccaccagctatcttctatccgccagtggtcccccaggcctcagctgtcacccaccacagtggacatctgacagtgtgctgcggttttccgtctcctttttccactagtctgggagcccccgggggctgagctgtcaccccacccctagctttaatcttgccctgtcaaatatcctcagcatctccccttcctaacagccccatctcaatctttctccccagcttctgccctcaaactcccaagcctcagcggccgc

SEQ ID NO: 229597 - DNA, 193 bp, Homo sapiens
gtatcataccctgaaattaagcatgtctggtttatgcttgatatttgtaaccactgtgtaactattcttatttttctggttcttccattgtagactcccatagcagtaaatacgttacatacgttcatgctttatttttttccaattacaattataccactaaattcactgaggaaataaacattacattttt

SEQ ID NO: 229598 - DNA, 519 bp, Homo sapiens
cgatagagacagaaatgtttattttcaccgatgaccctcagtgtttgaatttttgctgttaagtctataattctataaattaaaatgttaataaataacagaacagttaatgatgtttctctcctatctttcacattttacaattttacattctgctaccaaagaaaatgttagtctgcctcttctggtgctggagggggtctcccatggggactgggtgggggggtcagccaattagccattccagcaaataacaggagggagaagtgaagggctggaaggggttatccagaggagggagagcaggactcaggggacaaggagaagcgaatagggaactctgggagccaaagcaaaaggagatcaggtccactcacagagaaaaacggcaggcctagaattagagaaaagaagccctcccacccaagaaacaactcttacacataggattacatataggatggtttgtaaagtaatctcaggggcataaaggcagaggatgagcagaaaaaaaaaaca

SEQ ID NO: 229599 - DNA, 883 bp, Homo sapiens
acatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggtgtgcgtctaactgagttgctgaagcaaggacagtattctcccatggctattgaagaacaagtggctgttatctatgtgggtgtaaggaggtatcttgataaattggagcccagcaaggttacaaagtttgagaatgctttcttgtctcgtgttgtcagccagcaccaggccctgttgggcactatcagggctgatggaaagatctcagaagaaccagatgcaaagctgaaagagattgttaacaaacttcttggctggatttgaagcttaaactcctgtggattcacatcaaataccagttcagttttgtcattgttctagcaaattagttccatttgtaaaagggttactctcatattcgttatgtacagaagtcacatgaaaagtaaaggttccataatggca

SEQ ID NO: 229600 - DNA, 742 bp, Homo sapiens
cctgaatggtattgcctaggttttcttcgagggtttttatggttttaggtctaacatttaagtctttaatccatcttgaattaatttttctgtaaggtgtaaggaagagatccagtttcagctttttacctatggctagccagttttcccagcaccatttattaaataaggaatccttttcccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtctgaagtcaggtagcgtgatgtggggcaagtttcttaaaggaggtagcgcgtttgaactgggcagtgaaagacaggtagaactctgacagctagtggtaagagaatcggggaatagtattcctgggggaaggcaggccagaatgacatgtttgtgcaaaggctgagaggtgacagtatggaggcatactcagtaaatggtgagtaaaataatgttaaagaaggaatcactaagggccacattgtggaggagtttgaatccagctgagtttgaactttatgttgacttaagtgggaagctatggacagtctttgagcaagaaattcaaatcaacagcaaatttttatcaagagactactatgtacctggcattgtgctaggttccaggaataaaaaaaaagaataaatatg

SEQ ID NO: 229601 - DNA, 613 bp, Homo sapiens
taagcaattcgatacttggttttctctggttttgtttttccagttgtgatatagtcttatcacattatgttgacctaataaacccaaattgagccaagtggctagttgggagactgagtcaagaggatctcttgtgaccagagttcaagatcagcctggacaatatagcaagacctcatctcaacaaaaatagttttaaaattagcttggtatggtttcacaaccctgtagtcccagctactcggaaggcggcaatgggaggattgcttgagcaatccatttgaggctgcagtgaactatgactgtgccactgcactccagcctgggcaacaaagcaagaccaagtctctagacaaataaacagaaacccaattagtccatgtgaacatcctctattaccagtttttttgtgtgatgtaaaattgctggtatctctaagaagcttcattttactggctatgtgttttggctatggattaaggagatttcccaaaatagttttctcttttagtacaaatcttttttaaaatacatagttaaaatgcatgtaagtaaatagcattatctttgcaaaatgaaagagctttttatttttattccagaatgtaatgcg

SEQ ID NO: 229602 - DNA, 511 bp, Homo sapiens
tgtttggtatttctgagctgacatgtgtgcacagagtagctttctttggtccagaaatgaaaaccccaggcacatagatgcaaatgatggcaggtggacaccagtcagatcacagaaccaactctgcagattaagggtagggcactttatggcatttgctgtgtttgagaaataagatattctaggatttagagtttctaaagattcaacgaaatgtgtgctttgattcatgttgctaaaattattcaaaatattatttttttaaatgttctcaagtgaattgtctggggaatataaaatatatccttctctgcaagttcaaggtcaaatgatcctttggtcctcattgtaaccataatttctcaaggaagaatatcacccatatagatggccaaagatgatgcactaacctcagagaaatattttagcactttgttcaatttcgacagaaaatgtaaagtcaaacttgtttcctgggatttgctgcattccattacaaataaattatagt

SEQ ID NO: 229603 - DNA, 348 bp, Homo sapiens
tggagacatatattattttgactgtgtgtcctctgtcattaaagatggactatactagctgggtgtggttgctgatgcctataatcccaccactttgggaggccaaggcaggtagacggcttgagctcaggagttcgagaccagcctggccaacatggtgaaaccccgtctctactaaaaatacaaaaaattatccggtcgtggttgcgggcacctgtaatcccagctcctcgggaggctgagggaggagaatcgcttgaacctgggaggaggaagttgcagtgagccgagattgtgccattgcactccatcctgggcaacaagaggaaaactgtatctcaaaaacga

SEQ ID NO: 229604 - DNA, 453 bp, Homo sapiens
agaataaacttgtctgtttctacaaaaagccatgttggtatttcgagaggaattgcaatcaacctatggatcaaattgagaattgtatccttattatgttgaatcttccaacccacgaacatggtatgtctgtctatttaaatagttttttttttcacttctttcatcagaattgtgtgattttttcaacatcagatcctatcacgttttgttaggtttatacttaaatatttcctttgctctcaagagatttaaactgttattatttttatttcagtttttacatgtttgttgttagcatacagaaatgtgattgtgtttctcatgttgatctcatatcctgtgaccttggcaaactcacctattaattttaagaggttatttgtgtattacttggcattttccatgtagataatcatgtcatctgcaaatatggagagttttatttctacc

SEQ ID NO: 229605 - DNA, 896 bp, Homo sapiens
attgaagagggtaggaagaactagttttactttatctgtattacccctccctcaaagcagcactgctcagagccaagagagactctctcacctgtaattccttctaagggggaaagcaagagcatagtaagtaagcacccagctcccccagccatccacaacactgcccaagagccccacttctttctcacctcacccagattgctgagataatcagcatggctgagagattgggagaggctgagagcaggaaagagaagctgctggccctctgaagtgttctacagactccatcaggaagcccatccacgagctgcttgagacacctcatctactgttcccaaactctacaccccccacccccagactgagtccctaaatgtgcccccatggacagtgaatgcaagcgtattatgtagacagccagctcaactctgtgggattgggagaaggtacacaaacttgagtatttcaggacaccatcctagggaaaacaaacaggaggctcttagcacctaacctagctttgcaggattgaaagaaggcatgcaaagtcaagaattagccctcaagagggaaaaagaaatgtagagcaggtgcatccatagaaaaggattaagaaagtctcattatccatagacaggctgactggtgaaggcatttctctcctgatgccagtcaataaggattggaggaggagatgactgcctccttcttcaaatgtgaagacagcatttgaagcaacaagacttcaaaggacagcacttcaaggaacatgaaaagttaaggagccatgacatcacaaaggaacacaatattccagaaagcaactactaaaaaatggagatctaaaaatgacctgacaatttaattgttttaaggaagctcagagagct

SEQ ID NO: 229606 - DNA, 501 bp, Homo sapiens
taagttgctctctacaatgaggttctagttgatactccactgtccacttaagtataagagagttttccttattctacatcctcaccaaaatggtgagtgtaaaatattattccattgaagttttaatttgcatttccatggctactaaagaagttgaacaccttttcatgtctgcaggacatttgtatttcatcttctatgaatttccaatctactgtcttattattattactggttggtaaaatattcttcatatatcctgattattaatcctttttagttatttttcctgcaaatattttctcccagatgggttatctatctcatgctgaatttcaataactgtacattttttattttaatctagacatatttatcaatctttttcttttacagttcaaatttcaagtcttgttgaagaaatcctttctaccttccctgccctagtatcataaaaacattctccgtcgacgcggccgcgaatttagtagtagtaggcgg

SEQ ID NO: 229607 - DNA, 383 bp, Homo sapiens
aaatttacttattatgaggagtcggctcatgtaattatggaggctgagaatcccatgatctgctttctgcaaaccggaaacccacagaagccagtggtgtagtttgaaggcctgagcgatggtttccagtctgaatctggaagcttgaaaaccaggtgcttcaaggatgggagaagattcatgtcccagctcatgcagtcagtcagaggaagcccaaatccagccttcctctgtctttttcttctgttcaggctttcaacagattggaagatgcctgcccatattggggagggctgccttactgtccaccaattcaaatgctaccctcttctggaaacaccctcacagacacacccagaaataatgtttaaccagacattggg

SEQ ID NO: 229608 - DNA, 318 bp, Homo sapiens
ggaggtttgcctggttttagatgaaacatacgcctttgaagcaaagagccaccgtagctaaaaataccttttcctggctgttgatcctctcatttgtaaaatgcatgtttccattgttaaacctgcagcagcccctctagagaggaaagctccactatcgtggccaggctggagcacccatgccctggggaggtagcaccttccccagccctgcccgtgggctccgtcgccaagcctctccaagaaggagtccaagagaagcacacagaggattctcaatactttattttctgtttagaaatattaaaccacatacaa

SEQ ID NO: 229609 - DNA, 552 bp, Homo sapiens
ccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaa

SEQ ID NO: 229610 - DNA, 802 bp, Homo sapiens
ggctgggctttaactcctgggctcaagtagtctgcccaccacggcctcccaaagtgttgggattacaggagtgagccaccttgcctgtcccagagcctgcctctcttaactgctgcactagactaccttcttattttaaaagttagcctgcatttctcttacctgcattttaaattttattgagtagttattttatgagcagtctttgaaaaattttcataaagcgggctccccctgaaattttataacccacattccagatttaccagctgtgaatgtcttgccacacctacttgatctctcgctatgcgcgtacacagtttccttcttcgaaacaatccagaagtaggctagcaatggtcacccctacatacttccgcacacatctttcaagaacaggacaccattaccacacccaagaaaaccagcatttaatgaatttattcaggagtatcatccaacatactcaaatttccacagctgttccgaaagtatccttcaattctggatccattgatggttcacaggttgtatttggctgttacatctttttagttgttatccttcagagtaaaactggcctgcccctctttctttctttacaatattgactcctttgaggaaccggggctggatgtggagcattctccattcatctgattgtttccatgtgaccagattcgggtcacaaatttctggcaagaacccttcacagatgaccatgtattggttattaggtaacaatagattactcaagtagagaactgggaaattgtcctttgtccatcacaatagatttttt

SEQ ID NO: 229611 - DNA, 926 bp, Homo sapiens
ctgaagtctgggattacaggtgtgagacaccatgcctggtcctgtctcagttctgactagccacatgtggcttggtggtagctatagtatcggatattgcagaagaagaagttggttagattcagatttaattattgggggagggggacaggaatacttaataggtggtgctgtttactcctgttgcatcacgtcaggaggtgtgtagtgtctggttgtcccactcacagtgatgttgggatgtttgtctgtatctgtgttaaaagttagcctgcatttctcttacctgcattttaaattttattgagtagttattttatgagcagtctttgaaaaattttcataaagcgggctccccctgaaattttataacccacattccagatttaccagctgtgaatgtcttgccacacctacttgatctctcgctatgcgcgtacacagtttccttcttcgaaacaatccagaagtaggctagcaatggtcacccctacatacttccgcacacatctttcaagaacaggacaccattaccacacccaagaaaaccagcatttaatgaatttattcaggagtatcatccaacatactcaaatttccacagctgttccgaaagtatccttcaattctggatccattgatggttcacaggttgtatttggctgttacatctttttagttgttatccttcagagtaaaactggcctgcccctctttctttctttacaatattgactcctttgaggaaccggggctggatgtggagcattctccattcatctgattgtttccatgtgaccagattcgggtcacaaatttctggcaagaacccttcacagatgaccatgtattggttattaggtaacaatagattactcaagtagagaactgggaaattgtcctttgtccatcacaatagatttttt

SEQ ID NO: 229612 - DNA, 518 bp, Homo sapiens
gaggtgaatggttcgtgtttatatccccccattgccttttgtttgtagggacatcttgctggccatgttgatttgaacgaaattctcccctcatgctactccaacccccgataaatagaacgttcctcttaacagtaccaattactcacgcctcacgaaattagatgaaagggtgcccccttttccccgcttttctcccaccccaatctttacctgatgatggcttctttaccgtagcagatataccactacacaagcagttgggggagggggtggtggaacccttatgactggattgtgacaaatggggctccgcttgaataattttggtttagtagcaggcagttcttaactaacgcgtattatttcgaggctctgaacgcgatcttctctgtggcttcctgtgtgtgtgaacccagcagctggttatgtctcgacccagagaactgacatctctgtcagagaggagatggggatatacaattgtaaatctttggggagagtcttctttttataat

SEQ ID NO: 229613 - DNA, 521 bp, Homo sapiens
aaaatacatttttatataataaaataatatttgagtcaggtatgatagctcacttctgtaatcctgatgcttttggaggccaaggcaggaagattgcttgaggcaggaattcaagaccagcctggggaatatagcaagactcctgtctctacaaaaatttttaaaaccaccaagaggattgcttgagccccagagttcaaggccacagtgagctatgatcatgccactgtactccagtctgagtgacagaataagaccctgtctcttaaaaaaatatataaaaaaagagtatttgaaatcaaaagcaaatatacttaatagtaaaactggaatgatttccattaagttcaaaaacagtataaagatggtcactattgacagattattcagcatcattctattattctatctaatggagtaaggctaggagaagaccaattttgagattcaattaaggaaagctgttgatttttttctatacttatatcttgaaaataggtaacttttactgttggatagcg

SEQ ID NO: 229614 - DNA, 319 bp, Homo sapiens
tgggctgaaggccatgcaggtggggcctcggcttcacatcttttgttaaatggattttgtggctgttaggacactcttgagacccacatgtgaaaactgtcagtctgttatcacttaaggcagaagaaaattgcccttgactctgggctggcagcaggtggagacaaggcctgacagctttcctgccatgtggcacacactttgggagcagagccatagcccaaagtggaccgcccttgagctagaagtgttgactcaggcgtgggaaggtgtagagcaggcgggtcacggtgaggaaggagtggggggctcagttgtc

SEQ ID NO: 229615 - DNA, 415 bp, Homo sapiens
actaggaagatgatgaaaaatcagagggcagggacccttatgcaatagtcaggaacaaggatgaattagaatctatctgcatggcataccctcatttatgtgccaagccttcgttaactgccaccacttcttggaagcctgtcctgactccttcagatagtatggaagagcattctgcaatgctcctgtagctccatcatagcaattcttttattttaaatgtttatttctactgttttcctactggactccatactccttgaaatcagggatgaggttttattaactttgtgtccctagtgcctagaacatttcaaccatactcaaaccttcatcaactcagttcacagtcaacagatacttactgagcatttagtatatgccaggcactctgccaaggcactgggacagcatg

SEQ ID NO: 229616 - DNA, 470 bp, Homo sapiens
tgagatggagcttcactcttattgcccacgctggagtgcaatggcgcgatcttggctcactgcaacctccggctcccgggttcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctc

SEQ ID NO: 229617 - DNA, 473 bp, Homo sapiens
ctgaggtctgtgaggtctagcaaattaattgaacccaatgagggagttacaggaaccctgattaatagtcagtctgtcaaaagcacaggaaaaacaacctggggcttgctgttggcgcccgaagtgggactgaaccctcaacctgtgggatttgccactatctccaggtagatggtattgaaactgaactggggttggaggatacccaggcggtgtctgctgcacaattgattgcttgctggcataggggaaaactatacatctgtttatttattatttgtttgtttgtttattgttttgagaggctcttactctgttgtccaggctggagtccagtcgtgtgatcacagctgactgcagccttgatctctgggagaatcacttgaacccgggagggagaggttgcactgagccgagatcgtgccattgcactcctgcctgggcaacaagagcaaaactcggtctcaaaaaaa

SEQ ID NO: 229618 - DNA, 411 bp, Homo sapiens
ttttaactcacactatgatttatttgacccatgggttatttagaagtgtattttaaaatttttaaatctttgggggcttttaaagatatattattgttattaattttttgttttttgagaccctgtatcaaatatatgtatatttggatgggataaatgatcaggtgtgtagtttagaaggctattataagggtgtcaataaggctgaattatataacatatattctttccatagaaaattaaaaggaaaaatgaaaaattctgcaaagaacagggtttgtatatgctcagtctgggctggggcatagatgggaatgagtaactcatgcacatcatcactgatcatcccagggtcccagtttacgttcctgtgtcctgtgctgctcactggccgctgcatgttcccagaag

SEQ ID NO: 229619 - DNA, 178 bp, Homo sapiens
cattcacccccggggcagctacattgtggttgatgttggatcccagactgacgtgcctatcacacagcacacatctgggaagtctcccttcaccaggcagtgggcgaagtgagaatgcaaactcattttaatgtcagtttgagccaaatataattagaaaggaaaatctctgactttg

SEQ ID NO: 229620 - DNA, 409 bp, Homo sapiens
tcctcctgcttcctggccagaatagactgtctggggggtatgtgggggagaccagagaggcaatgaggtgtgacaggagaagaaaggagctgggcagcaggagcctggattgagttctagttctgctgtacaatcttggaaatgtcctgtgcctcagtttcctcacctgtaaagggaaggtcctaggcaagataatctctaagttcccttctggttctgacaacctgtatatttccttgccctgtcgatgatgtctggtgcagggcctggcacagagtagatgctccgtataagcctgttgaaggaaggcaggacagactgtgcctgtgtgtgtgtcagggggacactgcccatcacagcagagaccatttgctcgacaactatttcttgccaagaattgggctaaacc

SEQ ID NO: 229621 - DNA, 527 bp, Homo sapiens
cagtaaaaggtgtttgaagctgtgggttttgatgagaaaatgcagtgctcagagagtatgtggctgaggacagaggactaggggacactaaccaagtaagggacagttgaagatagagaatgagaaaacaataggaaggactgagtcacaaaggccagagtggtgggtttcccaagtggcagctgtactacagaatggcccagggctcagcttcttactaaccttgtgaccttgaggaactggcacttctctctgcttccctttccttgtctatgaaataggataataacaccatcatcagagggtggttcagaggtttgagcactgtggcaaatgtaaagtagtgtgtccttgtaatcatcagggaccaggtaggaagcgcttgatcagggtggattcccctcagagggaacactcaagaaaggtttgccgaaactgttataatcagaatgcagctacagcctagatatagagatcgcctgaacctgtgtcctcacgtcattaaaagtctgctcttatttggagta

SEQ ID NO: 229622 - DNA, 323 bp, Homo sapiens
gatcccagttgagggcccaccccaccccaggacccagctggtgcagttgacaaggatgcgctgcgcccaaggctatttaaacccgccctgttggggggcctcgagctcagatcttcgcagagcagagcagcggctggagcgttctgccggctcagcgtggacctggagcttacagcgtcttacgacttggaagtagattcagaggataggacagtacacttggatatttactcacctttttctcattcactatgtctgccgtggtctcgatgagagtgtgccacgtaagtttcccccattaaaagtcatgaattcagtggaaa

SEQ ID NO: 229623 - DNA, 451 bp, Homo sapiens
atttgggcaggtaaataagcttttgtttcttttttttttttcctcataaatggactaggaatattactcctacctacctggcatggccgatgtgcgagaaaatgagataatctcgtggacaggctctgaaaactgcacttttactgagtaaaaaaccctttgcctctccgggcccccgtttccccatctgtaaaatgagtctgtaaagtgagaatgatactccctacgccgcaaggctcttgcgggttaaactggaatattataaatgcaccatttatttgcagattgaaattctgtgcgtccggaggtggcgggtgggagagggaatgagcagggatgcagggtaggccctgagttgctgggggctcagcatggccgctgcgcacattgcatcattttgtcgacactggtgtgggtgaaatcttccaaaagaaattaaaacagaaaaaaa

SEQ ID NO: 229624 - DNA, 567 bp, Homo sapiens
ccattctaaaaactagaactgtttactcatcagtattagtaatctactcatcagtaaagaataaattattaactacttagtaatttactaactaatctcagtagattataaatcaatagctattattaagttattgataataattgaagccaataaaaacaaagcccaactatgggtcaagcacttactacatgccaggcattgttctaggccttggcagtgagcaaaacagacaaaaattcctgcctttgtggacctgacattctggtggttattattaccaccgtggtctaatgacaagatacacagcacatcagtccagcgcactctcacatgacgctgagaactgcagatggtatctacctgaattcaacagtgaccataaaagcacttggcaggccgggcctggtggctcacacctgtaatcccagcatacttgggaggctgaggcaggagaattgcttgaacccaggaggcggaggttgcagtgagacgagattgtgtcactgcactccagcctggggaacagagtgagactccatctcaaaaaaaaaaaaaagcacttgg

SEQ ID NO: 229625 - DNA, 389 bp, Homo sapiens
atgaagaaactcgggtagattgtcgcagaagttattcttacagcttcttactctataatgaagatttatggtatacgcaagggcagtctggtgcgctctgttcctcacttgatttcagtgatctctgaaatgtcacccaagatggcggtggctggttcgtgagtgttttttttctttttgtgcgtgagtgaagttttgttagaggtattttaagcattaattgaaaagctgcatttctgaactgagttttcgaattttcctacgtgttgacgcaaacagatccccatttctttgtcttgtgttttattgtgtgatgcgcccgtgaaggtagaggttgacttctctctttccacacacagcactctcctctgtggttattaaggggatta

SEQ ID NO: 229626 - DNA, 528 bp, Homo sapiens
tataaaggattttacagaagtagcataattaaggtttatgaaagaatgtggggttaatttgtaaaaataagatagaatgaacagaaatcaaatatgaaagtgtaacagaatttgctttttcaaaaggaaaatacagaattattgaagcaagaatgctgtgtacaatgaagaaataaaattcttttaaacattaaaataaaatggagtgtactttgaaaactattcattaaaatttatgacagttgtaaaaatgacttaattgcatattttcctttgtatttcacattagtgaagcaatttgatagaattgcattttaaagtacaaatgttcagtttctatttatgtgcagaatatggctatttgtttattgacttattaatcaccggatatttgtttcagtatggtttaaggtgaaataaattcttccaattcaataaagtgtgaaacttccaatagcagaacaaaatttacaaatatatgtatttaacctaagtaatttgtattaaaatttgtgtttacctgctctt

SEQ ID NO: 229627 - DNA, 475 bp, Homo sapiens
aaattaggccaggtttaaagaagtcaagctgtacatatgtaagaattttaataagcttggaaaatgctacctagagcttatgcacaggcttactgtaccaatgggattccctgccaccagccacagcgtgctaagcccctaacaagagctgttgagcacgtggggcagcggggacagggagtctgcttggtccaggtttccttaggagttggagactcacagcagaggctggcagccagatggatagagaacagaatcgggcatgcagctcagtggagccaatgacatttactaggaaaacatgccgaaggtttctttggtgcaaatctggtcctcacacacccttctagaaactagcaaacactgtaatcaatgtctgcatttatcaaatgcctgtttgtacccagaactgtgttgggtacaatagagagttatttaagcaaacatggtctctgacttctagatgccgacaccc

SEQ ID NO: 229628 - DNA, 434 bp, Homo sapiens
gtatcaactccctacttcatctgttatttttatgaatgaaaatcgtaattgagggggcactaaacatatttttggagaaatgaaatggggtggtgtgctgccttaattagtttctctaaggagatttgatttcatatcagctcttatatttgaaatttgtacttttaattagaagtgaggacttacacataacatttcatctttttagtgttaaattcatcttttctgatatgtagcatggaacatccttatgtacacaggagtataatatcacaataatttcttattctggggagttatcacattttttcttatttgatcaaacacttggaaaaccaggaattaacataaaataaatccctgtacaaactaatcaccattattttcttgcattcttaatctgagatggtagaaaagaaacaactccccccctc

SEQ ID NO: 229629 - DNA, 227 bp, Homo sapiens
gcaaatgattggctcctttgattcaggattaagtgttgcattccttggcttctgaggctatgtatccctgactgagcccccaaagatggcttgttttcttaggggttattcccatgtgggccaacaggcaacattaatatttattatgacaaagcactttccaaagtctgcctcaatgtctgtgtttagcatgtgcaaccttggccttcccttcagtttgtataatt

SEQ ID NO: 229630 - DNA, 260 bp, Homo sapiens
aatttggacaactgagacacagagaacagctagaaggatttaaagtcagaggatcgtgtagcattgttgcatctcctatgccatgtgtatgcacacctatgccatgtaaatgggtaactcaatagagagccatcctttaagaaatgtaagcaaccgcttatatccagtaagcctagtgggtcatacttgaaggaaaaaaaaacaaacccaaagccaaaacccacgtatttggaaacactattttacaaacacacacatac

SEQ ID NO: 229631 - DNA, 760 bp, Homo sapiens
ccagtgttactaactgtaattctatcctgttcttcactggggaaaagcttttccagtgtgctgagacagttttggttatgtaactgttaaaatgatgacagtcgtgtggcctgcggatagcactatgattttctcacagtgagttgaacctggcaggtgttgccactcacatctgaccacatttataacactttctgtactcgtatcttgtgccagtagtctgctagtccagattcatgttcctttttctcttttgaaattaaactcatagcctccaaaaatttgcatttgccctgttttgaggggggagaagtggagactattcatgatgctcaatatatcatagtattaaaatatacattgcaaattcctttgtatttatgcccttttgaaataaaaatgaatgttcttagcaaactcaaagttcttgaactctgtagtttacacatccttagaacagcactaccttgtatgtgatattcaagagactgactttctaaagagtcttagagccaagctttaaattctgatctgttaatatatatttcagtagttgctaataatgccatacctcttcttcactatgctgatcccacacacagctttctttaggagaaggaatacctgtacatatgaatgagaaaactgtagaaataatagttcggacccttttcaaaattgtattcggaattgctagtttagcctctactaaaccatacttggttcctgggcctagtgaagatttgatcatttaatttcg

SEQ ID NO: 229632 - DNA, 405 bp, Homo sapiens
aaggttaggagcatcaggtctatagtataatatatgcaaactatcaatcaaggagaacagttggctaaattaaatatgtgtatatattttcacacaggtggtttggcatagatttgttgagtcatgtaccatgtctattttcattcttttcagcaaactcttttaagaacttttattacttgtggggccatatgaactcaacaaactgagaattgaagtaattgctatcatcggagtgttccctctgccagattaggttgaggcattgaggctactcagaactggagaattggctcagcaaaccctgcactgaattgctgccaaatgcattggcatttgaaccccttggatgtgatcattaagctttagagtggtaatccttttttatgtgccactgtagaaatg

SEQ ID NO: 229633 - DNA, 449 bp, Homo sapiens
agaaacaaaacacatctgtcacacagccacatggcctcctcttacttggacagacaagcgtccccagcaaagcttcccgtcctctcgataggtgactcgtcctaaatcagctctgaattcccgcaaagacttctggaagctgtgctggggttgaaactggtagaccaaaaccagaatcaagtctgttgggaggggcctttcccctgggacgggaattccagtggtaatgtcttcctggggcttctccggaaggtccaatttccactccaccctgctcattctttcaccatgtatttctcacaaacactttgagctggattgaaggggaaacatttgataatgcaatcattaatggagtatctgggtattcggcaggaagtcagtatatctttcacactactgtttagacttattcaaaagaaatttaaaagaaacatgaaaaagcctca

SEQ ID NO: 229634 - DNA, 433 bp, Homo sapiens
ccatctttgtgtttcaatactccagaatgaagtgaaggtctttggctccaaaataattgaaagctactccactgtttggcatgaacttgttcattacaggtacattcacttaacaggctctctttccacccttgtagaaatacaaaaataagacttaatacagacgatggcatgggcttagtaactacccctttacccttaaacagctcattgcccctttacagggaagggctaagtacagtgtacggttttatcacattccagtgtaagaaatgcatcgtgaaaagcagatggagaggtaatgctggagagagagtgcatagctctcatggaaaaagtcttgtaggatttcttaaactggtgatctctagctattctgtaagaataaaaagaaatttacgatgcagatatgagggaaacatttagcaagtgg

SEQ ID NO: 229635 - DNA, 468 bp, Homo sapiens
caaggtgtgagttttttcctctcctaagtttggtaattctgaatgtcacaaaggtcctttgtttaagaatcctgcatgttccaagcaattcctggaatttcttaaatggcttccattttcctggaggagaagctcgtaatggtctgcttggctctctgcctttatagcctctactggagccacttaacccgcaatttgtaggttcagctgtacccccaggcctaaggccacccctgtccctaggtgagggaagataagttcaacccagcctaccctgcctctgtcctccctggtcacctggctcatctacaaaaagcgaagattcccccttagtgtctggcagagatgcacatttactcctgggtagaagttaaaaaaacaaaagatgtatttgctttttttaaatctgcttggaaatataaacaaaggtgaaatcttataaaataaagtgttccaaaaacacttgcc

SEQ ID NO: 229636 - DNA, 315 bp, Homo sapiens
tgaattctctatgggtaggatttaagaattatctcccgtcctcctcatgcagctgccctgtgattattaaactctttctctgctacaactcctactgtctcagggtactggctttttctgggtggcaggcaagaagaacccaactgctgtgaaacaataattgttttatcagtgtaattatttaccgtaaatggatggtattaactctcctgcgcaggtgagaaaactgagtaaaacagataaaatattttccttaaaattactgcctgaaacaaaattaaacaataacaataaaacttactgtgttcacgaggt

SEQ ID NO: 229637 - DNA, 478 bp, Homo sapiens
catgatacttaggtaggacaaatgtcttcagacagagaaattaaggtttactatcacatatgtgaaccctgaaagagccagtctgtaaagttggatcctgagtggctaactgggcctaaattcaaaatagagtgaaatgaccgtttgctgactagaggtcacacacatagtctgtgttcctggagaacccccatgctcacttaactttgggatttgtatagctgtctgttcctatttatgccacctgaatcaaccaatggacaatgacctgcattggccaatcagaactcaagaagcatcaaccaattagaactaagcaagtttgcattctttatccgcataagcaaaccaaagtgggaaaccgggcaggcactttccctataaaagacaggccctctctttgttctcttgaaacatggctgcatctcccaggtttccaaactgttagctgtaataaagtactctatccccttttaaa

SEQ ID NO: 229638 - DNA, 443 bp, Homo sapiens
tttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactgaaaatattgga

SEQ ID NO: 229639 - DNA, 423 bp, Homo sapiens
aacttacataaccaactttgaaattaaaaatgtatgtgtaaatctgatttgtccaactataggcaaatttcagtcatttaggaactgcctagctttattttgtgattatgccttccccccccccccatttgcatttagacggttaagagcttatattaaacacccataccaccaaagaaggaaaagggtagcatgatataaatgactaattttataaccagacccaatgaaagattgaaatagaaaataggtgaaatccttttactccatgaaaatggccttgctgtcatttcaaactatgcactttatatgtgtttatcaaaaaaagtcagaatagagaaaagtaatgaaagaaaataaaggagatctgaaatcacactattgagaaagaacttttacattctggagacccttcttttatat

SEQ ID NO: 229640 - DNA, 456 bp, Homo sapiens
ttctataagcacttgttgcattaacgatatgatttctatactgtccctctttgcgtgatgaattatattgttttccttgtgtctagttatgcagtacaagaacaaaactctgcttgttcataggaaaattattttaatgtgatctttttttctatttactagagtttttatttagttattatagccatactcataaaaaatcattgtgcatatcttgtctgtttttggaaaataagactatatttgccttatgaggtagattgaaaagcataacattcttacctatttttggaaagttccaaaacattctccaacaaactcattggctataggcatctttgaaaacagtaatcctaataacatttcactctgttgttgtaagttgtccattcaggtttgctatttcccgatacctctcttttatcctcttgtggtcttgaatttttatgtgggaag

SEQ ID NO: 229641 - DNA, 854 bp, Homo sapiens
ctaaatcagtagtgatatagtgggtggcaaatagaattgcaggaagaaagtgaagatctggttgcctggagcttgtaagattcaaccctagttcaacacagctctgtacttggaccacaaagacagaaagaaaaagggtgtctgaagctgagaagcccaagaagaataaaatactgaaaatagtaataacagtaagcaacacttatacagtgtttattaaatgccagccaccttgatagacattttacatgcattatgccatttaatcctcacaaccaccttgtgaacttggtgctgtcattgcccttgttttaaaactagattactaagacttagttaagtaatttcctcaaggtcatgtagctggaaagttgtggagcaagttttcaaacttgggtttgtctatcacgcaagttattttttactttaaaagatctgatcttctctactgttttgtcattttgcatggatgttggtcatccttatgttcacaatcactcttctccttctgaattaacagacctagctggcaaggcagcatagataatggttaaggaatgtggccattgcattcgattacctggattcaaattacgatacctacactaaaaagctgtgagactgtgaatcatggatttgacctctatctgcctcattttttacatctgtaaataaggataataccagtgccaacccacaggtttttataagacttaaatgagatggtgtgtgtaaaagcagttgttatatatctgagcataaaataagtgctcactatatattcgtttttattaggaaccagtagtgcatatgatacattctttgacaaaagcctgtgaagaagcagaagccca

SEQ ID NO: 229642 - DNA, 420 bp, Homo sapiens
ttttttgagacggagtttcgctcttgttgcccaggctggagtgcaatggcgtgatctcggctcacagcaacctccgcctcccatgttcaagccattctcctgcctcagcctcctgagtagctgggattacaggcatgcgccaccatgcctggctaattttgtatttttagtagagacggggtttctccatgttggtcaggctggtcttgaactccggacctcaggtgatctgcccgcctcagcctcccacagtgctgggattacaggcgtgagccactgcgcccagccattcagtgaacatctttaagcatattgcctttggttttactggagtgttggagttacttcattgggctacattaccaaatgtggaaatttgtgggcaaatggtataattaactatattgctcttgccgtgta

SEQ ID NO: 229643 - DNA, 330 bp, Homo sapiens
taatatattaacctaatctattaatgaacatttaggttatttccaatttttcactagtacacctattcctttaataattcctcttgtacatatgtttatacacatataagaattttgtgtgttaggttgtcagggacagatacctaaatgtggaattgctgggccaagagacagaaaggaagataaaatcatttacattttgcagccaggtgtggtggtgtgctcctgtgatcccagctacttgggaagctgaagtaggaggactgcttgagcccaggagtccaacaccagcttcacaacataccaagaccctgtctcaaaaaaaaaaaa

SEQ ID NO: 229644 - DNA, 568 bp, Homo sapiens
ggatgctgctgaagagaaatgcagataacagctgtgctggcagcctggagacacccgcctagattgaggccacacagaaggcactgagagaaatttccaaaagagatgaaacaaagaatacctctttgtttgaaattactgagagtagaattagtcaactggggaagagtttcatgatacattgatcgattcataaaaaactacacaaacaagataattattacttctggaaaaacaaattatacagggaaggaacaacaaccataataaagactaagatgacaataaaagttatgtatcaatgataatgtaaacaatctcaagaaaactatataggtacagtaaataaaaggtaaaacagataatgcctaaagctaaggaagtaagtagtagcaatatacgcacactacttacaaacacagagttaaagaacagtagaaacacaggcttgggattgataggagggagcagggaacatgacgacaatttgttcttctaccaggtggaacaatttctttccttatgtgctcatcaaatttcgattaaagtaaaaactaagttaaaaagt

SEQ ID NO: 229645 - DNA, 445 bp, Homo sapiens
taagttcattttaatggactgctttaagtttgtcagcagtattttctgagacacagtggctgaaaagttgtaattttatgatttatcagaggctatgtttcatattgatgctaacaccagaaatgtgaaccatttttctttatggtttcatgaaatacgtggactccaaatttttgagtttttctatgaggttagtttgtaatggattatgataagtatcagtgaaactaatagtaacattttgttcctgaatgctgctttttggcattttagcagcttgttttgtgtctatataatatatttatatctatataatgtactttgtaaagaaaatccagtttctctatgtatttttacctaacattgtactttgttctcactttttaaacattgtactttaattttattctctctgtttagtaaagctgaggaaggaatttcagct

SEQ ID NO: 229646 - DNA, 414 bp, Homo sapiens
agccagccccacctggactctttaaattcaacacgttccaaattcacttgtcatcattcaacatgttcaaaattgactcgtcttctcatctgcacatcggctctgcctcctgttcttttctacgttggtgagaaaagaactgttgctcaaagcagaagtgggagctgtctgaatggcctcagtgctctgcacacgctggggaagtcattgcagcaccttcggaatctcgcttgtctccaccatctgccttcctgttaatctggttgctccctctcactgacccagttactgtgtttcttgtcatttctgatgaacactacgctgggttcctagtccctgggtaacacaaattcaagtgttcaggaaatgtgatttttccctgccctctataactaaagttaaattcaatctatg

SEQ ID NO: 229647 - DNA, 391 bp, Homo sapiens
ctggaccgcctcgtaagcaggaggagcatagaaggaggcgggctccacaagcttgatcttctgaatccccttgtctctgtaaacttcccctggaagaagcgatgcactggcgaagccatgtgaggggggcttttggttccagagagacagcccgagagccccagtgggaaccatccggagacccagaagatcgaattcgcgggacggcgcgttaccttccaacaccgctgggccaccactctgagaaccagaatcagcggtactggggcttccccacgggacaggagcgcgttctttggattcccctggtgcggcgtgcacaaccttcggacgaagagtccacgcctgccacccaggaggaggcccaggcgcaggcaggagtggcggccgc

SEQ ID NO: 229648 - DNA, 526 bp, Homo sapiens
ggaatgggttgagcacctgtaggtactgtagggtaactctaataatttattgcatattttcaattagcttgaagagcatattttgaatgttcccaaggcaaagtaatgataactttgtctgtggtgacagatatgctaattaccctgatttgatcatcacacagtatattcatacatggaaatatcacaatgtcccccataaatatttgcaagtattatgtatcaactaaaaataataaaagcaaaaaacacatcatgttgtacaccataaatttatatgttttcttaccatcagttaaaatacaaataaaaatcttaaaaagaaagaaaaacgctgggcatagtggctcatgcctataatcccagcactttggaaggctaaggcaggaggatcgcttgagcccaggagttcaaaaccagcctgggcaacatggcaagacctcgtctctacaaaaagtaaataaaaagttagctgggcgtggtatgctgtcgacgcggccgcgaatttagtagtagtagtaggcgg

SEQ ID NO: 229649 - DNA, 431 bp, Homo sapiens
agtctttaggtatggcatttactaatctgtaaccctgggaacttataattactacaagaaataggatgaatccctatctgagtgggaaggtatttgattgtcttagaagcagaggtggaaatgaaggtgatgtattcagactcagtcaaggcaaggacctgatctatcttgtcatagctttatgtcccactcctggaacacagcccactacatagcaggcacccaacaaatacattacagggttataataacattgagtcaactagttaactagatgtaaaatcacttttactgggttattgttgtggccaaatgggttaataaaaagtgtacagataaccctcaagatcctcatttttattgttttgtgtttaaacatctgagtgctccccccacttttttttaaaataaactagattagattcttgatt

SEQ ID NO: 229650 - DNA, 643 bp, Homo sapiens
tgagaaataagataaattaccaaaattgtgaacaaaagagattatcactaatgacccttaggaagttaaaaaacattataagtgaatactctgaaaaacctgaagccaataagttagaccacttagataaaaaggaccaattcgtgcagagatagaaattgccaaaactgacccaaattaactggaaaacctgaagagaactgtgaactaagtcagaaattgaaaaaccttctcaaaaagaaatgccaaagcccagatatcttcactggtgaattctatcaaatattttgaaagctctttcagacaagaagagaggagggaagactttccagcccatttacagaactggcattaccctcatatcaaagtcacagcaagactcacaggaaaagagtgccatacaccagtgtcaccaataaacataaatgaaaacatccttaacaaacattggcagataatacaaagccacataaaaacggattacactccatgaccaatgggattcatcccaggaacatatggttggattaacatttgaaaatcaattcatggaatgcactgtattaatggaaaaaaagacataattatctcaaaagatgcagaagaaacagttgacaaaaatgttaacatcactcatgttcat

SEQ ID NO: 229651 - DNA, 262 bp, Homo sapiens
ccttcagcgctgaactggaagttctcagggtatctttctggtccagctgtggggatgtgggcaatgtgtgtaagggcccagcgtggtggctgccctgcccttagcccgacaagtgtttgctgtggctggtggcagtctcttctttcagtccccagtgcttttctgggcctccaccttcctaagagtgggctgactctacattccagtttacccagaagagttgtttcattcttgataatcaacagcatccctttcgttcttt

SEQ ID NO: 229652 - DNA, 345 bp, Homo sapiens
ttctactttgttctgattaattcatagatctgtgcaacgaaagaatttgcaattggcaagcaaaattctaaattaggcagtttaattgtcaagtaaattttaaaacttgcatgaaggatggaaaaaatatagaaatgtcgacatgttggcatttggaaaccataaatgggtattttcttgtaggtcatgccaatctaagagaaggaaaaaaaaagaaagactttggttctgtcagatagaataacagtttctttaggaaactttaaaaatctatttcatcatatattcttccaatgaaggtaaatttaatgaaattttatactttatttccttgaactcctctta

SEQ ID NO: 229653 - DNA, 582 bp, Homo sapiens
aatatctggtacaaaagggtggctggtgcccttcaccaggtctgtgcataggacaggctccatgccccctgtagtgcaggaagaccagagcatcaccagtcaagaactttgggagaagattcttatgctgatgggaagttgaatgaaggccccctcccattctgaattctgtaattctagggcccaaactgtatcccttagaaataaatagaacagcaactcaccatttagataattggcccatttggtgaagtctttccagtccagccatccaagaaacagtctgccaacaggctgtagtaggattctagcaggtcccggtgatctacaatggccatgagggccaaacacatggctttctataggattggcaagaacagcctagtgcatgtcaccatccactggagttaagtgggttttagactcaggctgatggacctaccttgacagagaagaagaaagaaggttttattaaaaaaaaaaaatagggcactggattttaggtcagaagacctgtaccatggctttggccaactaggaggatctctccaagttgctgttctttcatctgaaaaaaaaaaa

SEQ ID NO: 229654 - DNA, 452 bp, Homo sapiens
agagacctatagccagtgaatgagacatggggtttattgaggacaattacacgcagtccagtggtggcaggctggacaggagaagtgctaccatttgtagaaagcatgcagtttatatagtattttcacttagcaccttccccctagaaacttacacctgacaacctttgtttaacccagaacaaagggcctcaatcctctgtacagtctgcattccatgagatgggctggggggttcagatgctcctcatagataaggaatgaatctccaggttggtcactcccagactcttcagcacagaactccaaacacacattcttcttagaccacagggtcattctcaggctttgcttaagttagctattgctgtcagatgcatctgccattcacagaggcacttcttcctctgccgtccactgctcaaccccaagttcagctcttccttccagct

SEQ ID NO: 229655 - DNA, 297 bp, Homo sapiens
caacccagcaactaagcagtatattactgacaatgcttctgaatgtttggtcacttgttattcatgatatgactcacatccaactgttctgaactgattcattcttcaagaaaatttttaaacaatatgttgggttatgccgttttactaatttaaaagaatgattcgtactcaggacattttggtttatgatttgtatagatcactaattataggcaatactgtaagaaaaccagtgaaacaaacccttaatagataaccagaaaaatctctttgaaactccaaggtgggctatat

SEQ ID NO: 229656 - DNA, 231 bp, Homo sapiens
caagaagaaaggtttttatacaaagttgtgcaattacagtttgatagtcaaatttgaggacagtcaggtataaagctctcaattcaaatgcagatcaagagaaatgaacacttggttttattagtcatggcatagttgagacttgttatttgaaatttgtaatttctcacaataattttttattcttcactgtaatatttttaggtaccataagtttctatggccagttcc

SEQ ID NO: 229657 - DNA, 359 bp, Homo sapiens
gaattaggaaatggcgctcacacagacctgccccttcttgtctggtagttgttactctggtgtccctcaatgagacatgtcttccatcaatgtagccttttatggtccttgaccctggaatctgggctgggtcatgattgagaccatgagaaaccatgactcaatttcaccaatagaagaagttggtaggagtagcaatgtcttgtttctagctctgagcttaaaaaagacctggcagccttggccgggcacggtggctcacgtctgtaatcccagcaccttgggaggccgaggcgggcagatcacgaggtcagaagttcgagaccaccctgatcgacgtggtgaaaccctgtctctac

SEQ ID NO: 229658 - DNA, 397 bp, Homo sapiens
tgcataaagcgcgaggtatttctaccagtggggtttgaacccctcagaataagggaaagatttacatcctcagaccagggtccattggcatgcgtaggaagccctcttcgtcttcaagggtttagacaaatatattttattggacattagcccgccaaggggataatattaaacagagaacaaataagccaacctcatttattgagtcttccataggccgaatcctaggtttgagctttagaatacactagcacagctgtaggactattttcacttgattttgtcatgttgctagcgtgctttttaactgctttgtgcctgccaactcagcagaacatatgatggtccttctggtggtgctaatttgaaatttaaaactgctacgttagatgcttat

SEQ ID NO: 229659 - DNA, 397 bp, Homo sapiens
agtatgtactagagtttgtttaaatgttgaacaagatgctgaacattcttaatatcatatattttatttaggtgagatttaacataaatttgaaaaaaaattggccaggcatggtggctcacacctgtaatccctgcactttgggaggctgaggcaggtggatcacctgaggtcagaagtttgagaccagcctggccaacgtgttgaaaccctgtctctactacattaaaaaaaaaaaaaaaaaaaaaaacagatttggtggcaggtgcctgtaattccagctactagggaggccgaggcaggagaatcacttgaacccaggaggcggaggttgtagtgagcagagatcatgccactgcactccagcctgggtgacagagtgagagaccctgtctca

SEQ ID NO: 229660 - DNA, 345 bp, Homo sapiens
atttctgtgcctttgtcaatgcttactaaagtgacttcattttgactgtgttgtttcctgaggttgaatcctattcaaagattagaaaaagtgatagaaatgaaatgcagctaattttatcctggtatttattgggtagattttaataatcgaataccgtaaatactgtaagttttagaacttgtgtcaaaatgttcccttatgtggtggcatgcgcctgtagtcccagctgctccgggggctgaggcaggagaaatggcgtgaacccgggaggcggagcttgcagtgagcagagagcgagtcactgcactccagcctgggcgacacagcgagactccatctcca

SEQ ID NO: 229661 - DNA, 116 bp, Homo sapiens
cataaggcttacttcccacccaccccctccccggaaacagggtcttgctatgttgctcagactggtctcaaactcctgggctcaagtgatcatcccactttaccctcctgaatggc

SEQ ID NO: 229662 - DNA, 389 bp, Homo sapiens
gccctgcacccccacagccccagagaaagttcttcaaggggaagcagggtgggacttggacagccgctggagatgacgctgacggcccccactggtgctgagcatcgtgaaggatatttattctgttaaagaggaaggacccacctgcctaacgacgggagtgttattcccggaaaagcaattccagccctgccaaacacccctcgtttcctgtgaatagccgggaaatgaggattgcgaagcagcaggctggacacacacccgacaagctgctgccccaagccaggtggcaggagcttcaagggagtctagggttgccatttgtagtggaggaggccaaagctcagagaggtcaagtgactcgccccagatcacacagctgctccaag

SEQ ID NO: 229663 - DNA, 782 bp, Homo sapiens
aataaaaacagaaggtccccaaatggagtggatacattagattcttaagtagagcatttaattttcctcataagacacaataaagcatagagtggaggttcatcatgctatcatttaactttctagaattcaactctatactaaaaaaatgaataatgaaaaagacaatctaaataaggcagcttgtcaatggaatgactgtcccaggcaatcaaccttgaaatcataaatacatgttggctgaagtaatggaaagaacaggtaaatgataataggtttccccaacataagaagtgaaataaatgcattattcagatggccaggcaaatagatggtgatggcttccttaacatacttaatatccaaaatatacaaaataaaaccaatgggtttataatgatattccaccaaaacaaaaaaatcattggtcgactttggaccactgatctggatcattagacaaccagctcactattttgaaaaactggtaaataaaaaaagagaatcaagcatttattcctgcccttactataagaactacatcactaggtaaccaaacagttgaggaaacaaagttttagaagtagtctggctaaaaactgaagaaggactgagaaaaaatagaatggtatcagttggaaatcgccatttaattaaggtctttagtaatagctgctaaaatcataaaaagaaaggcaaccagatactggaagtatagaataccacctataaagtattactgccaaaaaactcaaacgctaaatctcaagcctcaagatcta

SEQ ID NO: 229664 - DNA, 431 bp, Homo sapiens
ccaggccacacctgccctggtggctccgtccagcatccctgctgggtcacttggaatggacgctggggcatcaaagctgccctacagctctgaagaacccctgcgtctctccctaatgacaagggtgctgggaaaaatgctcattccatgtttttatctggacttcaccagcagtcactgaagtcttaggtcacagttctgtggagttttccaacgggtccctcagacaccaccgctgccccacaggggctagaatggaatgagcttgggagtcaagagatgtatctgccttgagcttgagcaggtcattttacctctccccgttgcagtttctttctctggaaaaggagacacccggactggacagtctctgaggtccatccagctctacctttctgtctctactggctgtttgaagaattgcaatgctc

SEQ ID NO: 229665 - DNA, 614 bp, Homo sapiens
tcactttacgccctgaagcatgaagacttcacagccactgtaattttacccaatccaggcagtatacctatagttattcttattcatagattcccagatcatttctaaatataaagatattgtcttcaaaactctgtcatataagtgactaccatggatgaaataggtgtttcataaaatacagtttactttttccccccattttaagcacagctttaccatctctgcaggtatttgtttcagaaaaacaggaaatgctctctctctctatatatatatataggaatttataatgtttcatagataaaagggctggtttgtcaaaatagccatttttagaatatttattaaaaacaatgaatgaagttagagtaccaaggaagaacacaaaggaaaccacatatattatagttggaggaattatatcatgccatatttatatcatccaactttacaacgattaaagttcacaggataaatctaatactaaataaatggtaatagtagtagatggagacaagatatcattgtataacatagaatctgtcataaagtgttttttccctgcacattttcataatggctgttagaataatgattacaacatccctcat

SEQ ID NO: 229666 - DNA, 192 bp, Homo sapiens
aaggatgaataggaaacacccacaagaccaatgggaaagtatatcctgggctgttgatcattttctgtattaccagaaaatgacagataagcacatgcctgtgagtccactgcctatctctcccagtatttgtggagataaatacaaagtgctgagggaaagtctaagaaatataagaggtggaacctgccc

SEQ ID NO: 229667 - DNA, 380 bp, Homo sapiens
gcaggctgagctcaggagttccaggcggcagtgagccgtgattgtgccactgcactccagcctgggtgacagagcaagaccccgtctcaaaaacaaaacaaaaaaccacttccttgcttttctttctaattctacaacccccacatacatccctaaataatatagggtttcatttgcctgcttcagaacctcgtataaatccaaataactatgcatttgtttgtgacctctgctcgacattgtgtttttgagattcatccctgttgctgcatggagttgtagttcatttttattgctgtatagtattctattacaggattgcaccagggttcattaatccagtctactgtttataaacatttgtgttgtatccagttttg

SEQ ID NO: 229668 - DNA, 566 bp, Homo sapiens
agggaagctatctgagcaagaggtaaatacttagtcattcggaatagtccataaatgacgactgcttcatcttcaacaaggggaggtctgattggaaagtgctcacagaatgattggattgcatttctgtcttcaatccacctttgattcacaatatacattcctttgttaaaaaattgaagaatgtctgtaatcaaacccttgttaacagatgtaaagagctacaatttgcttgctggacattatttcaacaaaagttttttcattcaaaataatttgtcaaaaaaggacccatgcccttacgtggtttcagatagtgtgctgtccaatttgtatgcttttccacctactcccccagggccatcagggggtacgtgagtttaatgattctacttcttaaccatttcttaaatctgcctccttggtcgggcgcagtggctcacacctgtaatcctaacactttgggaggcgggaggattgctttgaggtgggaggattgaggtgggaggattgcttgagcccaggagttcaagaccaccctgggcaacatagtgccctgactctac

SEQ ID NO: 229669 - DNA, 229 bp, Homo sapiens
cggccctctaaaattgcattcttatgcatcttatagagagtgagatttcagtttaaggagaagaaaaaatattttctacaggaccatccaaacatgtaagtggcttctcatgggacagtttcccatcacgggaaagatataagtcgattcttagtcatccagagtgttgaagacagtgtatcagttagagactgagtttcagtccctgtccaacagcaactcaactata

SEQ ID NO: 229670 - DNA, 705 bp, Homo sapiens
ttttttggcgtatcttttctgactatacaatggtgcaacatcctttggctttgaaatttacatgatcataaaatgggtcattttttgttttaaaggcttattgaaataattttctcaagggcctctcttaatactttgttctcaaattattcttttgtgaagtgcttgcctgtgagtgatcacttttttctttaatggttaattctgctggatactcatctgtcaattctgtaggtgactaatgtcattctcttgcagtttaacagacttcatgaagtttctcatcttttgcaaagtacgcaatttcattttggtttgtgttgtatttgcattgtattagcaagagagtgacagagaaggataatgatgtagtgaatgggacagataacagctacagctaattaggaagagttggtgagtagagcctaattttataaatgattggtttattagtcagtgttcttgtttggcaatttttgcttctccatgcattacatggattaatgaccagttggatatcgaggatcttctgtacacacaacttgcagtaactatgttgtaggttgctctaaggattaaatataactaaatatgaggatatatttagactatatctaaaaaggcatctggcacactgcctaagcaaataaaagttgatcaattcatgtttattaaatctgaaagaaactggagggaaaggtatca

SEQ ID NO: 229671 - DNA, 308 bp, Homo sapiens
ccaggcaaccagtgagcaaggctgagaacttgtcccaggttacgagactcccaggtgagaaagaaagtggactcacagttccttggctgtctcacagagctgcagtggcattccacctctttcacaggctttgtagattctctcggctttccctgtatgttcctgtaggagttcttggagcaaaagttcacaatgtgactctccacacactgctgtgtctgtccaggtgggatctgcaagttagtcctgcctcctatctgccactttttctgtatcacgtgtctttgcaatttactccttcctccaaa

SEQ ID NO: 229672 - DNA, 359 bp, Homo sapiens
tttttttttgagaaaacacattttaacattagaaaaaaggtagaaaggacataatcccagaaaacccagtttttttcctttactatgaattaattaaaaaaaaactttaccattgactagcacttggaaactagtgatttagttatattatttcagatcatgtataaatcagaatttttaaaaaataacttttggaacaaaatcaccactgagggtggcaaacccatgggagactccagtttgagacagcggactgcacacgggcacctgccggctctctttactcccagagtttcccaccaccaggaagaaataatataatttttaagagactggaattctcacagtgcaagaaaaca

SEQ ID NO: 229673 - DNA, 487 bp, Homo sapiens
tatgcttgctttgatgaaggaaatatgacaaaatgtatgttgcatgagttccagaacttaggcataagttgctttgtagcttctctctttgcccacccactcatagcatcctccaccaccatgtaaggaagcttgggcaagactaatgaatgataaaagaccctgtgagagagaggcccagtctatagcccgcattaggcttcagacaggtgagtaaggccatcatagaccctccaaccccagtcaagctgccagataactaacgtctcatgagaaagcccaggcgagaccagcagaagaactgcccagctgagcttagcctgaattgcagacacatgagcaagtaaaatgttattgatttaagctactttgttgtgcagcaatagataagtgatatagtatactctgtataattagaatttatcagtggccctttcactgactctctgcatatttttgatgtaaagaaataaaacataaccagaga

SEQ ID NO: 229674 - DNA, 459 bp, Homo sapiens
gatgggatttcaccacgttggtcaggctggtctcgaactcctggcctcaggtgatctccctacctcggcctcccgaagtgctgggattacaggcgtgagccatggcacctggcccatgataacttcttcagaggaaataaaataaaataaaatcatgcgctgaactatgttagaaagtttgggttgtaaaatccaagtttgtttggtaattgtgtatgttaatggagtctgaaaaaaggactgaagatattacctctagtgtggcaggacattgacaaaacaacttaaccatgagaaacaggaatggaaacatttctttcttcagcttccaaatctcatgtattctgtgattttttttctatggtaatcctagcacccaagttacaagcttgtcaaatgggatatttaaaatgtaaatagaaaatgtttaattgtgtagataacccctactaggctttg

SEQ ID NO: 229675 - DNA, 458 bp, Homo sapiens
gaggttcttcctccttggtatcagactaagtggggggtctccagccgagacaacagaccaggcctggattcacagcagccttgaattacttttccaagctctgtagccagccttcaaatgccccgcctgcacctagaagtccccattcacggcagcttctaactctttttctgagctgtgtagccgggtgttaggtgacccacctgtgcctggagtgccctgacctgtgctgcatccctcagggactgggtgtgtacttcttgtagcacagtcaaaaatgcccatccaactctgcgggcaaaagcttgctccttcttggtgttctgtgcttccactgcttcagcaccttctccatgctcgtggcagacccatctactgccacccaggtttccttccactggagcctgtctgagcagcacagctgccaccgggtaccacaacccatgttgcggccacat

SEQ ID NO: 229676 - DNA, 207 bp, Homo sapiens
tcactgaagcagggagagagaggggactaaataccccacccccctcctcctgccctctggtctcctgccagtgacccctcttggccaagtgcaactggaagccctggatcttgaatgctgcgttctacggcagtcagcctcccaggctcagagccaggcagtgtggatgggggtgagcagggagtgaccagcaccccccacccctgc

SEQ ID NO: 229677 - DNA, 427 bp, Homo sapiens
ttctacttggatgactcaaaggtgacataaggtcagtgtttaaagtgaatttatctgtgccccaaacctgcttcttctcagtcagccacactaccacacacgaggtgcccaagacactaacttggcagccatcctgggcttctccctaccccagagctgaagaggaaatgaggcctgtcaattctgctaccttttttggactatgttttcttctctccattccgtcaccataggccaggccactaccatctgtctcatggattgttgtaataatctcactgggattttgcttccagtcttgcatcctttcaagcccttctccatgctgagtcatcctttaagtacgcctgaacccattatgggcatcccattctcttttatttatttatttatttttgagagtcttgctctgtcacccaggctggag

SEQ ID NO: 229678 - DNA, 613 bp, Homo sapiens
tagggacgataggcacccaaggcgtgtagtgagttcgccttgtagagaagatgtgagcccgccccaagactggcaattggaaaggcttgcatgcagagctgggttgtctgaaccctgacataataggtccctcgccggctcccgtaatcccagctagaggactttggtcccgtttccggcaaggccaccacctgacttctcttcgcaggattccctctcttagggttcctccacggtgttctccatgcccggtcgagggctccaggactttgggcggtaatgagtcggctacagtgggtctgagccggcgccgcggacgagtcccttcgtttcagccagtttggctcgtttattgagaaaagtggggggcgaggggttagtatgtaagaaagtcttaaagtttccacatggttaaggtaattttatcaactctttcttgcacccctccccctagtacaggtttcagacctaaataacctagagttcaggatccagacttcaaaatattcactgctttttctgttgtttgtgaaaaataagtgttttctttgagcccagatcgtgctattgcactccagcctgggcaacagccaaaccctatccgaaaaaaaaa

SEQ ID NO: 229679 - DNA, 462 bp, Homo sapiens
gagccaagatcacaccactacaatccagcctgggtgacagagtgagactttgtctcaaaaaaaagaaaaaaaaaaaatcacaagtggaagaggaagacagaagaatgggtcagggagatgcaaggatggaagaagaggcaggagaaatgaggcctgagaagaactggactcgccactgctggctttgaagacaaaggtttccaggtgccaagaaatgggtatggcctctagaagctgagcatgaccctcagctgacagccagcaaggaaacaaaggacttcagccctacagtcacaatgaactgaactcagccaagaacctgaataagcaagctaaccaattcacctctggagcctccagagaggcatgcaggcctgccgacacttcgattttggcccagtgagacccacgtcagacttgtgactacagaactacaagctaataaatttgtgttgtttaagc

SEQ ID NO: 229680 - DNA, 644 bp, Homo sapiens
tgaagtgtcttttccaaggccaagctcctgagggcaggggctcaagcttaggccttcagactccaaagtccagaccgtccctgggaacaagcaccctaggttttcacatggagcctccgaaacgcctctggcatctcctgctgtggggttggatatgagctgtcttatatagaccctacctaaattaaattaaaatcgactaattaaatgtggcctctttgaatacactgccgtatttctaattacagctttccttctctcctgagaaggcagcccaacattgtttctgaaaaggtcctcaattactaatggttggataacattttgaaaatgtaagtgtcattaaattgttagttagaaggccctgagtggggatgagaggatggaagtcagttgtcaaccgtctcctctctctctctgtttctgtctctgtctctcacactttctctctctcactgtttctctctctgtaatacacatatgcacatccttatctcacaattgacccaaagcatcagaaataaaaagtcagactgagtgaccttagctgctaggaagcatcttattgtgccttccctccctctctgactttggccttgacactgatctgagcctgcagataacagaaaggaggagcttatcta

SEQ ID NO: 229681 - DNA, 581 bp, Homo sapiens
tgttctgcatccagcattttctgggcagaaatatgcattccacttcaaaagttttcttagttttattgcaatatttggtgacagctttcactgagggaccacaatatattcatagataacgtgatgttttgtatcccagcccaaagacctggcaaaagaagtattcgttgtcaattctcttctaagcttccaagggtcatcttttttcagttaaggggctgattggtacaatgcatgagaaaaaaagtagtttgtttaattgtataatgtaataggtagaattctaaggtgaagatttctaagataacagagtctctaagcccctaagtggcttagacaaggtgaattcactctactcagatcaccaatttttgaaaacttggaaagtaatgaaatatactaatgcaaagtctagaaaacataatttaattttccttattaattcagaagacagttaaggagcttacagcgactctaagaaattactactactactgttgtttaggaaaatttggtgattgcatggaattagtgctaagatatatcttatgtgctgctttttgaataaagtttaaaatgtg

SEQ ID NO: 229682 - DNA, 422 bp, Homo sapiens
aaaatttttttttaaattgacaacagatttttgagatttttggtttacaaagctgtcatagaactcaaatacaaatatctatatagaaatgatttaatgatttagtgatgtctttgttagtatgtcattttacacgccagttcactatctccaccaaaaatgtacttataaaaggtagaaacactattatagaatctagatctccaggtttccaggtttttgaaattagctaaataaaatgttaagttcctgatcactcatttgccttacattttaaggataatattttaaagataaaatgtgttgttataaaagtaaataacaacattacaaaaagttatattttttaatagaaatggggtcttgctgtcacccaggctggaatgcagtgtcactatctgtacccctctaactcctgagtt

SEQ ID NO: 229683 - DNA, 524 bp, Homo sapiens
actgaatttggatgttttgtatttctaatttctgcacttagccttattattttttccttctatttattggggtttagtgtgtttttgtcctaactccttaagttgaatgcttacttcaaattggtagcttttcctttctaatataagcatttatgactataaagttagtacatgggttttgctatggagcatttttatgatgggtcagtttttagagtatttaaaaattaccattatgggccgggcatggtggctaacacctgtaatcccagcactttgggaggcccaggcaggtggatcacttgaggtcaggagttcgagatcagcctggtcaacatggtgaaaccccgtctctactaaaaatacaaaaaaaagtagccaggcatggtggcgcatgcctgtagtcccagttactcaggagactagggcaggagaattgcttgaacctgggaggcagaggttgcagtgagctgagatcgtgcccctgcactccagcctgggtgacagagggagactctgtctca

SEQ ID NO: 229684 - DNA, 610 bp, Homo sapiens
aatttgacttgtcattctcataaagttgacattaatctggtaatcttacgatctttatttcaagttgtggaaaagtaatgtataaggcaagggaaatagttcaacagaggccttttaaagaattctacataatatttttattttctaagtttattcaacagaagtctgcaatatcagtgaatggggctcttttcaaaaaagactacagatcagtggatgagttagctattttcaccatctagggattttcttctcaatccctgaagaattcagaagttgaaactaagttccatatttgaaatatgttggccaggcacaatggctcacgcccataatcccagcactttgggaggctgaggaaggaggatcgcttgagcccaaaaatttgaaaccagcctgtacaacaaagtgagaccctgtctctacaaaaataaaaataaaattaaaaaagaaaataaatatatcttacccttcaactaatatgtttctgaatcttagaaaattactatgatattagtattcaatttcttatattctctgtctccctcttctctcatttcctttccccttttcttcccctctgttccttcccccaatcattctcttctct

SEQ ID NO: 229685 - DNA, 474 bp, Homo sapiens
cctttgtaccacgtttttggatgtgagcatggctagtttggggttttaacttttttagaaacaggaacagaagcacattgtaaaaaaatttaaaattccctgggtattttttcaccccgagactctcacagcattactttaaaaattttttattttgaaatatacatacagaaaattatttttctaaacagcttattgaggtacaaatgacatcaccattacttttttaacattatgcagaaagacaaccaaagactacctactcccacagtatgtgtacaaaaaaacggtttctatggatatttttgtatatgaaaatatcatggacttatataaatattgtttctagcacaactctatatttgtaaattaatttataatgtaaactggggcagcaaagaaaagtttttcccaagaaagttcactgcatgctgagaagaagaatcacatgaaataaacttaaagtgggatcac

SEQ ID NO: 229686 - DNA, 83 bp, Homo sapiens
ttacttaacaaaatttgtaagatgcagttcagacagagctcagtgggaaatatataacattgaatgcatatgatagaaaagaa

SEQ ID NO: 229687 - DNA, 1411 bp, Homo sapiens
taatttgtaacaggacacgattggagaaattggttgttttactaagactttgactggaatggtgtgcttttctttaaggaatcaaacttgacttatggaaccaataaagtccttggaaaaactggccccatattttgtgtacacagtctccgtacaagatttctgacctgtagtaagtaaagaatgtcactttctgacaggcacataagccccaggtttacctcagaacctcaagaggagaggaaattcacccaatttataagtatttgatggcacaaatccatggctgggcatggctttaagaaagtcttatctgagattcctcctgtggaacaaagttaattggttccagagattcaaagccagagttgctgtcagttcattggtagagatgccatcactgggcaagtgttctgaaaacatcttatctgaataacagcagtcctggagaacatctagggatctagcaaagcgagagatacatgaaggacataaaaacgtttttagaaagtccttggaaacagttctcatttcagacatgtaagcatgagctaggatgaaaagtgatttcatcctggtatctgcaattttcacattcattaggtttcaacatataaactttcaggggacacagacattcagactatagcaccaagctgtagaagctacatagttgtagaccagggtcagcaacccaagaagcctgacttccaagctgtgcttttaacttccccaccatgttgcacctaaagctttggagttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctctctgaagtcttctacctggaggcttcatctgcatgataaaactttggtctccacaacctcttacaacccaggcattcctttctatcgataattactctttcaaccaattgccaatcagaaaattgttatatctacctataatctagaagcccccacatcaagttgttttgcctttctggacaggaccaatgtatatcttaaatgtatttgattgatctctcatgtctccctaaaatgtataaaaccacgctgttccccgaccacctggagcacatgttctcagggtctcctgagggctgtgtcacaggccatgttcacttacatttggctcagaataaatctcttcaaatattt

SEQ ID NO: 229688 - DNA, 580 bp, Homo sapiens
agaggcagcagattaataattggcatagataaaaaagttaccatgcaaatactaaaaagaagccagtgtagctatattaatgccagacaaagtagactttatgacccaaaggttgaggtaaaagcactactagggacaaagagtaatgcctcttagtgatgaaaggtaaatttaccaagatgataaaacatttctaaatctgtatgcacttcatgacataagctcacaatatacaaaacaaaaatagtaagaaagatttagagtgaaaactcattgacataaatttaaaactcacacacaacaccacacatctgttgagtacctctctctccaaggacacatgctgaatgcatcacactgggtggctgtgatgagggaggtgggattggggcatggaaaaaccgtgaaatcaagtgagagatacctccccacaaccaggtgccgcagcccaataggaagagacgtgcttggtcaacttagtttctgccctcaagcaccagagagaaaaggcagagaaaccaggtaagggcacattgtctattcattagacccatggagttttcaataaaaggacacaaaa

SEQ ID NO: 229689 - DNA, 540 bp, Homo sapiens
gactgctgaggcatattagaattgaggagtggtagtggttaagtgacgtctgtcagaacttgggcttttttgaattgaggtttataaccctcataaatcattaaatgccttgagtttatatgggaaagggagaataagtatgatttttaagtctgatattgcaatagcgtgtgccccagataattaaagctgtagaaagttctaacgtaataatcacctaatgcaaagtgaaactggttccatttaaaaattcaggaaacagggttaggtgcagcggctcacgcctgtaatcccagcactttgggaggccaaggcaggaggattgcttgagcccaggagttcaagaacagcctgggcaacatagtgagacctcatctctgtgaaatactaaaaaattagcttcaggcacatgcttgtagtccgatctactcgaaaggctaaggctggaggatgccatgatcctagcagtttgaggctacagtgagctgtgatcacgccatcgcactccatcccgggtggcagagtgagacctgtcttcgt

SEQ ID NO: 229690 - DNA, 370 bp, Homo sapiens
catatacctcgtgacctgggcatgatctttaacttttttcccccacctctctctgagtgtggctaactactgaccacgttttgtcagttccacttcctcactatctctggaagctgtgtactattctacactctcactgccctactctggttcatgccatcactgcttgcctgtaatccttcagtagcatcctaagtggcctcttttctttccttctggtgtcccccttcctctcaatctatcctccatccagattgagctttctgcaatacaaatgagttattttctctcccctgatttcagcctctcgttatcctttggataaggtccaaaacctgtaacacatgaccctcagagccctttgtggtgt

SEQ ID NO: 229691 - DNA, 369 bp, Homo sapiens
agcaggcaaagagtttgtgcagggaaactcttatttttaaaaccatcagatctctggagactcattcactatcagaagaacagcgcaggaaagacccgctcccctaattcagtcaccttccactgggtccctcccacaacatgggggaattcaagattatatttggctggggacacagccagaccatatcaagtggctaatcatcatatgctgttcagagagaaggagactcaggccaaggtcagatatactcgaggcggctgaatgctattgcagggagagctcatcctggaatcggatcagacagaattttggctccgccattattaagtcactgagccactctgacttccagtctcatctattaaa

SEQ ID NO: 229692 - DNA, 453 bp, Homo sapiens
agagattctggtttacctgatgtagggggaatgtgggtattgtcatttttaaaagcttctcagatgtttctagaagctgtgtttgagaatcattgttctagacactctgaccaaatgataagtagtactagtgatagcagacatccttttctggcttctgatcataagcttctagtattgcaccattaatggtgatatgagctgatcatttgagattgactcagtggtgtgttggaggcagctggtacctgctcaaaaggtgtaactgtacacatattttcccaacttcacattcattgacattatgttgatcacttcaaatcagccatggttgattcacatggaaattgacaaatgctaaaatcagcgctccccaccttctctgtcaacctgttcattatttgccagcacatcacagtagatctttattagcttaaagaagtattctttttt

SEQ ID NO: 229693 - DNA, 558 bp, Homo sapiens
atattatagaccatatatatatatatatatatgtttatttttttgagatggagtctcgctctgttgcccaggctggagtgcagtggcacagtcttggctcactgcaacgtctgcctcccaggctcaagtgatcctcccacctcagcctttcaagtagctgggactacaggtgtgcacaaccacacctagctaatttttgtatttttgtagagacggggtttcgccatgttgcccaggctggtctcgaactcctcacctcaggttatctgcccgcctatggtctcccaaagtgctgggattacaggcgtgagccaccgcacccagcctatccctgtctttatagaaacattgtgaaaaggagagagttctgaatgttgatgtccctgaggtagagcaattgcatgtacccaaaatctgtgtgttttcatttgtgagcatctagtccagtgccctcccttcacttgctctgagggtgtaggatgttgtgatacccattagctaattacctttggaaatgatttcagaggattagaatgccacttcagccacccatttttt

SEQ ID NO: 229694 - DNA, 356 bp, Homo sapiens
gtacaagtgtaattttgttacatgcatagattgcatagtggtgaagttaaggcttttaggatatccatcatccaaataatgtacatcgtacctatcaagtattctcttattgtccaccagagtttgatttctttagattccacatattaactgagatcatgcagtatttgtccttctgtgtttggcttatttcacttagcataatgactcttaggttcacctgtattgtcacaaatggtaggatttctttttttttttttttttttgaggctgaataatactccatcgtatgtatataccatttttaatccattcatctatagatggtcacctaggtttccatagcttagctattg

SEQ ID NO: 229695 - DNA, 444 bp, Homo sapiens
atgtctctctttcttcatttgtagattgtatataaatttcaagtagacagttatcttttctcctttgaaaatttcattgtttagtgttgctgatacagttagcataattatttttcttttgttagatcatttgtctcttttctggtagctcttaagattttctctttgtctttcgcatgctgcatttttgcataattggtagaaaggacttattttgctcagaactcttttttttttttttaaacagcatctctctgtcacccaggcctgagtgcagtggcacgatcatagctcgctttaccattttcctccctgggctccagctactcgggaggctgaggcaggagaagtgcttaaacccgggaggcggaggctgcagtgagccgagatcacgccattgcactccagcttgggcaacaagagtgaatctccatctcaaaagaa

SEQ ID NO: 229696 - DNA, 501 bp, Homo sapiens
ctggcagcctcgggtgttccctaagagggatttctttcttagatgtattactactttttctagggattagccaagcctagcctctcagatcatattgctccaggttccctcaaatgactaataagaatgtgatgtgtttgtttttgtttgtttgtttttgagacggagtctcactctgttgtccaggctggggtgcaatggtgcgatctcgctcactgcaacctccacctcgattcttgtgcctcaggctcccgagcagctgggactacaggtgtgtaacactacacccggataatttttgtatttttagttggagacggagtttcaccatattggccaggctggtctcaaactcctgacctcaagtgatccgcccgcctcggcctcccaaagtgctgagattacaggcatgagccaccgcgcccaaccgaatgtgatatttttatgaccatgagaaaagaagggctgcattctttggtgggtccgcaaaattaaaaaaaa

SEQ ID NO: 229697 - DNA, 326 bp, Homo sapiens
attccatatttttagtggggtattggttatacaggtagatatatttgtcagaattcattgaactgagaacttaaaatctgtgcattttccgaacacttcaacagaaataataaaataagaaaaatgtttaaatggaaaaaattactaagcatgaaagcaataatcgagtggatatagattgttatataacaagtagaatatctaattgtgagagaaagcagagtaaaagaatcatcaacataggctggagtggagtcaatccaggaatgctccctatttgtgtgtatgagctgggttttggggaaaggatgagctgtagatggcca

SEQ ID NO: 229698 - DNA, 2053 bp, Homo sapiens
cacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagatctctataaaaatggactccaaagagctaactttgtaccattcatagcagtcttgaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaa

SEQ ID NO: 229699 - DNA, 2889 bp, Homo sapiens
cacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaaggtcagtgactgtgccatgagtagtccgagccgactgcatatgactggagaagcctctgggattaccctccctgtccgatctaccccaggtgtctcctgctttcacgaagctgagggctcctcgagaggagtttccatttctcttgaccttttatactgtctgtgaatgagccctgagcactgagggaaatgaccctgagtgactttcattttgagggtcagaggttgactcagagtttgttccttccgggacgtttagagagctgaacctagtgggagtgcctggcttgaagagatgcaggtgtggggttggggcctggggacccctaccctctgcgttttccaagctctcggggctggtgactgacgggcactggaggaagagccgcgcctgggacctctgcaggccctgatgtctctcgtgattctaggaaggaaggtccacacacattctcagattgagggatcgattcttggtgttcttttcaagtcactaggggcttcagtggaattattttgtcaccgggctttctttctccctggcttccttcattcagttatatgttcatgaatgaatgaatgaatgtatattctgagtaaccaagagtgccagttttactgctctattcatgtattcgcactaaactgcacgattttcaaagagatgaggtcttgctatgttgccaaggctggagtgcagtggccattcacaggtatgatcatggtgctctgcagcctccaacttttggtttcaagggatcctcctgcctcagcctcccaagtagctgggactacagatgtgtgccactccacccagcctcaactttaaaaaattagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagatctctataaaaatggactccaaagagctaactttgtaccattcatagcagtcttgaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaa

SEQ ID NO: 229700 - DNA, 1616 bp, Homo sapiens
cacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaaggaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaa

SEQ ID NO: 229701 - DNA, 1733 bp, Homo sapiens
cacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaaggtcagtgactgtgccatgagtagtccgagccgactgcatatgactggagaagcctctgggattaccctccctgtccgatctaccccaggtgtctcctgctttcacgaagctgagggctcctcgagaggagtttccatttctcttgaccttttatactgtctgtgaatgagccctgagcactgagggaaatgaccctgagtgactttcattttgagggtcagaggttgactcagagtttgttccttccgggacgtttagagagctgaacctagtgggagtgcctggcttgaagagatgcaggtgtggggttggggcctggggacccctaccctctgcgttttccaagctctcggggctggtgactgacgggcactggaggaagagccgcgcctgggacctctgcaggccctgatgtctctcgtgattctaggaaggaaggtccacacacattctcagattgagggatcgattcttggtgttcttttcaagtcactaggggcttcagtggaattattttgtcaccgggctttctttctccctggcttccttcattcagttatatgttcatgaatgaatgaatgaatgtatattctgagtaaccaagagtgccagttttactgctctattcatgtattcgcactaaactgcacgattttcaaagagatgaggtcttgctatgttgccaaggctggagtgcagtggccattcacaggtatgatcatggtgctctgcagcctccaacttttggtttcaagggatcctcctgcctcagcctcccaagtagctgggactacagatgtgtgccactccacccagcctcaactttaaaaaattagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcagggctcctggaacattggctggatggccatggattccggaaaccggctttttggaaaatccgggtccaaaacgggggtct

SEQ ID NO: 229702 - DNA, 456 bp, Homo sapiens
cacagagacactgacgttagtgtttttggtatttagtgacttgtgaaatcacaggtgacttctgatagtgcagacttagggcactattggggtgggggaaaagaaggcagaagccagactgcagtggggtgagcaaatgtgagttcaggaagtggagatagtggaggctgatttggagaagtctggatgaggaggaacaaggagatgccttttttttttttttttaaggataaactatacttgaacattttttcccattaaacatacatgtattggggtacctgcccacagcctttttaatctgctgtggcacattgcctctactgagttgcatgatcttgtcttccctctgatcctacctcacagagaagagtagcccgttcacaatgacctatgtattgtgtgacctgtttgtattttcttgtaggaatttgaattaaaagacacagacaagtt

SEQ ID NO: 229703 - DNA, 511 bp, Homo sapiens
atagtagtctttaatactttaaaggattaaaacagtaatgcaacactgtctacgtgctaggacctgaactaaatacttggaaatattttattttatcaacccaatgaggatgatacaattattatgcctctttaacagatgaagaaattgtagtttagaaaagaaagtagctgttcaaatacacactacactacaggtggcaaaatagggctttcacctgggtaggatgattctagaatgccactttacagccactgaaatatattgcctcccaaatgattctttctgctcaaagagttttttttaagttatctacttatttatattctgcttttttcaaaaagaatgtgagaacagtacaaaatgtgttcagtatagcaaattaaaattaattaaaaagtaagaaaaagaagccaatttgggcaacccactcgggtccccttccacgctgtggaagctttgttgtttcgctcttcgcaataataaatgagcttgatgttttattgagtac

SEQ ID NO: 229704 - DNA, 461 bp, Homo sapiens
acaataaaataaaaaaatttgtagaatgggaaaaaatatttgcaaaccatacatctgataaaagattgatatacaaaatatataagaaatgcaagcagattaaaagcaaaaacaacagtaacccagttcaaaataggcaaaaactaaactgatatttgtccaatgaagacatacaaatggccaagagataagccataaagtactcaatatcaccaaatatctggcaattgcaaatcaaaaccatgatgagtatcatttcaaacatgttagaatggataatgtaaaaagaagaaacataacaagtgttgacaacactttgaagaaaaaaattctgtacattcttggagagttataaattgatggagtcattacaaaaaccaatagaggttatttgaaatacagaactactgcgcaatctagcaatagtagtattgtgtatataatactgtttatataacaaa

SEQ ID NO: 229705 - DNA, 435 bp, Homo sapiens
ctcaaaatcatttactaaacagtctgtcctttctgaattgattcctcttgctaactttatcacgtattgtttctgtctgcacatgggtttgtctctgcattctctgtccattggtctgattgtctgctcttgtgtaaacactacaatgtttttattactatagtgatatctgtactatatctcaacacccaataagacaaattctctttttttttcaaaggttgactttaactatttatgggcctttaaaatttttaagtttttgagttactaaaaaattcaacttgaatttttattgggattgcattaaatgtataggctaattgggaaaaattgtccattttataatattaattattccttctaacaatgtaaatatattccatttattcagattattttctgtgtgttttattaaaattttacatttttctc

SEQ ID NO: 229706 - DNA, 620 bp, Homo sapiens
gaaaactataccatctgggtcattttatgtttgcatttgcttattgttttttcctttgaaagttggtcacatttttctagttctttgtgtgtcaagtaattcttgtaccctggacatttatcctgaccatatgttataagactctgatcctgttggccaatattccctggagaatatctatgtttttgtcttagtagacaaccacacttcagatattacaagttctttgtcatcttgtgtggctgttggttccactgtcagttcagttttcaagacctttgctgtgttgctttgggtctgtcccatgcatgtcctgcttaagggttaatctggggcttgggcagtggtttatatcattgttcagttctcaaagccttttctgtgctgctttgaatctaccctgtgcatgcatagctcaagagggaacctaagatgtatgccaattcacatacagaattaggagatcctcttgttcagctcattcctttgcagttctcctcccatattctttggccttcagagtcctcttttcccagtcctcaggccagaaagatggggtttctctgagttttacattcacataccaccactgcaacagttcaaaaccacaagagaaaata

SEQ ID NO: 229707 - DNA, 431 bp, Homo sapiens
ttgccaagtttttcaggaagtgctagtggccattttgatgatgtgaactagattttaaaacagaaagaggaaaaatgaatgtggtggacaagggctgctgacaatattagatagaatcagagatggagtctcactatgttgcccagtctggacttgaagtcttggcctcaagcaaacccccttgcgtcagcctctgaaagtgctgggattacaggcatgagctaccgtgcttgccttctcctccttctccttctccttcttctcctcctcctcctccttctccttcttcttcattgttaattttaggtgcagcaattccatccaggggataaaagatttatttattttattttatcattttttaaaatttattttttcgagatcgcgacagtgcgctacagcctgggcgacagagggagactcgtctcaaa

SEQ ID NO: 229708 - DNA, 1021 bp, Homo sapiens
gacttcccaagatacttccttagaaacaggacaaggatatgaagatgaacaagatggctggaacagttcttcgaaaactactcgagtaaatgaaaatattactaatcaaggcaatcaaatagtttccctaatcatcatccaggaagagaacggtcctaggcctgaagagggaggtgtttcttctgacaacccatacaactcaaaaagagcagagctagtcactgctagatctcaggaagggtccataaatggaatcactttccaaggtgtccctatggtgatgggagcagggtgtatctctcaaccagagcagtcctcccctgagtctgcccttacccaccagagcaatgagggaaattccacatgtgaggtacatcagaaaggatcccatggagtccaaaaatcatacaaatgtgaagaatgccccaaggtctttaagtatctctgtcacttattagctcaccagagaagacacaggaatgagaggccatttgtttgtcccgagtgtcaaaaaggcttcttccagatatcagacctacgggtgcatcagataattcacacaggaaagaagcctttcacatgcagcatgtgtaaaaagtccttcagccacaaaaccaacctgcggtctcatgagagaatccacacaggagaaaagccttatacatgtcccttttgtaagacaagctaccgccagtcatccacataccaccgccatatgaggactcatgagaaaattaccctgccaagtgttccctccacaccagaagcttcctaagctgctggtctgataatgtgtataaatatgtatgcaagtatgtatattcctatagtatttatctacttaggatataagatataatctcctgattatgctttcaatttattgtcttgcttcattaaaatgtaaggctaaggagagcatggaatttgtcagttttgttcactaaagtattccaagtggttgggaaagtggaacatttccaagaaccaataaatttctgttgaataaatgaatgaatcc

SEQ ID NO: 229709 - DNA, 261 bp, Homo sapiens
gcattagcagttgatacttgatcagcttgttagatgtagaaggtctcactgaagtttgagaatcacactaactttttaaagtagatttttgtttgtttgtttttgagacggaattttgctcttgtcacccaggctggagtgcaatggcgtgatctcggctcactgcaacatccacctgctgggttcaagcaattctcctgcctcagcctcccgagtagctgggattacaggtgcctgccaccatgcccagctaatttttgt

SEQ ID NO: 229710 - DNA, 831 bp, Homo sapiens
gggagggagggaaggagggaggacttgtatgtgagaagtgacttctaccttactgctttaaaaaatgtatctgtcttttgacaacataaaatgtcttgtgtctaaacatggatcccttgtaattcacgcaacttcttacaagtgaagattacagtttttcatcaaatttgtgaagttttcagctattattaaactattctttaagccaatttctttcttccctctcactcctggtacagtatatcttggtatgcttacttcatggcgttccatagattatataagactatattaatttgtcttatttttctttctcttcagacgagataatcttaattgaagttcctacaagtttgctgattctttcttctgcctgtttaaatctacttttgagttcatctggtgaaatcttcatttcagttgtcataattttccaccccagattctatttagttctttttaatttctgattattgatattctccacttaatgagacatcattctcctactttcctttatttcttcacacatgacttcctaattaggcctttgaacaatgtaatataactgatttataagctactctagttactgtgtctggacttccttagaatgaatttctgttggctgtgctttttcttgcgtataggctgtactttttttttggttttgtgcctgtctcattttttgttgttgttgaaaactgaacatttaaaataatataatttggcaactgtgaaaatcagattcttcattttcctaatgtgtgttatgattggttactgttgcttagtaaacaacagtactgtgactttcctaaactaatccta

SEQ ID NO: 229711 - DNA, 588 bp, Homo sapiens
acacggcctctataaaaaataataataataatgaatgggctgggggcagtagctcacacctgtaatcccaacacttcaggaagccgaggtgggtagatggcttgagtccaggagtttgagactagcctgggtgacatggccaaacccagtctctacaaaaaaatacaaaaattagctgggccctgtagtcccagcacttgggaggctgaggcgggaggatccacttgagcatgggaggtggaagttgcagtgagctgagatcatgccactgcactccagcctagctgacaaaatgagactcaaaaaacaacaaaaaataagtcttggtgtggtggctcacgcctgtaatcccagcactttgggaggccgaggtgggcggatcacctgaggtcaggagtttgagaccagcctggccaacatggtgaaaccccatctctagtaaaaatacaaaaattagccaggcatggtggtgcatgcctgtagtcccacctactcgggaggctgaggcaggagaatcacttgaacccgggaggcggaggttgcagtgagctgagatcgtgccactgcactccagcctgggcaacaaga

SEQ ID NO: 229712 - DNA, 510 bp, Homo sapiens
agtgccaaagttttgaagaatctgatacaaatattgttttttccactccctcatctgaacttctctctcttaaacctaggttcctccataggcttcccctggggaatggtctgtgaggtagcggtcatgggcctcgaagtgttttctggattgatcacggttactgtgtctactctctgctgctagcacactggcatgttagtaattttagctgatatccctgtcccaggttcccttaaaccaagaagctcagatgaggcagctgcgttcatttttttatttttaatttctagatttatttaaatcacagaagtaatatttatttattttgacaatgtaaaatatacagacctgtagaaagagaaatagtctccttcacttgtctcccatcaaattctactcccctagaaatagtttgtgtctttgtatattctttcctttgtacacattagcagatatgatatggatgggttggtttgctgtataaaagtgaccttaaactgtacctat

SEQ ID NO: 229713 - DNA, 1741 bp, Homo sapiens
gaattatgccaagcatttgtataaggctaatgtttagcaggaagcattcatgatcaacgatttatcttgaaaataagattccttcgtctgagggattgatctgtatgtgtgtgtatatttagtttctcatgacaagaaaaatggtattcagtcagctataatatcagtatctataatctatttctcggtaaacatatttgtacatatacacgtttatttttctaatttaacagatgtccttggtatttatttgcattttgtcatagcattcttgctcatatgacctgcactccagcctgggtgacagagccagacttatcccaaaaaaataaatgtacagtttacagagaaatactagacacaggtaagttgaaaataaatagattgaaaagcatattttaagaaaacagtaaaagattgaagtgactatattaatatcaggtaaaatagattgcaacagaaaaattttgtatcaggtaatgtggattcttcatagtaacaaaagttcatcaggaggacatatcaatcataagtgtatatttatttaatgcagaatgacttaatacatgaaaactgactaaaggcagaaatagttccacaatcagattgagattttaatgtaactctttcagcaactaataaaaaaaaattactcagaagatttggaatttattattagccattcttgatcatattgatgtttattaaacgttatatcttacagctagagaattctcattcttttcacatgcatatggtacattcaccaaaacagagcatgctgggctttgtacatgctgggccataaggtacaaaggattaagattatatagagtatgaattttgaccgcagtggaattaaatttcaagtatttggaaagtgacacacttttttgtaatcagttggtcaagaaatgtcaaagggaaatcagaaaatattttggaccgagtgattgtggaaatgcaagataacaatttatgagatgaagctaaagcagtgtttggaggaaatttatatatttaattatgttggaataaaactacaattatctaatttcctacctaattaaacatttaaagaaaacagcaaggtaaacccaaggtaatgtaaaaaaaggaaataataataaattcttgaaatagaatacggacaagtagagaaaaataatgaaactaaaaagagttcttggaaaagttagttaagataaagctctaattagactaatccagaataagagagaagacactaattaccagtatatttaataaaataggagacatcactgtcgatcatatggacattaaaaggccttataagagaatatcataaacagctctaagccagtaaattagacaacttagttgaaaaaaataaattctttggaaaacacaaattattacccaggagcaatagaaaattttagtatccctatattgattagagaagctgaatttgcaattaaaaattattccaccaagacaatgtgaagcctaaatggccacactaataaattttatcaaacttcaagaaagaaatattgtgaatcttatgtaaagtcttccattaagaaaaaaaaatgagaatacttcttaactcattttattataacaaattggtaactatcattgttactgtgatactaaaattcaacaaagataacagcaaaacaaagaatcagtattcttcatggatatagatgtaaacattttaaacaaaatttgagcaaattaaattaacgat

SEQ ID NO: 229714 - DNA, 524 bp, Homo sapiens
atgcaaaggttataagtccacctgtgctatttagtaactgtgtaacttctctctgcctcaatttctttgtgcagtggggatagtaatatggttctgagtctacctgtgctatttagtaactgtgtaacctctctctgcctcagtttctttatctgtgcaaccccttcctcatggggttgttgtaaggattaagtgagctaatagatgtaaaacacttggaattgtgcctggcatatagagctcagtaagtataagctatgattaatgacaccatcatgctctccccatacatcacccatgacagtccacctgttgaggaaagtaggggttgtgtttacagttttatgaggtagattgagttatagttggatatctttaaacttggaaaaaaaggtgtgtgtgccggataggtaaggggcctgatgtgatgagcaaacacctttgtctatgatagtatatatatttttaaattcagctatgaaacagaagatttgacagaaataaagagctaataatttctcctt

SEQ ID NO: 229715 - DNA, 758 bp, Homo sapiens
gggaggctgaggcgggtaaatcacctgaggtcaggagtttgagagcagcctggccaacatagtgaaaccccgtctctacgaaaaatacaaaaaattagctgggcatcgtggcaggcacctgtaatcccagcttctagggaggctgaggcaggagaatcacttgaacctgggaggcggaggttgcagtgagccaagatcacaccattgcactccagcctgggcaacaagagcaaaagtccatctcaaaaaataaaaattaaaaaaagcaataaattgatttacagtcaacagaacacagacattagaaagtagttgaggcaccagagtctatggagaatgaaattaagatgggatgaaaggcagcatttgaatccattgctgtttaaatgctgtatttctgttttcctcatgatcgcacttaatgttaaaaacaagtatgcaaattcaaccttggcacattagtgagttatcaggccatttggatactttgagattcttattttaaccagtactgttgattgtgaggctatgtctgtgtatgtgagtgtgtgtgtgcttgtgtgtgttgtaaacgtaaatatttaaattggttcattataatctgtgaaaattaacctaactttatctgaaaaaaaattgcaagtggcaacggtagacattcttgtgtcctgcctatgggtagatagaagcttttttcattttatttgtttgatagttttctagcaaatttatttaattagtaaaagaatcgagagaga

SEQ ID NO: 229716 - DNA, 646 bp, Homo sapiens
gccacattttcttaatgcagtctatcattgttggacatttgggttggttcagtatattgaaatttgatcctcaatgtggcagtgttgggaggtgtagcctagtgggaagtgtttgtgttatgggggcagatccctcatgaatgtcttgctgctgttctcacagtagtaagttcttgctctcttgaggctagattagttcttgaaggaattgattatttcccgaatgagtgggttgttataaagccaggacacccctcaggttttcccctctttgcacctgtctgcttcccctttgattttctccaccatgttatgcagcacaaaagccctcaccagaagccaaggctatgcccacaaacttttcagcctatagaaccataagctagtctcaggtatttttctatagcaacacaaaatggactaagacagaactgttcagtgaattaaagttgtaattatgaaattcccaaaaaagaaatatccaggctcagatgctcttattgaagaagtctaccaaactttttaaggaagaattaaaactaattctacataatctcttccagaaaatagaagaggaagagacattttccagttaatgttaagaaatgttttaccttgcttatatcaaaaccaaagacattacaga

SEQ ID NO: 229717 - DNA, 547 bp, Homo sapiens
tgagcgcctgggtctgcacgttggcagttttattatttagcatttttccaaggagatgagatttacatatacttgcaagtaacttagtcagtccgaggtgggagtcctgcagtgtgggtttctgctgctatgggtctgagaagaggctgtaaggactcctcaggaggttgttaactgtcttccctccccccatcaccagcctgtgttcctgggtattgacgtgtagctacccgcagctctccccttgcctctgcttttcacatagttcccaggaggcataatttctgctgtaaatcaattaaaacttctagagcgctctacacggtgctaacatgcttttactgcctaatcctcacactgtctttgtgatgcaggtgtcatcgttcccactttgagatgatggaatgataattataataaagtagtctggtttggcaaagtggagtacgccatttgaagactctcaggagtttaatagtttaagttctggagggagtcagttttgaacccaatatcagtattgaaaatgtttgaaatttacaagtgg

SEQ ID NO: 229718 - DNA, 226 bp, Homo sapiens
ttatatataaatatttatataattatataataaatataaaaatttagtttctttttttaaccctcttataccagggagaatggctattttaaaaaaaaattttttattatactttaagttctagggtacatgtgcacaacgaataatttagtttctaattaaacatttaaatgcatatttaaccattggctttttttgcttaataaaggtaatgtttgataatatg

SEQ ID NO: 229719 - DNA, 891 bp, Homo sapiens
tggacacataacaaacaattactgagcaactactttgtgtaaaacattacactagggactagaaataaaaaatttcttaagaccttgttcttaacctgtggagtttctgttacagagcatgtcattctgacatggggcgagttgtgccctcccccaattttttcttctctaccaggatttcctgaccatctttcaagatctttcttgatgaaactacccaacaatgccatgataaactttattgctgtttctgtactcgtcttccttggtagacagtgtagaagagaaacattttgtgttgtttagatttgaatctgttagattcatgatgtttattaacatgtgtgcattgacccataagtggggtgtgaaattggtagatttttgactggtactttaaaaaactggagtagaagagaacggaaactgtcaaagtgattcacacattaagaatgagtaatgcttcatgaaatttgtttctattatttatgtgagtgtcttgagtcacaatgtaaaatatttttactaaggatcatttaaaaaatcaataaaacactggaggctcagtaatttgggatagactataggaagaaacctagacctagagattctgaagttttcagattataaacagatctatactatacatagaaagcaatgggttacacaagtttatagcttaagtaaaccaataaaatagcaaacatgtctatacattaaggcaggagtcagcaaactatttctgtaaagatagtaaatattttaggttttatagactataagtttcctgtcacgactctgcaactctaccatcatagcacaaacgcagccacagatgatgtgtaatggaatgacaatggctgggttccaataaaatttgaattttacata

SEQ ID NO: 229720 - DNA, 509 bp, Homo sapiens
taaaaataaataaataaataaataatggaattataattcatgtgttttatatgtttgatataaggaataaaaataaatacacatcctctctaatgtctaattcttttgcatcatacctggtatgctactgtaatttacctttcttatttttggttatcgtggtggtttccacttttgcctattgtaaataatgttgcagcagacatcattttatataagtcttttggtacagattttggattttcttttaaggataaattgttagatgcacaatgataaagaattttcttatttcttatattgcttacttatcttagaagattataccaatttatactaaactgagaatattttcaaaatatatgcagagtctgaatacttctcactaactttacttataccacttggtcaaagccactatcatctctcacttaaactttggcagtagcttcctaactggaagtatagactgccccctacagtctgtactccacataacagaagtttta

SEQ ID NO: 229721 - DNA, 486 bp, Homo sapiens
gaaggtgaggctgtatcacagagggctgtgtaatttaaagagctgcaagttcattaactttctagagttatatcctagtttgtaggataaatagaatgggtgtgagaaagaaaatcatgaaaaaaattccttttagatggatcacagattaggaaaaattcagtgaaaaaactggaagaggcctgctttggaaataaggtgtacactgtttagaccttagctttgtcgtacagacctagggaatagaagcccatgaaagtttgcaggattttgacagtttctctccaatctttctgctgaaagtatagaataaggagtgatccagattgcacaggggtgaattttccataatccaggactaaatgtggcagatgccaaatttatgagtgttagtaatcttcaccctgttgttcttgggatttttccatgaggagagaaaagaaagaattatctggattctagttccagccttgccactacctaaaa

SEQ ID NO: 229722 - DNA, 136 bp, Homo sapiens
gctcagcctcatcagcttggaaaaggctgccacaggcactcgtgctgctcatgtgcactttgtgtctaattattttcttggcaaccagtggataaatggcagcttcttccttttctgggagacagagagtgggagg

SEQ ID NO: 229723 - DNA, 981 bp, Homo sapiens
ttaaattctatattgacccttcaatgcctaagcaattaagtcccaatttcttaacctcacactcaaagcctttacaatttagttttcaactgccttcctaaacttccccatcttccaccctttaagtcctgatctactcacagttttccacacctaccctgaatttccccactttagtttcattaatagttttgtcactgcaatgacagaactgttaaagcccagcttaaatttatttaaaagtttacaagttgttctgggaatcatatagtttgatcctcagtagtgataaaacaacataaaattatgaaaaatgttattataacataatggaatttcctctactttaaatatttattttgcaccatccctgacctcactaccaaaaaaaaaaaattcaaagtgcctgaggtttccaggcattcttagctctatttacttacttcccacctcaaatggccttagaattcaaattctgtagaaaatggattgccataaataatccaatgaaaatgggtcatattttgccattaatagaatcacagtcaacaaggactaatagaattagtcacttaagtatctttagatatgggagacaacagaaacagtaagaatctcttctctttgttcccagccttgaatataactaggaagccttcccagaagaaagcagctgtgaagggtacccatcaggaatatccggctcagaagccagggcctcagagactgttctctcactgagacctagagagggaactccctgtgttattctcactgatggcccaggaaccacccttgcaagtcatgaccaccagcatcatgtagcactggaactgatctgggcaatgacctctgtctaaacttctgaatcccctccgacaaagacccaagacagcagcatggccatgcagctgtgctcacatctcacccctgcactggccaggaacacatctatctttcctttgggtagggtcacccaac

SEQ ID NO: 229724 - DNA, 124 bp, Homo sapiens
actatacttcttgttataatgcaaatggcatattgttcttcttccggcattaacattaatttgtactttctatgacattagctgtataacaatgtgttctgaatctgttaaggagaagtcctcc

SEQ ID NO: 229725 - DNA, 412 bp, Homo sapiens
ccataactatgagctaccaaccgcagagactgagagcttggcctgagttgtgccttcagaagggactctcttggcccctggggtacctaggggctcacaaaactgaggagtaggccaggcgcggtggctcacacctgtaatcccagcactttggaaggccgaggtgggcagatcatgaggtcaggagatcgagaccatcctggctaacacagtgaaaccccatctctactaaaaatacaaaaaattagccgggcgtagtggcgggcgcctgtagtcccagctacatgggaggctgaggcaggagaatggcatgaacccgggaggcggagcttgcagtaagccaagatcgagtcactgcactccagcctgggtgacagagcaagactccatctcaaaaaaaacaaaaaacaaa

SEQ ID NO: 229726 - DNA, 439 bp, Homo sapiens
tgtgaaatgcagggacaggttcagggacttgcccaaggacatgtggtgagtaagtggcaaggttaagattcaaacccagttctcctacctcccactgtacagtcttcagaactttttaaaggataagaaccaaatgagaggatgcacttctatagtgcgcactatgtgctgggcaccattgcagtttacaaattttaacttatttaatccttctgataatgctatgtggtaggtacaacctttcacccacattttataggtgaggaaactgaagtacagagatgttgagtaacttgtccaaggtcacagataagaaatagcaactgggcatggtggcttatgcctgtaatcccagcattttgggaggctgaggcgggaggatcacttgagaccaggaattcaagaccagcctgggctacacagtgagactctgtgtata

SEQ ID NO: 229727 - DNA, 612 bp, Homo sapiens
gattatgatgggaatacctcacagggcactgcacaggctactgaactgcgtcccaaacctccaccttcctgcgtgaaggttcccaaagaaaaacctgtccttggcactgacttctacatagacttgctatataaatagggaaagccaggcacctctcagtttctgcatccagaaaatatattaacatttattataaagatcaattgaaacagagaatgtggcgttcttgtagcagtgtgtaatgaggaataaaactggaagtaataataataacaacatcaaataaattactggaacactgatttatgcatgtgatgctactaagtaatttcatactttatttcatgtttattttccccattttacctacggggaaaatgaggctcagagagattagcaactcctcaaagatcatgccttaagaagtggtcaagctgagatggaaactttggctgtccaatagcagaggccgagcttcagcccttcttctatattgtctttttactgttacatctgctgtgattgttatttatttggggtgttttagcaaaagttgtatttgaaatgggaaattgtagaattataattaaatgcagagttgtacaatttgca

SEQ ID NO: 229728 - DNA, 349 bp, Homo sapiens
agcagaggactggagtgtagggtagccatagtaatccaggtaagaggccatatgggtctgggcagggatggttgcagtgcaggcagtgagaagctgcagacactgaatttgttgttgttgtttttatttttgagacagagtctggctatgtctttctggctggagtacagtgccacgattttggctcactgctacctctgcctcccaggtgccagtgattctcgtgacccagctactcaggaggctgaggcaagagaatcacttgaacctgggaggcagaggttgtggtgagctgagactgcaccactacactccagcctgggtaaccgagtgagactccatctcgaag

SEQ ID NO: 229729 - DNA, 380 bp, Homo sapiens
acccctgaggattatcaaggtcccttggggaataaggacctcagtgtggaacaggagccctgccaggtgtgggggtacccctggaggactgggggattggctgacctaactcaagttatatctcacttgagatctaactcaagtgactcttcccatgtgaagatccctcccagactgccaaagcaaagactattactctaactttttgtttttgttttttctttttttgcgggggatggagtctctctctgccaccctaaattcatgctaaagatttctagtgtcttaccatatgctaggaaatgtggatagagtagtaaacaagagcaagtcctgcccttggggagtttatattctagagagttagaaagattacaaaa

SEQ ID NO: 229730 - DNA, 548 bp, Homo sapiens
agatttactatctggccctttacagaaaaagtttgctgacttgtgctctacccagtgactcatgaatcatgcatgaggttttacagtctagctgttgagagtaggtactattcctggccctatgtgtgggcactgggtactattatctctaatattttccagagactgaaaatctctggaattctctttctgtgcaggcttgtcttcagtactcagtcctgggaattccagtaatgttgatttgcttggactcttgacttcatttccatcacaactcagggagtctgccaggctctgtctggattattcttcctcacagtgtgacctagaaactttcacagggcagtgagttggggcagtgattggactcttgctttgttgcccttctctgggagatcattgtcttttgttgcctgatgccaattgtcttaataaatccaattctttttactccatcttatccagaagattgagaagttgatttggggcatgttgaatgtaaagttgaatccaggggtgaagtagaagctaaagatatgaatgtgggg

SEQ ID NO: 229731 - DNA, 450 bp, Homo sapiens
gtgaggatctcctttagaagaggagaagccttgcatcaacctcttgggcctcagccaagatgtctgagataccgtccactatagtctccaagaacatgaccaatgacaagaacagcctggaatccatgaacatcagctcttcttcaagcactgaagagaacccaaagaaacaggcaagaaaaaacgaagaacatggtcctgacccttcagcgaaccctttccacttatctggggatgtggatttcttcttgctcagagatcaggagcggaataaggctctctccgtgagtatccaggacagacgccagcacctccgggagcttccctgctcccactgcttcctggagtggccacattgcccttctcagaggagcactttcctcaggtccttctcattccagaatagtcaatagctcaccacttactataaaatcagctggaaaccttaaa

SEQ ID NO: 229732 - DNA, 213 bp, Homo sapiens
ccgcctcaaagagccggcccgatcatcgcctcctagaatacccagctcaacgtctacctggagtcggctctacaggacgcgctcatctcaaacccagagctcaggcttttagggcagagagcgagagaaaggcttgctttacagaaagggaaactgaggtccaaggaataggattgcctgccgctcgaagaaacgtaatcccattcactcgtt

SEQ ID NO: 229733 - DNA, 490 bp, Homo sapiens
tacgtcatgcatttcagagtgcgtattaggaatcagaggacaaatggcttgagaatgtcacacagaaagtgcatagcataactgcagcagcacatgactgaatttcctgggcgcaaaagctgttgaggactgaaagtcactcagtagcccatctcgtgttttggatgcaattctttgaacttttagagtagcagattccatcagggaggccacatgtggatttaagcagataatttgtataggcacaaatcatatcattttgactaagttttttggaatgaaattgatatctgctttatcaccacttgtacttattggactattttggctttttagaaccttacttgttagaaaaaaaggctttctgttattaaggttgtttgaataggctgaagcaggagaatcgcttgaacccgagaggcggaggttgcagtgagccgagatcatgccactgcactccagcctgggtgacagagtgagactccatctc

SEQ ID NO: 229734 - DNA, 459 bp, Homo sapiens
taaagaatagctaatataattttaacattttgaaataagtaaaagataaggcaaaattgctatgaagaaaaataaaggcaattagaaactcttggaaaaacaaaatgctgtacaaaacaggaaactaatcaatgtattccacttgattctacagtaaaccacatttacttagctaaacactgttaattgattttaagcttttatacacaacctataaacaaggcatgagacacaattgtgctcataaataaaatgtaaatgtcatcaacttttaacaacagagagataaaaattcaaatgataaagactgggaagtgagaagtaatgcacaggggtgaaggaaaagttggatggactcatctttcaaagttgtgaaaatcaaggattcatcaaaatgtggaatcaaggattacagcccaatgacaaatgtagaaataaaattgtatacgttttacagtt

SEQ ID NO: 229735 - DNA, 387 bp, Homo sapiens
ttaaaactttcttggcctttacttttgcttcaggatattgcctccatgaaattagacatataaggattaaatgtccctacaaatgcaaaaaatttataatttaaggggaagtctatagaggggccatttggatcaattgaattctaataatttttaaaaggcaccaaaattccaaagtgctagccagattaaagtactcttatgctaagaaaccaacaaactgtattgaacatttctttgcctatttataaatcatgaccacaattatcagtagatatcaaatgccagttagagttgtttagccccaagaagacttattcttcttgtggctaactaatatgtcagagataaatcacacattctcagacctcaatatgattttctaaa

SEQ ID NO: 229736 - DNA, 495 bp, Homo sapiens
agaaaagttctccaagtccccactcgacccaggaagtccagctggcttcaagtctcataagtatattcagtcaagcagccagtgccactgctctgcctatggagtagccattcttttattccctttcttaataagtttgctttcaatttatggactcgcccagaattctttcttgcacaaggtccaagaaccctcttgaggtctggattggaacccctttctgataacagagtgaaaccctgaactacacctaccagaccaaaccagtaaggagtttaactacagtaactgagctttacttcatggcaggaaactctgtaaccagttaagcaatgaagttataatcaaattagctgtctccatcacacacttctgtttcctataggtgctgtcagatcaggttcctgattggagttctcttatctgctctggtttggagggctgccccattcgggaatctgttttgttttgctcaaatacactcagtaaaaacat

SEQ ID NO: 229737 - DNA, 410 bp, Homo sapiens
tacccactctctgatgtctgcatatctcattcctctcagttgtgggacaagaactcggaactcactgaactacaaaagaacttaacattcctactcgccaaactacaagagtaaaagagctataacagtagctggtcatgtccaaatggtttgtcaatctatgagaggagatactgtagttaataaaccagcagaaagataatgcatattggtccagaattttcaagaacagattgggtctctttaggttggaactgttcattcatggatccactagaaacaaagaaattgtactttccctgcagggtagatcatggaagggtattatttttattcatgtattgatatattggttcatttaatatgtagtgaggattatctaaatacctaacactggaccagcaactaca

SEQ ID NO: 229738 - DNA, 386 bp, Homo sapiens
aatgcatgtaagcctttagcacagtgtctgcctaagttagcatccagtaaatgttagctgctgcaataataagaaatattatagtattaagttattgttatttctgtgagggtgctggttttctgaatgctgagacattggtgatctttgctcctgaacgtgttactatttggaatactgcctttattcagcagcagattcagttcagatttactgaacacctactatgccaggaattgatctaaataagcaaaacaaaaatcctgctctcttgaaacttactttctggttaggagagacaaaactttcattaaccaaccctagcagtcttaacctttacatactttttgattgttcctgttgctgtgcttgagagtgtttggagg

SEQ ID NO: 229739 - DNA, 505 bp, Homo sapiens
gaaaacatatcaatagttttattaaatgtaaacacctaaacatactaattaaaggacagattttcacattgaaattttataaaattacttaaatataggctatatataagaaattaacctgatgagcaaaatggctgaacagaatcctctagcgatcatccccccacaggaacaccaaactgaacaactattcacacaaaacaagcaccttcataagaagcaaaaaacaggtgaaccggtacctggctttaacatcgtattaaggaaagaggcactgaagaggatttgaaagacaatcttgagtcacctataccacccctttcccgtacttcacctttggccatgtggtgttaagagacaatctgtgcacttgcatgagggagagtgcagtgattgtgggaatttgccttggaactcagtgctgccctgtcacagtggaaagccacacagggaagaacttagctggtgcccacagagggagcatttagactaatcctagccagag

SEQ ID NO: 229740 - DNA, 390 bp, Homo sapiens
tgcaacattcactctgagaaccgatgtggaactaatagcagcctttttatttccaatctttgaggtcacaagcagttgccctagcctgaaccctgtaagatttttctataggaagctctctttcaatgggtcatctccttaatgtatctcaacaggtctgcctggatgtttgaaatgagatgtgattcctgctaactactgtcaccaccaacatacacctctgaataggaggaataagttttacctttggaaaaaagccctgggcaattcaagtgaagcaacaacttggtgattttcttcttgggcattttatcacctttcaagttacatccaaggagcatctatttggggtcgacgcggccgcgaatttagtaatagtagtagtaggcg

SEQ ID NO: 229741 - DNA, 518 bp, Homo sapiens
tgcaacattcactctgagaaccgatgtggaactaatagcagcctttttatttccaatctttgaggtcacaagcagttgccctagcctgaaccctgtaagatttttctataggaagctctctttcaatgggtcatctccttaatgtatctcaacaggtctgcctggatgtttgaaatgagatgtgattcctgctaactactgtcaccaccaacatacacctctgaataggaggaataagttttacctttggaaaaaagccctgggcaattcaagtgaagcaacaacttggtgattttcttcttgggcattttatcacctttcaagttacatccaaggagcatctatttggggatatgtttgattgtctcaaaaaaatacaacagcgaaacaaaactcacaaatgtctgttacgtgaaggaagtgtgaatgaaatagagcatggtgggagagatttcctagctccgtttttcagcctggattgattaactctaataaattcaggaaggtgatttcagatg

SEQ ID NO: 229742 - DNA, 532 bp, Homo sapiens
tgccaggtcagccaacttttcaagaaatggcaaaaatctgaagtttgaagtgagtatctctaattttaaatgttggttcaacatttttacaaacacaatgcaggcctcacacatagaagtttaaagaactgaaacatctcaatgatcaacatgagaaaatatatagctggaaattgggaaaaaactttattttctgctgtttattctacattactactgatattatcatgactaatactgtaagatttaggctttaaaatatgaaatgcctatatttagtacttatatctgatttaaagtaggaattactcagaatttaaatagaaagtttatataaaataataggaaatggtaatgagtatcaatatgccaatatatagttgagaaagaaatgtattttttaagaaataagcataaaaatgtgttttagtgagagcattacatgtagttagtaattttagtttacaacaatttcacaaaaaaacatttaaatgatatgatctacacagtaggcaagaaatagcttaaagca

SEQ ID NO: 229743 - DNA, 1149 bp, Homo sapiens
aagttttggagtgactcttgatgctaccgcaacgcacttctcagcagataccagtgatgccatacaattggagaggatgctttcataaagcgtgaggtttcctggtcacattcttggctcacagctgaattccacatgagtattatccctctcttggctattagtgctcacgtgactttgtgtaaagcacagataattggaaggcaatcattggacctctttttcatcattatcctccccatccagtttgtgtttctaagccagagttgctaaccactagtagttagcactactagtgatttgtggtttcccatctgtcctggctcatggacatgactcagataggctggaggacatgaggtgcgtggataacacacagattatctgagcattctgggatcactgagatgccctgtggttactgtggaatcgcatcccagaagctccgaccacatccatccatgcagataaacccattttccaggcactcacagcaccattgttaattttccacaaccatctgggaaaagtggtatcttcctgctccacaaaacatatggcagagccgggcgccatggctcacacctgtaaattgtagcattttgggagggcaaggtgggcagatcacttgaggtcaggagtttgaaaccagcctggccaacatggtgaaacctgtctccactgaaaatacaaaaattagccaggtgtgatgatgggcgcctgtattcccagctactcaggaggctgaggcaggagaatggcttgaacccaggagatggaggttgcactgagccaagatggtgccaccacactccagcctgggcaacagagcaagactgtgtctcaaaaaacaacaaaaacaacaacaaaacacgtggtggggagaaggggtaacaccctacacatggtagccaaagttacctgcttttaagtaataaatgtgaacacctactgctatcacatttcaaaggtacattgaacgaaagagtttgtataagaaagatgtcatctaggctgggaaagctattggtagtcttgaattaggggcagagatgctcaaagttatctttgatccccgctttccctgaatcccatagttacccccaagccacccccactctccctaccatccaggctcccaatgctggc

SEQ ID NO: 229744 - DNA, 452 bp, Homo sapiens
gtccccttcatccagcccggggctcttcagtgcagaaaacccacagcagggcggtggaaggaatatgcaccagaaccctgggctgagagccacagccagagacggctggccagaggcctcgctccaggagggctgtaatgggggcccgcggcgatgagctcagaacgcccctcccacaggacagcctcctggaacacacctcagggacaacctccaaggcaccattttggagcaccttctcctgaatccccctggggcaccaaggcagaaatcacagccatgggcagtgcacaaagccaccggctcctggccagaagcactaagtgcctccccaggccaaggctcctccccaacacccaaaaccctgaccctgccgcacggctcaaataattcccatcctcgtgcccctcaaggcgggctatgggaaacacctgcacacaagcaggaagcgc

SEQ ID NO: 229745 - DNA, 310 bp, Homo sapiens
caagccttttgaagagtccgattcagaaataatgttttggagatggccaggtgccctaaccacttcctgaaatctggcctgatttttaatagcttttacctaagttcctcagattctctgattcatagttttcaaaatatcttgtctcctatttttgtatattgttctcggcttcttctgcattttaactcaagtataggcaattctcactatatttactggaattactccaatacgttttagaatattcatggtgctgtgcagccatcactagtatctaattccaaaacacttccattaaccccaactc

SEQ ID NO: 229746 - DNA, 599 bp, Homo sapiens
agcattatcctcagtgtggtcctctgtatgttgcctgtgattgggcaccaatttcttaaaccactattctggcctatcagcatggacaaagtaagtgcaacagaaaatctacgcagatataattcatgaccttcttttgcttttgcctctgtggatgaaaaccctatcccccatgctctggctataggtttttgacagaattcaagagtgcaggagacttccacagcagtccccagtctggaccaaactgaaacactcaagcactcgacgttctgcctatgcattctcccataaacaaggctttggggccctcatcacttctggcaagatagtgaagcccaggatgtccaagagaaacaccctttttttgaaaaagatagaggccctagggaaattccaaaggaggcagtcagtgctcttcctccctcgtactcatgcaacttaggaagaattagagtccctgggaaaccagcataaacctgctccttcattctcactagggactaagcctcttaattgtccagaaggctattcccagaaaggcaaggaggggtaaggaaagagcccccagatatctgccagagttgcagcatttcaag

SEQ ID NO: 229747 - DNA, 358 bp, Homo sapiens
gtcaagctgtgcacgggaaggaccctaaccaaccacccgcactatgaagacagcagcctgagagagcggaccagagcggtttatcagatatatgccaagagggcaccagaggaagtgcatgccctcctaaggtccttcggcactgactacgtaatcctggaagacagcatctgctacgagcggaggcaccgccggggctgccgactccgggacctgctggacattgccaacggccacatgatggatggcccaggagagaatgatcctgatttgaaacctgcagaccaccctcgcttctgtgaagagatcaaaagaaacctgcctccctacgtggcctacttcaccagagtgttccaga

SEQ ID NO: 229748 - DNA, 435 bp, Homo sapiens
aaggaatctgagatgtaaaatatcatgtctgagaacacacagctagtaattggtagagctaagatttgaacctaggcagttcaactccaaagcccgcacttaaagcactatgttcaggataaattattaagaatcatagaaactatatgctatcataaagattgagatgtatgtctgaggtatttttctttatgtagacatcaacagataatctcaatatttggtgtatgttatggcttgttgttgttgttgttgtgggggtagagacagggtctgtttatgttgcctgggacgactggtcttgaactcctgggctcaaagcagtcctcccaccttggcctcccaaattgctaggattacaggcgtgatactatggcttttaacacagtatgagtaaccaaagaataaaggactgacatatagtcatttcgattt

SEQ ID NO: 229749 - DNA, 983 bp, Homo sapiens
  misc_feature (18)..(18): n is a, c, g, or t
  misc_feature (265)..(265): n is a, c, g, or t
aaaaatgaaaatggggcnccagaagatgaagagaattttgaagaagctattaaaaatgtgaacacagcactaaatacaactcagatcccaagcagtattgaagatatatttaatgatgatcgctgcattaaatatcaccaaacagactccatcattttggattttagctcgtgccttaaaggaatttgtggccaaagagggtcaaggaaatttacctgttcgaggcacaattcctgatatgattgcagattcaggcaaatatatnaaactgcaaaacgttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataa

SEQ ID NO: 229750 - DNA, 838 bp, Homo sapiens
gggcagcctgagctccacacctagacatcttttcccaaataagtgtggtcagaagaaatcctaggaagtactttctctcaaacctgaattttgggtcagtttaccagctagccatgatagcatgcgcctgtagtcctagcaacttgggagactgaggcagaggatggcttgagaccaggagtttgaggctgcagtgagccatgatagcaccactgctatcatgctaaaggaatctagcaggacaggacactaacgggtttgtggaggtcagttgagtcctggctttatcactagctcttcacacatccctggagaattacctaggcttctatgtttccaacatcacatctctaatatcagtggttccaggcattgtgtgtgtattatctataataattgaaacctcacaatagcccagcagggagtaggttatcctcactttataaattacaaaaccgaggcccaggaagggcgaatactctactgtaaggtcacactgctgtgcaaattgcagccagaggccgggcatggtggctcacacctgtaatcccagcactttgggaggacaaggcaggtggatcacctgaggtcaagagttcaagaccagcctggccgacatggtgaaaccccatctctactaaaaatacaaaaattagctgggcgtggtagtggatagaaaccccgtctttactaaaaatacaaaaattagctgtaattccatctacttgggaggctgaggcaggagaatcacttgaatctgggaggcggaggttgtggtgagccgagatcacaccactgtactccggcctgggtgacagagcaaaactccatctcaaaa

SEQ ID NO: 229751 - DNA, 365 bp, Homo sapiens
tggctcacggtactgcaggttgtacaggaagcatggcagcatctgcttctggagaggcctcagggagtttccaatcctggtggaagactaagcaggagcaggcgcatcacatggctggagcaggaggaagagagaagccggtagtggctcagttctagtccaaaaggctcagaagtagggaagttgacagtgcagccttcagcctgtggccagaggcctaggagcccaaggcaggccaccagtgcaagtcactgagtccaaaggctgaagaacctggaatctgacgtccaaaggcaggaggaaccacaggagaaagacggaaaccagaagactcagcaggccagcacatccctccttcttctgcc

SEQ ID NO: 229752 - DNA, 376 bp, Homo sapiens
ttctaatcctggtttactattaactctgcaggacacagtgttcaagttatcttccattccatttcctatggaaagaaagaatatttctggccaggcgcggtggttcacacctgtaatcccagcactttgggaggccgaggcaggcggatcacttaggtcaggagttcgagaccagcctggccaacatggtgaaaccccatctctactaaaaatacaaaaattagccgggcatggtggcgcgcacttgtaatcacagctactcgggagtctgagggaggagaatcacttgaacctgggaggtagaggttgcagtgagccgagatcgcaccactgcatccacctgggtgacagagcaagactctgtctcaaaaaaaaa

SEQ ID NO: 229753 - DNA, 887 bp, Homo sapiens
aaaatgttgagattataggtgtgagccaccatgcctggctgataatgtgatttctaacaaatgttgaataattatagtttgggaaaggaaaacagtatcatttagtgaactataatttttttcttaatttttttaacttaaacttttatatctctttgacaatttggagattcttagggtggtttgatatacctgctttctaatggtagttagatgtttcagctctattctgaagcagtgaaattcagtctgctttctaatggtagttagatgtttcagctctattctgaagcagtgaaattcagtctgctttcaaagtcagtgaatgcattttgaattatcccttatttcatttcagtagtaactaccttgagactccccaagtactccaattagtttttaatttcagcagtaaatgtgtgttgaaaagaccaaagtttgcattattttccttctgatgtatttaccatccatgcctgttgacataaaaagatttttccagacttgggtagttttcagaaccaaacaaaacccttgtgctataatgtgacttagacacttttgactgaaatgcttgatatagttaatacacataatttttttcaaaatgaaaccacaaagagctataaagagaatttcatagctaatttactgcttacctgtatttggggaagccatttagcatctgtgaacctaaatttcatcagccgtaaaatgggagttagtttttaagtggaaagaatgttacataagataaacggagacaaagtttttatcagtgaaatccaaacaactcatcttaagatgctgtaagctttatgtgtttcttttgtgtttccctaccccgcgtcgacgcggccgcgaatttagtagtagtaggcggccgc

SEQ ID NO: 229754 - DNA, 263 bp, Homo sapiens
gagacaaagtttttatcagtgaaatccaaacaactcatcttaagatgctgtaagctttatgtgtttcttttgtgtttccctaccccgcaaatgtttttcaaacttaaccctgttaggtaaaaactctgggttcctataaacgggtaaagtttgtccattggtcttctcaaggaaaaagcaatatgaacagtttgggttatcttagtaaaagggaggactctgattttgtctcatgtccatcctctctctgtgtgttctagtcg

SEQ ID NO: 229755 - DNA, 206 bp, Homo sapiens
ttataattattagcaaatagaacccagaagtataaataatacatcatcagcaaatggggattatcccaagaatgcaaggtgagcttaacattagctgcttgattagtggaagtagccacatttagatattaatgagaaaaaatcatacagtcatctcaataaaggtagattaagtatttgacaacattcactgtccattcataatt

SEQ ID NO: 229756 - DNA, 364 bp, Homo sapiens
aaaaatcaaaaaagagagctaagatatatagtatatagtgtacatagtatgtagtacgtactgatggaaagtttcccgtgatatgatattaaggaaatattttaaagtcatggtacagaacaagatattcagtatgacacagatttggtgggaaagctaaatataatgcctgcacacacacacacacatccttacatgtgcatcgtagaagatctggaaagatacacaccatgctgtaatattctggaaacggagaaggagacagaaggcagggttgctgttgaagtagactgtgttcaacatttacattgtgagtttctgtgatgctaaaattttccacaatgtgtgtattattctggaatta

SEQ ID NO: 229757 - DNA, 398 bp, Homo sapiens
tgtgtattgttggcatgcatttagtaattagcccgagtggatcagatggccttttatttccaaagattttttccctccagtcttacagcagcgaaatgtttgtagcacttgatgaaacagaacatatcctgtttctgtttttaaagtaatgagaactgttagctaataaaattggataatcccagccagatatgataattcagagaataccaccgagaggtgttgaattgtgggatggtttaaaaagaaaagccgactttgtgtgtgtgtgtgtatgtgtgtgtgtgcgcgcgcgagcgcgctgaaattttctttaggcttagaactcatgtatgtcactacactgcatcgtagtactgattagtcacaactggtaaaatgaaatattgattctctta

SEQ ID NO: 229758 - DNA, 489 bp, Homo sapiens
aggtgcttgcccaccgagtacacggccatgagcagccccgagcccgacagtgtggtggccgcgccgccaaacaccttgagcaggctgccgctcgggctgccgtggcccagcgcgtggccgcccagtgacaagtagagcagccccacacccaggcccagcgccgccagcagcgccagcagccccaggcacacgcggcgccgacaatgccactcgctctggcagcagtcctgcctggtggccggcttgttgcccagcaccgagtacacgctgaagggcagtgcgccatagtggcggcggatgccctcgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagccgctcacggcacgcggccgc

SEQ ID NO: 229759 - DNA, 511 bp, Homo sapiens
gcacgtgtcatttttatgttaatttcattttatgcgaaatgctccagcgcagtacaggctagtgggttcagggtggctgtgactaagtaatgtagatggggtaccttagacaaagtttccagactagaggctggaagtaagaggtccgggtgcccttttccacactgcagaccacggacttttccggtttctgaacaagtgagacaggccggctaaggacatttataatctccatgggtgagggccccaccctcatgaccatctaatcttgattacctcccgaaggccccacctcctaacttcctaatacaatcacttcttgggggaagagggtgtttggaattccaccccccgcccttttttttttttggagacagtctcactctgctgctcaggctggagtgcagtggtgtgatcttggctcactgcgacctccccctcccaggttctgcggtgtgagggggagggcggcttcgtggtcggctgggtcgggggagcgccgggcggccgc

SEQ ID NO: 229760 - DNA, 643 bp, Homo sapiens
aatgttaaaataatgaatgtcagcatgatttctagagatcgtactgagcaggatttagaggggcaggggggtttccccacttgtattcctgtccttcatagctgtctcttctggatttttttagtttattactcctcagggacaagcttttcgtttttcccctctatatcagcataatctgaaaaatattaaaattaaaataactaataatagactgcattaatagattagttccttttatagctttcatcattttaagtgaaaactttctataagttatttagggttttgaatttataatactgtaattaaaataagggtttttttcctcccattgacagtaaagctgtcactgccacaagatttgagctaaaaaaaaaattgtagattttgtacttctttgtcagtgctgccaaatcgagctttcttctggagcaccattcatcgagcaagacccctgacggtgccaggtggaaacttaatggatcctttccacctggtttgttttcagtgtttaatcctattagtatcagcaggatataggtcaggatatcaggtgcagaacctgtggaatcagccaatttggcttgctcatttactttaataaggtcccataatgagtgagagtacaaagttcaagccc

SEQ ID NO: 229761 - DNA, 356 bp, Homo sapiens
ttgttttgtttgagatggagtctcattctgtcacccaagctggagtgcagtggtacaatctcagctcactgcaaactctgcctaccaggttcaagtgattctcatgcctaagcctcctgagtagctgagattacaagtgtatgccaccacaccaggctaatttttgtatttttagtagaggcaggctttcaccatgttgaccaggctgcttttcatttgtttgtatatttctttcttcctttccttctttatttctagaagtattttaattttaatatataaattatgactggtaaaaaccttcatttctctgtctttgcttactgttatggctgattaaaaaataagttttcaaa

SEQ ID NO: 229762 - DNA, 432 bp, Homo sapiens
tgctccaagggcctcctgggcttccaggacgcatctcccctggtgttcctctcacccctctggccacctgtcatgcatcctctgcacctggcatttggaacctggagcttcaaaggctggagggtcccaggacgcttgctctcctcaggccagcttgttcatgccacaccagctcaaaggtcccttcctccaggaagtcctccctaactaccgccaatgcacacacatatgcacatatacacgcatgcacatgggacaaatatgttttctttcttgcatggtctctttgtactctgagcttcccagcacttagcacaaataattaactctgtacttagtgccatgagtctgagccagacactgtctcattctgcctcctgcccccatgcctgccctaagcagtcattcaataaatgtccgtgaatgaatgaa

SEQ ID NO: 229763 - DNA, 419 bp, Homo sapiens
ccagggtgatacttggagaaaactattatgttcctccttaggctttttttgctggggttatcttccctaagtcattcaaacttttgttgtataatgtgatttcttgacctccttattgccttaatttcaagtcctctgaagctgatctgactggaagagagtacattggaatcatgacctaccatgacaccaactctgtatctctgagtagattctaagtgcattgactcgtatgggtcatgtggtaaaatatcaggtcttttacttttatttgaaatgctataaaacctttctgttctctcctttctttatactgttgattcatagttgagaataaactctaccatatttttaagaaattcttgtaaatttcattccatgaactaataaaaatgtattgtttgtgtgctacctagcta

SEQ ID NO: 229764 - DNA, 651 bp, Homo sapiens
tgtgtacaggagcctagatagcaaactcctttagacacagtgttagaaagttggaattaataaaatatttaatgtgctccttgaagcatttgtttttgaaaggaaacttgacgtaaactaaacttccacagacgtgttttagaagtgactgtttccagtagattttcaatgatgtctgtatacactcagctgtggctgtaaaatacaacacacatactttgtaaacctgttagtgtgacgttttcaccctgacctgaaatgtttagtatcactcagaatacgagagtcatgaagctaacaggctgcaatgtgttcggcgctgtcgcccttcccgtgcaggaggccactgtctgcggggtccggtgctttcccgtcctgggctaaggtgggtgggcagagcagcctggaccgtctgcagccaccatgtcctctggacccctctctgcaccatgcccacctcctccaggcccccacaccatgccatgcagtggccgtgacagtgtttagaatcctttcttgtcttccatttcttcatcattttagggaggaagtgctgtgctttatgtcaagatgaaacacaacatctgattccttacctggctctgctagggcttaggaaagggggcttggttaaggtggactctgctgcct

SEQ ID NO: 229765 - DNA, 482 bp, Homo sapiens
aattatattgcttcttacatagttttttttttcctcataggttcgtatcctacaagtactttaaatttaatgtgttaattaaaaatttctggcaatctttttggtttttgttaaaattatctttatattgtttgtgtaatatattatcattttacaaatgggggacaaaagagatataaagtgacaagtaaatctgtctcctcagcttcacttcttcattctctagttcagtagttctcaactgggagtgagttgtcccccagggaacatttggatgcctggagacatttttggttgtcacaactagggggacagcactggtgaggtcagaaatgctgctaaacactctacagtgctcaagacaactcctacaacaaagaattatgtcgcccatcttcagcagtgctaaggttgagatacattgctctagttctaatccatagaaataaaattgtttctatagaaccttccagatatctcct

SEQ ID NO: 229766 - DNA, 422 bp, Homo sapiens
tagtgctcattacatcatctggattttccagagccaggctcttctgaggacatgggatagcaaaggctgcagatctcaacacaactttagagaatgccttggagttatggagacagaagtcagaatacagcaggttgagaagtaactcgtcaagagcaagaaaagttgcaagcatacacacaacggaaaaacagcactgaaaggaagatgtgaagaaatatactcagagcatttttcatattccatttaattcataaaagagctttggaggctgaaagttcaagaccaaggtatcatcaggcttttcctgccagaagacaaaggattccgatcaattaccttttctaattctacgaatgttctgtaaaattgtcccttgcctttcaaattacattaaaaataaaaagtgcacgtgactttca

SEQ ID NO: 229767 - DNA, 384 bp, Homo sapiens
tgtttctccggccatgcgggggagagtagagctcagtgtacaagagatgggagggtgtcagtacccagcaaggatggaatgacaatagctaccacatgggagtgctcactactgggcagatgctgttgtgatgccaccacagtccacctttgtcaaaacttgccccattttgcagatgaggccactgaggctgagagcaaaggtggccccagggcaagcggtgaggccagagctacaggtgtatgttccacacctggccacctgcaccgacgcacagggtaagtgttggcaagtcgtgtctgtccttccggcctcagtcttcccctctataaaatagaggtaactgttcccagctgcttcctagaaactctgagatcctgaact

SEQ ID NO: 229768 - DNA, 425 bp, Homo sapiens
tctttttcatcctttaaggtatggcattcctgaccattctatctaagttcatacccctctttattattctctgtcattgtatcctgtttgtttcctctataaaacttatcctggtcttggtgcagtggctcatgcctgtaatcccagcactttgggaggccaaggtgggcggatcacctgaggttgggagttcaagaccagcctgaccaacatggagaaaccccatctctactaaaaagaatacaaaaattagccggtgtagtggtgcacacctgtggtcctagctattcgggaggctgaggcaagtgaattggttgaacccaggaggtggaggttacagtgagccgagatcacgccactgcactccagcctgggagaaagagtgaaactctgtctcaaaaaaaaacaaaaaacaaacaaacaaa

SEQ ID NO: 229769 - DNA, 463 bp, Homo sapiens
attatggagtacagaatctacattcatttctagtatgaaatctgagatttcagagcaatttcctacttgtgtctgtagactgccacgtgaaccttagggcatgtatttatagtcttattccatttttaggagcactgcaagttgataagctttacagtggtgttccatgttaacactttaggatttgtggctgacatccctgacctgccatggtaatcactatcattgcttttcagaatgagatcttctctgtgcctccctgaaatgaactctgccttttcccctaacttttagggccaagccccatttgggctatcaacatccaaacaggcttcttgctagctagtggaaaaagacttctgaaactcactgaagtcccacaaatgctgacccagccacattaacttcagcatagccatgtggcctccacatccagaggcctgcctacaaaatgcagatgcag

SEQ ID NO: 229770 - DNA, 482 bp, Homo sapiens
ccacttgccacttggttgtgtaattacctatgacctgaattactgtacttgttccttgagggctaaatttatgtttgagtcttcctggtgttctaaccatgactcaaatcagtgcctcacacaaaagtaagggtgtttcagaactatctggtgaacaactgaaaatttagaacctttcatatattcttttatagctctgatatggaagatttcttgagaggaaagtactatgtttaactgtcatccaaataaaatggaaaatatagctttgaccaaaagaaatgatgtgttctaagagaataaaattaaaagaggattttaaaatctgttatccagtagatctgaaaataaataagaactgtcctcttgctgaaggagtaaatgcctttaaactttcacagtcatcgtatattgcacataaatgtggaaactggaaatctgtttcccactgaaagtaaagaaattgtgtttgaataaaagaa

SEQ ID NO: 229771 - DNA, 399 bp, Homo sapiens
aaaggagagggaacaacagcatgtggattatattttgcctaaaatacatgtgcaaagaaatgagaaaagaaagcacgtttggggttttattacactccaagcatttcaagatgtttagcatgtccagaatgcagctgtcttcatacacccccaattagaaatagttgatggttttctactgaacccagcagccctccacactatgtttgctgctgtctatttgccttgggatagacagaacaaaactcgccttgtagtgactacttgccttgggaaacaaagtggtgttcttcaggcaaacgctatgcagtaaaaaccagtggtaagaaaaaaaacaaaaaactgaattcatttgagaaaaaattgaagaatttagtccagaagttttacaataaacaa

SEQ ID NO: 229772 - DNA, 289 bp, Homo sapiens
aaaggtgctaaaacttaacagaacagggagatgactttagttagacgaataacaacattttaaatatctataaataacaagtaggagaaatgtctactatttgcaaacttaaaacttctctcctgctaagcatcatatggttgaaaataagcaaaagaggaaaggaggaggacaggaaaagagaggaagggaggaaggaaagaaaagaagtggaagaaacccttacatgcttttcgtttaagtgacttttccagccacaattaattctcatgtcagtactttttttctt

SEQ ID NO: 229773 - DNA, 367 bp, Homo sapiens
actaagtgaaaaatcttgtctatttgtagacagctcttagggctgtttaaagtgctctgggaatgttttgagatcattgtaaacatattttcaatatgccttttcatagcagagtttaaaatagatgtctccccaatttttcaactttggacttgtattctcagcaagaataatttatatagaagtgttaatatcaaatatctgctgttagttttataaatgtgtttatcttcttaggtgtactgtagttgtattaaatagaattattgacttaaattattcgaagaaagaaagaagtagcttttagaaaagaaacataacctacttatctgtattagtgttgcttctttgactaatcacttgagtt

SEQ ID NO: 229774 - DNA, 227 bp, Homo sapiens
ccagaagagaacatggaacgtgaacgcagaggatgtgtaagtgaagttagattgtcaatggatttttgtttttgggaaattatatgctttgcaaatatatttaattggagcttattttggagaactgtcaccattttatcccagttggcaatttttaaagaaaattactgaagtgaacataaaaaatggaaacatttcagaagtgtttgaataaacatcccctctcc

SEQ ID NO: 229775 - DNA, 272 bp, Homo sapiens
aaaattttatctttcttttaacatcttaaaaaaattgacttttagcatcaatcatgactagtattcaagtctgtaattgttgaaggactctgtctttacagttgagactattctagacacataaagataattccaataagcatttctgtaatcaactcttggctgtaccgagttattcctgcgatgaagtagaatgactgtcttaactcctactctgctctattgacagtaaattattcttggttctaaccataagcctttaacccaatgtc

SEQ ID NO: 229776 - DNA, 333 bp, Homo sapiens
accttcacaacaaccctgtgaggtagatgcaagtatccccatttgtggcttagagaagataaaagaaacttgtgtaatatcacatagcaagtggtgggagtcaggattcgaacctatatcaggctctctggctcccttcttagccaatgtgttacagaactcatactaagtgtacaacctgtgtttgtagctccttattgtaacacaaggatcaggagaaagaactatgctttaagtcctttgagaatttccagatagtttcttcctccatcccctcccctagtcccatctcctaaataatgtaaattacttctgcttacagttgcaggaaac

SEQ ID NO: 229777 - DNA, 564 bp, Homo sapiens
cacagagttggctggagttagtcctgattgccaagggtaaatggggctgttaccatgcaatggatagaaactaggatgctcctgtgtgtctccttatatcctaccaggtgtagcatgaaggttaaggacaattccgtcctcttatttggagaggagaccaaggccctgtaggactaaaggtttgggtgagctgaaagccaagggcaattggcccagcttggggaggagagttacaaatacatttgtgactatcagaccagaaacagactgcggtgttcacctgcggtttgggtacctgctgcttgttctttgctggggtatctgaagactgaaaacacagctcacacttagcctttttcctattctgtgtgaaagaactgtagtagttttctcttgcttaacaaggttctagtggtgaagtttattgcttagtctgtgagttgtagggaaataaccacaggatgggatggtagcagaacgagaaaagaaaagaaggttgtagatgccaggctggtgtcggcttgaaatttttaaagtatacagttcttctttatggattattaa

SEQ ID NO: 229778 - DNA, 367 bp, Homo sapiens
caaatattgcatttatgtaaatttatagagtttgaggaataattaaaactagtatttctgtagttctctacactattattttatgctttcaaaaatgattgtacacattttcaggggccaaaaccaggctatagttcatgacataagctgtgcttgagacttgtagctggtggtgtgctggagatggctcatcccggctcctgtgtgcatctctttccaactccacattcatctcttcccaataccatgttggtatcttgacatgggcataaaactggccatggtggaggtatttacacaatgtaaatgggcaaatgccacacattagagacatttcttttcttctgggcgagtctgttcttaaata

SEQ ID NO: 229779 - DNA, 644 bp, Homo sapiens
aggagctgtcgttttgatcatatcagcgtcaataggagctatgttgcagttttatttaatttcttctctctggttttaaatgatttgaggctgaagtcaattcacactatcggtgcattgggagtcaagcactgcagtaccacagagtcattttctgcttttcagccctgcccccagctggctcttacacagcaaaattccctgtgtgggctaattagtatatgaagaaaattgcttttgtgtttggagggcttccagattcactctctcataccagcccacacaatcaataaagatttggctgatctttccttatctcaggtggattagctcttctccaagtccatacccagactaggcaacatggtcctcaagcatgaaggggctgacaatctctgctcactttagaagggattgtccttctttagagcttggtttcattgagattcgttaatccatagctttttagaacaagagtcttctctaaccatttacatcttagaacactttgcattggtttgaagtggctttttccatttttgtttgtttgtgttttgggaaaggtggatatgggttgtacttaaatattcttcttactcatgttgctctgtgcttttttttgttgttgttcttttgtttttttt

SEQ ID NO: 229780 - DNA, 483 bp, Homo sapiens
cagtatgggcatcaagtttgaaaacatgactttcagtccaagctgctgtgcaaatctttggacaatttaataagcctcagttttctaatctgtaaaatggagatgaaaatactcaccctacccacatacactggcacaaatgatataatgtattaatcaagatagaaaactgaacctagccatggcatacaaaatcatgtcatataattttgaaaagtgcaaagttgtgaaatcatctttattttgccatgtatctcagattctcaactgtaacattatttgggtgatcagtgtgtagtattgattatattttagtgtcagccatgtagttactctctcctctaaggagttttttattaccattcactggaaaatacacagctttttctttgcaattatttctttacctcttttcttctgccttccaatttaaaattcatgagtaatacagcacctcacgaatagatgaaagggatgacaatc

SEQ ID NO: 229781 - DNA, 328 bp, Homo sapiens
gcagcctcagtgagatccaggaggatggcattgctgggctggcccagcccttattgattatggtgtaaagaattaatatggtggttatatactctttgttagacaccttggcttacaagacgtaagcgtaaagtgtagtgcgctttagtcagtatggccacatggtcctttggtggtaaattgtttgagatgcctccagtttttaaaaggagtagcatatcgggccaggagcagtggctcatgcctataatcccagcactttggaaggccgaggcaagaggattgcttgagcccaggagttcaagaccagcctgggcaacatagtgag

SEQ ID NO: 229782 - DNA, 1161 bp, Homo sapiens
gcgtgcatggcagctgtccatgtgtgggttggaatggcacaggctgccagcttgatgttttcaaattcagctttgtaggaggccataaattattcaacacccagctgatttttatttataattgaaaaaaaattagcatgcagtgccttttgttcacatgagagtttcaaagcatagtccattggtactggcctaatggtttctgtgagatgttaactggaacctggatttttaacttttcatgtttaaacaggatcagccctgctctaactcattctggatttgacaaataaaactatgtttctcatgaggtggtccctggacctccttgcctcagaatcacctaggatgcgtaagaaaaatttagaccctgaatcctatcaaagaacaactgaatcagcatttctgagtatgatgcctagaaatttgcagtttatcatgcccctatccatttcaaaacacacaggaatgtctgcctgaacttatattttaaggacagtgaattgtaacccagacaacatggaaatataaaagggaaaagagcctctttggtgggaatacaattgtgttcatgtgtgaaatgtgagttgcagcatgctttatttattccatgacttgtctttgttattcttagatttgaaatgatatcatggtcatttgtaggcatcaagagtgtcagtgtcccagtcagaatttgacttaagatattgcatttctgaaacttactcagtttttctacgaaataaatccttaaaatacccaagtgcatgtacttggcaaatatcctcatactttccaaagtggtcaaatggtagtgctcaagagaaaaatgcttctctagtatctgtttagggaaatttccttcctgtgaatgtcactgacgtgaataacatgagtcatagaaacatacagcacaactgcaaattaataaaggaacatgtatttcctttctaaaataatttaatgttatttccctactctaattacaaaaacttttaaaaaataaaatgcaaaacagaaaaactcatatttaggtaagctgtttctaaaaggctttttcttaattctctttcaccatttactgtaatgcagtgtaatatctaactttaatcgatgctgtttcattcctttgggtaagccagaggaaaacctatcctcagg

SEQ ID NO: 229783 - DNA, 262 bp, Homo sapiens
taattactgaattgaattgaaagtactccaacaaatttccttgtagtttgtttgaacttctaaaatgatgacatcattgctgtgtgattaataaagacatttaaagaaggaattacaaaacttcctagggaaatcatttctcctcttagttcccgctctcttctggtttcttacccactctaatagactaattagacttgcatagagatgggacagcaggctgtggaagggaaagctgtataatgcagtagaagtaccatag

SEQ ID NO: 229784 - DNA, 550 bp, Homo sapiens
tctctgacaaacatgttgttaagctttcaagttcacaattctgcagctggaagaagggggcagagaatcctatcagaaactcagtatttagttctactttacagctataaggaaatggcttctctagctctcaaaatgctcagtgaatttcctgcaaagttactaagaaagttaccctctttgaattgaaatacatatggaacaaattttatatttatgagagagtatcaattgttggaactacagaggatgctgcatgtgaagtaacttcaaatgtaattacggggccgggcgcagtggctcatgcctgtaatcccagcactaaggccggtggatcacttgaggtcgggagctcaaaaccagcctggcgaacatagtgaaacccctaaaaatacaaaaaattagtggggcatggtggtgcatgcctgtaatcccatctatttgggaggctgaggcaggagaatcgcttgaacccgggaggcgaaggctgcagggggccgagatcgtgacactgcactccagcctgggtgacagagcaaaactctgtctt

SEQ ID NO: 229785 - DNA, 591 bp, Homo sapiens
gcagtgtgcctaacatattacctgatattttaccattagcgggtttctctcttggctaaaggactgtagagaaaggaacagctacatctgcctagagaaatccatacagaagagggaaatgcttgtgctgaggcttgaaagaggaggaaacactggctccatgaagccttcatcgaccctcaaggattgctccttcctgtcctttatttccattgataagaaaaagctgtctgtaactgatttccaggccgaagtacaagaacagcttcccactgtcgctagtctctgggtgcctcaacatcccttgtttgtttctttaacctgcttgtaacctgtaggcgcggagtttattacctgttttcttgtgagaagacaaactcagagtggaagagaacttgtcccaggtcacccttggtggaggtgagctcagatcagcctgacctcacaacccaacaagaagcagtgcaagcaggaaatgtgtacattctatagtccattcatccaagttgacaagaagaaacctcaggcatgaagacagaacaagcatttctcaacaatacaaagtgataaagcgtcaaaatgagcttcata

SEQ ID NO: 229786 - DNA, 394 bp, Homo sapiens
ccggtgcgcacactactcccaccgcccccgagtgcctctgtccggctggccgcggccctggaacgaatattgctcagtcccccgcgagtcaggtctgccgcgttgcccggtgaggggaaggtgtgaagccccgggcctccgtctgcccggtgagtccggggacgcgcgcccccggggatgccatctggctcctgggctgtgaccagtcacagctcacatagctctgggcactggtaccgactgcctttccttgttagctgcgatacacaaatacacgagccagatcctttcctgaggccaggaagcctggaatctaataacaccgggcggtggataaagtcccccgagccagtgcttagcttccgttaatggagccatggatggaagcggatgt

SEQ ID NO: 229787 - DNA, 476 bp, Homo sapiens
agattttagactctcggtcaatatttttcacattttaagcttcaatagagatggcaattccagttccctgttcaagtacttttgttgttactattctaaatcttgatccttgaaattaaaactaaaggcatccagattagagcagataaaatacatttgttcctggctataaaaagtggttatatgggccaggtgtagtggctcacacctgtaatcccagcacattgggaggccaaggtgggcagattgcctgaggtcaggagttcgaggccagcctggccaacatgataaaaacccgtctttattaaaaatacaaaaattagccaggcgtggtggcaggcgcctgtagtcccagctacttgggaggctgaggcaggagaattgcttgaacccgggaggtggaggttacagtgagtcaagattgcaccactgcactccagcctgagctacagagcagactctgtctaaaaaaaaaa

SEQ ID NO: 229788 - DNA, 644 bp, Homo sapiens
agcgggtgacttgcaagatccaagtgccctgttcaacccttgacttggggttttgtacattgttatggttctggggtttgctgaagttgtgcacgtgttcacttgaggagttttttccttaacctgtcgagcgttcccagtgggaggtcgtataagaggccattttgcctcttagtgtgcctgtttgaggtctttgagaagaggataacaccagttccgagtgttttctgtctgttaggagactgtcttttcctggtgctggctgtgaccacttatcattttagagagacagtttaacaaccacctgaccatcactttattgtcgcctgacagtcctgggggcaacgggttgggggtatgtgtgtgggggtgctctcctgccctgtccatatctgcctaactacctactctaacatacctatgagctgaaagcctccacttagagtgtttgagttgttctgccttttttgactgagccattgtacatcttacatgtgttgattgatgtcttatgtcttcctaaaatgtataaaattgaactgtagcctgaccaccttggacacatgtcgtcaggacctcctgaggctgtgtcacaggcacgtccttaaccttggcaaaataaacttctaaattgaatgagaaaa

SEQ ID NO: 229789 - DNA, 2144 bp, Homo sapiens
  misc_feature (651)..(651): n is a, c, g, or t
  misc_feature (720)..(721): n is a, c, g, or t
  misc_feature (723)..(723): n is a, c, g, or t
  misc_feature (787)..(787): n is a, c, g, or t
  misc_feature (908)..(908): n is a, c, g, or t
  misc_feature (946)..(946): n is a, c, g, or t
  misc_feature (1495)..(1495): n is a, c, g, or t
  misc_feature (1947)..(1947): n is a, c, g, or t
  misc_feature (2134)..(2134): n is a, c, g, or t
tgagacagagtctcgctctgtcgcccaggctggagtgcaatggtgcgatctccgctcaccacagcctccctagtagctgggactacaggcgcatgccccaacacccagctaagttttgtaattttagtagagacgggtttcactatgttggccaggatggtcatggtctgctgacctcgtgatccacccgcctcgacctcccaaagttcaattttcttaaaagtgaccaccaacaccatcaacatatgtttatagactagatgtatcacttgtttacccaaattgtagcataaatatctgtttttagaaagcttttccataagtctttctatatgattggattattaagcaaggctatgattaggaaataaaccactttcccctttagctagttctaatgaaagctttccaaattaaacactgtgtttgaacacttcttccattcatagcatgtgctcatcaaaaagtgctttccgtttctggtatgtcaactgtactatttataacctagttaacaaagccaacatggtgaaaccttatctctactaaaagtgcaaaaattagccaggcatcatggcacatgcctgtaatcccagctacccaggaggctgaggcaagagaattgcttgaacctgggaggtggaggttgcngtgagccgagattgtgccactgcatccagcctgggtgtcagagtgaggctgtctcagaaaaaaaaaagnngnggggggggtggttccaagatggccgaataagaacagctccagtctacagctcccagcgtgagcnatgcagaagacgggtgatttctgcatttccaactgaggtaccgggttcatctcactggggcttgtcagacagtgggtgcagtgcaccgagcgtgagctgaagcagggtgcggcattgcctnacccaggaagtgcaaggggtcagggaattccctttccnagccaagcgaagctgtgacagatggcaactggaaaatcaggtcactcccaccctaatcctgcacttttccagtggtcttagcaaacggcacactaggagattatatcccgtgcctggctcagaggatcccacgcccttggaacctcgctcattgctagcacagcagtctgagattgaactgcaaggcagcaacaaggctggtggaggggcgcccaccattgctgaggcttgagtaggtaaacaaagcagcgggaagctccaactgggtgaagcccaccgctgctcaaggagacctgcctgcctctgtagactccacctctggcggcagggcatagccaaacaaaaggcagcagaaacctctggagacttaaatgtccctgtctgacagctttgaagagagtagtggttctcccagcacagagttggagatctgagaatggacagactgcctcctcaagtgggtccctgacccccaagtagcctaactgggaggcatcccccagtaggggcagactgacacctcacacggccgggtacccctctgagacnaggcttccagaggaacaaccaggcagcaacatttgctgttcaccaatattcgctgttctgcaacctctgctgctgatacccaggcaaacagggtctggagtggacctccagcaaactccaacagacctgcagctgagggtcctgactgttagaaggaaaactaacaaacagaaaggacatccacaccaaaaccccacctgtacatcaccatcatcaaagaccaaatgtagataaaaccacaaagatggggaaaaaacagagcagaaaagctgaaaattctaaaaatcagagcgcctctccccctccaaaggaatgcatctcctcgtcagcaatggaacaacgctggatggagaatgactttgacgagttgagagaagaaggcttcagatgatcagacttctccgagctaaaggaggaagcttgaacgcatcacaaagaagctaaaaaccttnaaaaaagattagacgaatggctaactagaataaccagtgtagagaagtccttaaatgacctgatggagctgaaaaccatggcacaagaactacgtgacgaatgcacaagcttcagtagccgactcgatcaagtggaagaaagggtatcaagtgattgaagatcaaatgaatgaaatgaagcgagaanagaagtttag

SEQ ID NO: 229790 - DNA, 104 bp, Homo sapiens
tcttaaaaggctccactgggggcaacaacgaaaaaaagctgaaaaatgctactctaaatgaatttactggccaggcatagtggctcacacctgaaatcccaata

SEQ ID NO: 229791 - DNA, 375 bp, Homo sapiens
cttttgagttaacactgaaatgaattaatactgaaatgaattaagactttgggagacggttgggaagccatgactcattttaaaatgtaagacatgactttcaccttccgccatgattgtgaggcctctccagccatgtggaactatggattttctctgttatcgcccaggctggaatgcaatggcatgatcttggctcactgcaacctccatctcctaggtgaacacacagtgttcatcccctcaggaggacacagcttttgaggtaccatcttggaagcagagaccagacctcactagacacaaacttcctggcaccttgattttggacttcatagcctctagaactgtgagaaataaatttttattatttat

SEQ ID NO: 229792 - DNA, 1600 bp, Homo sapiens
  misc_feature (1324)..(1324): n is a, c, g, or t
  misc_feature (1595)..(1595): n is a, c, g, or t
atgtatcctcaaagttgacaaccatgacatttggggattatgattggttttaaaaaacaaaatccttaatatagtaatttaaacaaataggtatttttttccacacaggaaaaaaagaagcctggaaatggatcatccaggactgacttccaatgatgtcaaaatccttagcggttgatttatcaccttatgggcacaagatggttgctgctcctttgaggcatgaagaaggaataagcaacaaaggatcatgcctaaaacatcactgcccaacagcgccacagccccccaacaataaaccttcccttaaatgctgtagtaagctgtattttctaaagatgaccacctcaatatatttattctgtttaatactttctttctacaacatgatacatgctcctccaactgacagaaggggacatattctctccctgtaagtctaggaggagatttttaacagtcttgtctaatagagtacagcagaagtgatgctaaataactccggaggcagggtcataaaaaaacccagtgataatattaaaaccacatgtgaatgttccagctggacccccagcaggtacaagcattaactaaaaaatggcatgaacaagctttcatatgactccagcctcagtctttgagtcttctagctgaggcctcagacatcatggagcagaaacaagtccttatctgaattactcacccacacaaaccatgagatataataaattataattgttgttttaaggtactatattttataacaaaatattaagcagcagtagagaactaaagcatagaaaaatctcaaattaacaacctaacatcacacctagagaaaccaaaaaaacaagagcataccaactccgaagctagcagaagacaagaaataactgaaatcagagctgaattgaatgaaattgagtcacgaaaaaccatacaaaagatcaacaaaaccaaaagctggccctttgaaaaaaatgaataagattgatagaccactaggtagactaataagtaaaagagagaagatccagggccaggcacagtggctcacacctgtaatcccagaactttgggaggccaagatgggcagatcacctcaggtcgggacttcaagaccagcctgaccaacatggagaaaccctgtctttactaaaaatacaaaattagccgggtatggtagcacatgcctgtaatcccagctactcaggaggctgaggcaggagaatcgcttgaacccaggaggcagaggttgtggtgagctgagatggtgccattgcactccagcctgggcaacaagactgaaatttcgtcaaaaaanaaaaaaagaaagaaagaaggaaggaaggaagggaaagaagagagaatattcaaataaacacaatcacaacacacaaaggggacattaccagcaaccccacagaaatacacaaaaccctcagagattattacaaatatcactatgtgcacaaactaaaaaacctagaagaaatggataatttcctgaaaatataaaacaacccaagattgaaccaggaagaaattgaaaccctaaacagacaactaacaaattgtgaaattgaatcagtaanaaaaa

SEQ ID NO: 229793 - DNA, 557 bp, Homo sapiens
aaaaacacataaatttatttgcctctcagttctacttgtcttcacattatagcaaacaaatacttctctgtaggtggcagtgcacttacataagacatttttctgaaagaaaagggtgggggtggaattatcttgaacattcgaaagcatttatgtaacttgaatctcatagttttaaaaacacactcttatttcctataatgtggatatatacttaatttatacttgcccttagtctctttccctcagaggtattagtaagtgttaaagagttatcagttttcattttatgacattatgattgaaattgacatgccagtcaagaattcaaaaacagatgttgtgaataaaacagtggctagcatttttgtttttaacaacaacaatagcatttgtattataaaataattgaaactggctaatataggtaaaactgttggtcaaatgatatatctcaactagttttggggctggagacttttaagtgggaaaggtttttttttcctaagtacattaaaaagaatgaccagttgaccatcctgctcatgaattttatg

SEQ ID NO: 229794 - DNA, 372 bp, Homo sapiens
cagatgtatgtggagagggagaaggatttgtattgaatagaaataacgagagctgcagtctaagattttttctagaaaaaaaaaaaaactttccaaatcccatttagaaaaactgcgacatggtaccgccttgagcgggaaaaataggttttacagattaggacaaggtcaggcaaacaaacagcccaaagccatgccatcagctcgaagcagctctgccccagcccactgctcttcctgggcctggctcacccctgcacgtgggacaaatccttaccctgctacaaagaaaccagcatgggaatccaaagtccactatgtctcagaaaaaggaagagaaatgtgagaatacatttccatttggttcacact

SEQ ID NO: 229795 - DNA, 494 bp, Homo sapiens
attctaaattgggttctaactggggaagtttctgattgcattgagtgggttgaaaagaaatgcatgcagtaggggagattttgtaaatctttgtgtgcctcctttgtgccagccccatgctcaaccctgcgtttacagtactgtggccacagacatgatccctactcccaaggacgtcatagatcagtcttggaggggaaccactgggaaggcaggcccaacctgccagtttcatgccctctctgcttttcatgttctctcttccacttctgaagcaattccagaggtattgacagaaaattactgagaacccatttattcaaagaggccatttgtaatcaagggtcccatgtctctcatcatataaatgatccattaaagtcatttagcaagtcacttagaacctttcaaagattgtctcctttggaggaaaaagcctattttgttctttttttaaaatcaagtacatgtaccctagaacttaaagtataata

SEQ ID NO: 229796 - DNA, 519 bp, Homo sapiens
atttcaggctttctctatcagttgcatttgattgtcctggacgtgctgaggcccatgcaaggtctgttgtattactttggccattatgcttcagtgtcacagcttctacagaaaggacgtacaggttgagcatcctaaatccttaaacccaaagtactctcaaatcgagaactttttgagtgctgacatggcactcaaaaggaaatgtttattgagcatttcagatttggatttttggatttgggatgctcagccagtaggtataatgcaaacattgcaaaatctgaaaaaaattccaaacccaggatgcttctggtcccaagcatttcagataagggatactcaacctatactaccattgggagggagatattatattaccattcgtcagtagagagaatgtgcagagtggggccaggggtagtaggaagtaggtcattctggggcagcaacttttatttatttatttagtttctcagcttttaatttatgaaggactcagccacattaatgttttgc

SEQ ID NO: 229797 - DNA, 760 bp, Homo sapiens
acaatgtatacatataacaaaatatcatgttgtgtgccataaatatatacaatttgtttgtcaactaaaaagtatgtcccttggaatacactggacatatttatgcttttttgaaaagtaccagtagagatacagtggttccccagtggtccctctgcactggagaccctctcacaggatgcccaggcctttccccatgactgggcaattaaaggctaatgcacagcacaaaaggcagcttccaggatcctgacacagcactgtggcttgcttctattctaactggcctatcttctgccttacttgtcattggatattttgaatatcactcctgggtggatctatataataaataaaggtccaagtgtgttctataacatgagaaactgcaactatgtgtcaataaaaattatcagtacaagaaaatattatttctcaaggtttgatgtcagatcaaacatcattttctcagggacccctcttatttaaggctcccagctatatgtccccacaatgtcctctattcttcctaacagtgtctgtactttctctgcttgtataatgtctggttttcccagcagactgtatgctccatgaggataagggccatgtctacagccccagtggctaagtaaaaagggctcaataaatttttgttgaatataaatttaaaaagctatttccatataatttttctaaaaaattatttcatcatttgttactgaagttttttctggcattaaaaatacctttggaattt

SEQ ID NO: 229798 - DNA, 334 bp, Homo sapiens
tgttctttcaaggtttagtagagttttaaaaataaatgtatgcatgtagaacaattcccagatggttgtttggttaaagagtatctccacagagctcctcacactgctattgcagagcagaagtcactgggttacttgattattagtattgtctactggaaattcggtaagagagtagattttatgtggtcttcccaaaacaagaaaactatgtgggatgatgaatatgttaattggcttgactatagtaattaactatgtatatgtatatcaaaacatcatgttgtataccttaaatgtgtacaataaaaataaaatcttaaaaaatttttta

SEQ ID NO: 229799 - DNA, 408 bp, Homo sapiens
gattgggggtggttctttttcagtaggcaagagtttttaaatgtgtttattgttgatctttaaatttattatattgtacttatagaatgtgttgtcttaatttccatgtgtttaaaatttcttaacattttctttgtttttggtatataattatttttaaatgttattgttttaatatgtctctagattaaataggtctcatactttctctaaatttctctctcatatatactgttcatggtctttgtatataaaatataccttatcaatttggcttttgaagtcatatcattactattaacttacttccaaagtatgtttaattctgaagtgtgggtaatattgaagtcttggcaaactcatgtgattagaaacccccctggtgcaacagagtgtgtttttggattc

SEQ ID NO: 229800 - DNA, 438 bp, Homo sapiens
ggttccaggcagaaaagtcagcttgcagaaagacaggaggtggagacacctggccatgtttaaaacatggagttgaccagcttgatgagcacgtagcctgtccatagattgagctgcctcttgagtgctgggttctggaagatgcggggtggggctttagggcaaagatgaattaggaaactacattagttctggtcagaggcatgagactgtgtgaggctggcacaggaggcatggatagagtgggaatgaagaatctactgaccttgacaatggattatatagggggtggatggaatcaaagaagaacattacagttagagtctatgaaaagctatggcacctttaacagaaataggaacacttagaggcgtgctagaagagggacactggggctgggtgcagtggcatgcacttgtagttctagctactcaggag

SEQ ID NO: 229801 - DNA, 532 bp, Homo sapiens
atcacagtattccatcaagtagatatgcaatttacacagccatttgatcatagtttgacctatagttgttcctaatattttataatataaataatatgaatattaatagcactataatattcctttctcttattttttgattattttgctatgactaagtagtggggaggaacaaaaacttttccttgtaaatagagtaatgtattgttcattagaagaacaatttagaaaatacagttcattgaaaagatttttaaaaattacccacgacggcatcattactcagagataatcctattagcaatttattattgaatttcttgcctttttctatctatatatctatatttcctttggaagtaacatgtactatttgtattattttgaagcttttaaaaaattttaacaatatcaccttcacctttctatggcattaaataattaaatattttctagatgttgacaaactatggctgatgggtcaaatctggcccacccccttcttttgtaaataaagttttattggaacaca

SEQ ID NO: 229802 - DNA, 409 bp, Homo sapiens
aaggttgcccaaatctacccacctccccatgaaacatcatggattgcacatccaatagcattgttctggtttgcatcttaacctctgaggctcgtaaactgtggcaaacctttgttcagggacagctacatcactcctattagcatcttggaccttggctcctggatgctgtccagatctcatattgctgaagtgttacttattcaaatctctctgacttggcattccacacccataaagtagctcaatctcatcttgactcccagccaaacgatgctcccagtagtatcttttttgacagagattaaggttcattttacgttatacatccaaacatttgatataaataatgactcatgtttaaactggttaataaatatctaccactgaagccagagaaagaagacaa

SEQ ID NO: 229803 - DNA, 406 bp, Homo sapiens
tactgaaatcctgattcactccatcccatttggtacttcctacgccccacccacctgccatcttgccttttccttagagcagccaacctgaagcctttggtgaaaatagtctctccccccgaacttttttttttttttttgagacagtgtctccctctgtcacccaggctggagtgcagtgatgcgatctcctgtctcagcctcccgagtagctgggattccaggcgtccgccactatgcccagctaatttttgtatttttagcagagacggggttttgccatgttggccaggctggtcttgaactcctggcctcaagtgatctgcctgcctcagcctcccaaagtgttgggattacaggagtgagccactgtgcctggctgaaaatagtctttacaggaaaatta

SEQ ID NO: 229804 - DNA, 491 bp, Homo sapiens
tggctctgtgtcagtgttgacaagtcgtacgtgttcgacgctccgtgaggcaactggttccagcagtatgcagaaggaaaccagtaaatcctcaatgtcacgccactcattgagacttggttgctctttttactctaaatatcaccatggatacaaacactttgaaaccagggtcctgtccatcacctcacagcccagtattgcacaattgtgtaagcacttgaaaaggtagaccttgtacctcaatcggctcacgaatactgttgggacacctgtgaaaacttagttgttttaggtatttcagttttgttttttatcattctttgtattggaaagttattctgatgcgtcattacagattttaaagtaaaaacagaatatctgtagtatgatagttttctcttctataggtacataatcttttataagtgtttttaatttaaaatgagactgtaatgccattgcctttaaggaggatagtttcagtacca

SEQ ID NO: 229805 - DNA, 466 bp, Homo sapiens
aggtgacgagagagagaatgagtgtgaaagaggaacacttagataaccatcagatcttgtgaaaagtcactattacgagaacagcatgggggaaactgcccctatgatccaatcacctcccaccaggtccctccctggacatgtggggattatggggattaccattcaagatgagatttgggtggggacacagagccaaaccatatcagtactcaaaactaaaatgccaccaaaggaagtttgaataaataggaaggcatattctatttttgggtagaaagactcactattataaagatgtcagctctccataaattaatctataaatttaacacagatctaataaaaataccaacagagtacgcaacctgaatataaattcatatggaaatttttgcatcagggataaccatgttgcttcagtagcatcctcagaatgaaaaacaaccaaccaaaacaaaaagaa

SEQ ID NO: 229806 - DNA, 652 bp, Homo sapiens
cgccctcccagagtgctgggattacaggcgtgagtcaccgcacccagcctaccttcaatatcgatgtttctgacagtctacaactgccattcttttcccaccttatatacctgtagctcttaaattttaatataaataagaattgcctgggaaactaaatggagattcctaggaataaccccagagaatctaagtcattaggtctagtgtaaggcccaaaaatatgtgttgtgaacaagtctaccaagtggaccattctctgagaaacattgctgtgcatatttatctcataaaatcagtagcttcaaaaaccacctaaacaataaagattatgtctacattctgactttaatcaagtattctactgtatttctaaaagcctattatttctcacaatctatggatgatcacagctggactcatcatttctcccattgtattgattagtgggcagcaatattcacctaattttcctagccagaaacttgaaagtcatattttagtcctctgtctctcttatatttgaccacagtcccattatttctctttctaattatctttcagcctcccttcactctccctagctctttcaattccactgccactgacttaaggctgtcattacttttcatctaaattgaagtacccagag

SEQ ID NO: 229807 - DNA, 543 bp, Homo sapiens
cagtagtttattatataactgaaatttgctaaaggagatcttaagtgttctcaccacggtggggggtggggagataagctatgtgaggtgttgaatatgttaattaacttgattgtaataagtttttcacagtatatacataaatcatcaagttgtacagcttataatttttaactgtcagctatacatccataaagttgtgggggaaacaaaacaaagacagcaaaacaagttttcattcacacaaattctggaagtcagcaaacacgtggtgaatcaggtcagcactcatagtgttacatcatcctcactagtatgctgcaataaatactccagacttacaatttgttccccatatgtttgtattttcaaatgtcttcagagataaaaattatttgtgttacttcttccttcataagaaacattaaggtttgtaggactaggaaagtatgaattatggataggaaaatgtacatttttcctgtgaagctgaacaggacaccctaaaaaaatgtatggttactgtcattgagaaattcagtg

SEQ ID NO: 229808 - DNA, 333 bp, Homo sapiens
gcagcattatttttaacagcgtaagactggaaacaacgcaaatgcccatcaatgggagagtcgtttaaatgttatcatacatccatacaacaaactagattgccgtcatgaaaaaataagcatgctctttaaggacagggaacaatctccaaagtaaattaagtgaaaaataacagtggctgtaatatgtgttaccacttctgttaaaatttaaaaggaagggaagaagcagttacatatttccttgtataagcataaaataactctgaaatgatacaggagaaactgttaatagtggttgcttccagagagggaaccaaggaagctgggtac

SEQ ID NO: 229809 - DNA, 460 bp, Homo sapiens
atttttacctgatcaactagagttgttgactcttgtcttcaaggaaatagggagaaaaatatttttttcatttaaaataccttttttttttagttagtaggatggtgaaaccattttgcagttattttattccctcaatcatatctgatttgcatttcaaagttatgagttctgtccctttgtgacaaaacccaacatgttaaggtgtggtaagtgaacttatatattaaaagccatagaatatttagatagattttctatggctataccaccctggaatgtgcctgatcttgtttgatgttggaaactaagtaggcttggacctggttagtaatttggtgggagagtatttagatagattacttttgggtcacaaggatagtcttaatctggtactctcacagtgaaacataaaggggttccagggacaaactgaacctaaacagaactcctgaacttt

SEQ ID NO: 229810 - DNA, 299 bp, Homo sapiens
gggacctgctgcttcactgatgagtccaactttcggtagcattttgcagacgcagcgtgaaaggaagctgtgtgctcgtctctccctgggctatggctcgctaataaacacaatattaaagaagcagtgggttgatgctgtttagcctaaaaaagagagtcgtcgtgtccctagcctggccttacctctcttttaagacagaaggcctcagctgagagggctttcctggacagtgctggacgatgtagtatgttttctgagagagctgtccatgacatctccttctacttcaattattt

SEQ ID NO: 229811 - DNA, 604 bp, Homo sapiens
gattctcctgcttcagcctcctgagtagctgggcgagcgccactacacccagctaatttttatattttttgtagagacggggttttgccatgttggccaggctggtctcgaactcctgacctcaggtgatccgcctgcctcagcctcccaaaatgctaggattacaggtgtgagccactttttcataagagatattttgtgtgggggtctgttgtttttcagtgcaggattctgacaggtgagaatggtttgttttcttgctaaatgaacagtctcactttgtggtacagtaagtactcacgtcatccataggttcttagaaactgcaactttaagcaagacaacatacaacaacaggtccttgaataaggtagttttgttcacttaaagtcacagtttctaaaagcctatccatgaagttgagtgaggacttactgtgtgtgtgtatatatatgtgtgttttttttgtctttttggtttttttttttgtcgggatggggtttcaccatgtttccaggctggtctcaaacttctagtctcaagcgatttacctgccttggcatcccaaattgtcacgccaccatacccggcctcttactgtatg

SEQ ID NO: 229812 - DNA, 527 bp, Homo sapiens
taggcttttcttttagatgctgccttccatctagttatgctattctgtttaccctggggagtggtagaacaggtgaacctcataagtctctggaaaggggccagggatgaatgtcttatacatgttagtattgatctgaaggagaattggtttggggtttgggtacatcaaatggaaaaggtcagcagaagatgtgtgtggcactagtaaggaggataattgacatcaaatgctttccatggaatgtcatggtttggactgttctccttactggcatcattggggtctggatcagaattctttatacaggtctagataacattatatgtaacaaaaattccccaagttactcatcagaaatcttagaaagcatgaagcacagtattgagcagagttgaagacaggtattggctgtgagagagagtgagacaggttttaaaatgggctgaggacttttatcactataaagagtagtttatttcctttttaatatataattatgtaaattagagccactggaatttttg

SEQ ID NO: 229813 - DNA, 284 bp, Homo sapiens
ttgtagttttctccatatgacacccacacattttcatgatgtttacacctaagtatttatttttcttttttggtattattgtaaaagttatttaaaaggcttacttttttatttcaaattctgaatgttccttactggtatacaggaaagcatttgactttcgtgtatttactttgtgccctgtaaccttgttaaatttgatcattacttctgagtatttctgttgattctttgagaattttctcataatatcattttaaataaaaagacaatattatttcttc

SEQ ID NO: 229814 - DNA, 334 bp, Homo sapiens
attgaaaagatttgggggaaaaactataaaaaataataacaaaaaaacccaatgtagtatgacaactattgcataacatttacattgtattaggtactgtaagaacacctagagatgatttaaagtatatgagaggatgtgcataggttacatgcaaatactatgccattttatataagggacttgagcatagaggattttggtatttgtaggaggttctgaaaccaatcccccacagatacagggggatgactctaatttctcactgaactttttgaaaaaggagcaggatcctcttaaaaacccacgtgctctcttggctttttatggctca

SEQ ID NO: 229815 - DNA, 552 bp, Homo sapiens
gccctcccttctgccaagatggatagtaccatccaaggacatgatgagatcagctccctcagccctccagaatctgttataaagagaaagcagcttccttgggatagttgccacccaagaactcagaagccaagctttccagcggtgagataagtgtcagggcatgtgctcggctcagcctgcccagagctgaggtcagacccttgtgacccccaggtgtcatctgcggatgggggcagtgctgtgggcacaactagcaggcagaggagatggaagaggagggggcagcggtaacttggaagtacttaggagttgtttttaaaagcaatgtcaaagtagagagctagaaattgaaggaagaacagaacacactttttacaaagcaaagtccagggatccctggtctttcacaatatgaccccaccaatgtaataactgctaagatgtactgagcacctactatgtgccccaggcactatgcatcatatgcattttcttaaattaattctcaccacataatcctattagggtaagagctattattatcatctt

SEQ ID NO: 229816 - DNA, 373 bp, Homo sapiens
ttttcacatataataccttactccccaacattaggtaaatgaggcattgctatgtatataaagcagaaagttaacatttgagagcatggaatgatagacttcactgcctccctctgtacttggttctgtcctctttacacattcataatttcatattccttgacctgcctttataacgtgcccaagttagcaccctcttctctaaaggggttatcttgccagaaagtacagaccttaaacacacaccaaagctcaaggtctcttctgcatcagcttacatttttctcttatctcacactgggatgacagacgcacccatctgtcatgtagattctttacatcccaagctaggcatttcttcttttgtttttgg

SEQ ID NO: 229817 - DNA, 461 bp, Homo sapiens
tatgctttgatgttagaagacatggttagcacctctgaaatagtttttctaacagcctgaaaaatagttggaaagagttgatgggaaggttgtataaatgaattttggtgaattctcaacatgatttatttatttttattttatttttcgagacagagttccactgtcacccatgctggagtgcagtgtcatgatcttgactcatcgcaacctccgcctctggggctcaagcgattctcctgcttcagcctccagtgtagctgggattacagtcacgcaccaccattcccgtctctactggaattacaaagattagccaggcatggtgatatgcgcctacagtcccagctacttgggaggctgaggcaggagaatcgcttgacctgggaggtgcaggttgtggtgagccgaggttgcgccactgcactccagcctgaggaacagagagagactccgtctca

SEQ ID NO: 229818 - DNA, 332 bp, Homo sapiens
ccagtgtttttggaacaaatttactaaagtagaatttaaaaagaataccaggccaggtgcagtggctcaggcctgtagtcccagcactttggggaggctgagggcaggtgcatcacaaggtcaggagttcgagaccagcctggcccacatagtgaaaccccgtctctactggaattacaaagattagccaggcatggtgatatgcgcctacagtcccagctacttgggaggctgaggcaggagaatcgcttgacctgggaggtgcaggttgtggtgagccgaggttgcgccactgcactccagcctgaggaacagagagagactccgtctca

SEQ ID NO: 229819 - DNA, 780 bp, Homo sapiens
atgtgaaggggccatggagtgaatggatggagggatggatgaatgtgtgagtaggtaggtaggtgaatgggtagatgtgtggatggataagtaggtgggtgggtgaatggataaatggatggatgggtagatggatggatgaagggataaacagatgggtggatggattgataagtgagcggatgaatggatgaatagctaggaaagtgggtgggtggatgagggtgggttgatgaggtaggtacacctacagataggtaagtgagcagtttcttgggagtccacaggtcacattttatctttgctttggaaaacctagcagatctgccatgatcaggatggcttcccgaccttgcaacccttctgcttctgacctccttggcacctgggaatgggggagattctgaccagcctccccagatgagtgttcaatgatagttacataaacacagtctcagaagagtcatccctgtgtcctccctcactgtgggttcccagctctggggcctgccctctctcgggtgccctgttcagctgtgctctgagccccagtttctccacctgtgaaatcagaataacacctacctcacagggctgttgtgaggatcctcccagtaatgactgtatggcactttgagttgcaaagcaatggatgaatgctaaatattattattaattattattatcactattctctccacaactatgggattcttcaaacatggcttatggtaataaatatttggttctgcattgggcagaggtatccaccagcccctt

SEQ ID NO: 229820 - DNA, 474 bp, Homo sapiens
ctttagtcagggtcatgcatgacagagggcttactggattgagaaatgagaggacagagttcagggtgaacatggcagatggaaagtgagaaaggaaaccaagatgtgtagaagaaagtcacagtagaggggaaccaaatcatgtggataaactctgcctacatctctggctgacctttgaactatccacaggcccaccattcaaaggtcctgacttcacaccctcatcagtcaatatattatgttttatcattagagtggaggacaaggagaacctaggtgtcaagaattgtcctgcaggatggaggcacattagtgaacatgacagacaaggttcttgtcctcaattcacacatctcatgctatcttggaagctgtatgttgcctgacttggagttctaatcaactgatatatacaacttattataattttcacttccaataaagaaattccatttgttgattttcctaaca

SEQ ID NO: 229821 - DNA, 395 bp, Homo sapiens
gttttatttagtcctccaaatactatgtgaggtggtaaattgtgattcagttgcctagcctataaaatgtggacaataaaagtatctacaacagaaggtttgctgtgaggattgaataaattaatatgtatgaagcacttagaaaagtggcaccaaagttctcataaaagttagttactattataaaaaaatcaatcttatcttagatgataagatatctttatcttatcaatcttatcttagatggcttaatgactttgtgacttgttcaagctcacataactgtaagattcaaacaaagctcagacttaaaccaagtttgtttgactttaaatccaatgctcttaataactaatacatagtccttggtaaagttgtcataaaatcatatgtgt

SEQ ID NO: 229822 - DNA, 1070 bp, Homo sapiens
gagccacaactttgcgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtggggtaggta

SEQ ID NO: 229823 - DNA, 1191 bp, Homo sapiens
agatgggtggaggcactgggccacctcagagggccagtgtcttgctgaggggccggagcagtcctgtgcctgcagcctccggagccatgggaacagggctgcgaagtcagtccttgcgagagccccgaccctcctatggaaagctgcaggagccctgggggaggccccaggagggccaactccgcagggcgctaagcctcagacaggggcaagagaagtccaggtcccagggcctcgagagaggcacagaagggccagatgccactgcccaggagcgggtgccggggagcctgggggacacagagcagctgatccaagcccagcgaagaggcagccggtggtggctgaggcggtaccaacaggtaagaagaaggtgggagagctttgtcgccatcttccccagcgtgactctgagtcagccggcctccccgtagcccacactgggcaccatcagctaaagatgctggaagccatcgtggcccccttgctgtgcctggaccagcccaccgtgtctgctgacctacctcttcacagctctctggactttggctgggtggccctaggaggcttctgccaccagctcactggagtcgccacgtggctgccactcttagctctggcccttccactccagcactagctctctttgaagatcccagcagggtcaaaaagaagggggctcagctgtctgccctctgggcttgggtaggggccttggactatgattctatgaaggtttagaagaagcctgcccggaatgggggctgtggacgctcctgccccacacgaccagctgtcaacttccaggacggagcttgatgaagccagacccatggccgagaggctcacggacgttgcctggtcactgggccatgacccaactgcccttcttgtcagttgctgatggtgggccagggcgcaggtctccctcccagatggtgagccctctggggcaaggaccacagctgggtggccctcctggctgagcactctgtgctgaaaacctttgaacctcacggtgtcctgatgaaggaagcagaggaagtcttcctccctgtgtgacagagggggaaactgaggcccagagtggggaagggatttcttggttttgacatctccgaccccaccccaccccatccagtgtccagcactggagtcgaacacagtaataaagatgctgagaaaaagtca

SEQ ID NO: 229824 - DNA, 921 bp, Homo sapiens
ggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgatacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttcttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaa

SEQ ID NO: 229825 - DNA, 736 bp, Homo sapiens
cgaattacagcctcaaggcctctgcagttaagttgagaaaaagggccatgtctcaggacagaaccatggatgtggcttttagcacgtggagaggattcaaacagagaagaaggtaactaggtttttgagaaaggtctactgaccaaaaaagtataagcccatatttaaacagtttgcaaccgttcaaatcttctaatggtcattgagtctcagctacctagatgcaggactgagagcattctttccttttcttttcactgtcttccttggtcacacatgaggggacattgagaataggctttctgtgggggctgagtcagttcctttgcagcttcctgcttttgctttgcctccttcaagtaccagaagagtagcactgcagaaaacagttgaaaatccctgatttcatcccagtctcattctatacatgggactctaaggtccagacaaaccacttactggccctggctgtgagattgggactcagagcacctgactcacaacctggtccactgtagccctcatcaaggctctggtcaagtcttcccccttcttgggcctcactgctcaccctctgagtctctctaccgtctcacactgcctccttcccactctccctgcctctaaccaactgtggggtctcattggatttggtcagtgttgatcttggaatgagtatcttttggaagttgataatgtacctgcagttttccatgttttgagatgtgttaaaata

SEQ ID NO: 229826 - DNA, 200 bp, Homo sapiens
aggatgaagaagatgaagaggaagaagaagggactgagagaccatctgtaaaagggaggagtaaggagatcctcaaattcttgcattcattgttttcgtgaaagaactgtacgtcatggaactccttgtaatgccgacgctgggcttttctcccacctgtatgcagttgctgctgaatttcaggggatgtgatttgaact

SEQ ID NO: 229827 - DNA, 265 bp, Homo sapiens
aattatttctcaaaatgattgtaccagttcacattcccaacagcagtaaatgagagttcccactgctctgcatccttgtcaacacttagtattgactgactttttgatttttgccagactcagttggtatgagatagtacctcaaatatgttaccttgttatatgttttgagccatttttgtttcttttctctagtgcttgttcatgtatttttcaatttttttactgtagtaaaatatatataataaaatttatcattttattc

SEQ ID NO: 229828 - DNA, 541 bp, Homo sapiens
cgattggggttaatcgaggactgtcactggggcttctcccccaaagttgggcgcgctgcgtcctccgtccccagacatcgaaagtccgggctcacctgggagtgcagcctgagtgtggaacgcgcttccccaccgctggcggggtaaccgtaccctattgtcttcctcccagtccgctgcgctcccgagccttcctcaattctttgatgggggaggggcgcggctgcgagaaaccggccccctccactccccgccccatcttctctccgaccagatttttttcctccaacattgtaagtgagaagttttaataatgcgaataaatctagcttgggagagaaaattttgtttagtgtcagtttaataaacataatttttttgttggtgtagaggatctttagatcctcagattgatacaccaggttttaaaaagaaaacatcacctgcactccaacctgggtgacagactctgtctccaaaacaaaacaaacaaacaaaaagattttattaaagatattttgttaactcagtaaaaaaaaaa

SEQ ID NO: 229829 - DNA, 443 bp, Homo sapiens
cgattggggttaatcgaggactgtcactggggcttctcccccaaagttgggcgcgctgcgtcctccgtccccagacatcgaaagtccgggctcacctgggagtgcagcctgagtgtggaacgcgcttccccaccgctggcggggtaaccgtaccctattgtcttcctcccagtccgctgcgctcccgagccttcctcaattctttgatgggggaggggcgcggctgcgagaaaccggccccctccactccccgccccatcttctctccgaccagatttttttcctccaacattgtaagtgagaagttttaataatgcgaataaatctagcttgggagagaaacacaatagaatcaaaaaaaaatggcaaccatgaatatagagtactaactgaagacatacagggctatgcaaaaagaagcccccaagataattccttgggcc

SEQ ID NO: 229830 - DNA, 1012 bp, Homo sapiens
cgattggggttaatcgaggactgtcactggggcttctcccccaaagttgggcgcgctgcgtcctccgtccccagacatcgaaagtccgggctcacctgggagtgcagcctgagtgtggaacgcgcttccccaccgctggcggggtaaccgtaccctattgtcttcctcccagtccgctgcgctcccgagccttcctcaattctttgatgggggaggggcgcggctgcgagaaaccggccccctccactccccgccccatcttctctccgaccagatttttttcctccaacattgtaagtgagaagttttaataatgcgaataaatctagcttgggagagaaaattttgtttagtgtcagtttaataaacataatttttttgttggtgtagaggatctttagatcctcagattgatacaccaggttttaaaaagaaaacatcacctgctgcagtaaaactcattgcatgaataaagaacaggttactttgcgggatcccaaacaaggtgtccaaaacaggcaccctgttttaagtaaattaccatattaatgcttttctttattgggagtgccgtttcctgatgggacacactaaatcttgcacacagtaggtgcccgataaataaatttgacttgatcaagatttttttgttgttgtcactaatctattttggataggatttgtacatttctgtagtcaatatttgtttaatgaccttatggattttacaacaaaaggagctggtgctgatgtaggagggctttatctttggattaataggcagccaaatgtacacggggcccagactcttgcctggtgccacgtcctccctccagcctgtaatcagaagctcttgtaaaccctcccttgcagtgagggctgaaaactccgatctgcctttgttccatgacaaaggagagattatcacgtgccctactggactgtgcatttcgtggcttgaaaaatcagtggtgaatgatgccactcagacgctgggacactgggagaacct

SEQ ID NO: 229831 - DNA, 538 bp, Homo sapiens
cagggacagaataagattctgctgtgtgtccctatggaaactcatgtggaattttaatgagaagtgttaaaattggggccaggtggaaggtgatttaatcatggagggcactgggtgttggaaggtggagattggggaggatgggtggattacgctggtggtgaggggcgaaaagtgggggtgggggggatccctcacaaatagttaaacaccatctccttaatcctttcctcatgatggtgattctcgtgatagttttggagctgtgagatttaatggatactggcctcctgggttttggacttgcattggccctgcgatcccatttgtgttattttcctggcaaacctctaccctttggattgagaaaacttacccaatgcctgtaccatcattgtaccttgaaagaaaagaactcccttttaaattccgggacttataggcaaaagggactgcagccttttctcaggtgagacgtggaactttttacattcgagttaatgctgaaatgactaaagacttttggcaaccttaaaaa

SEQ ID NO: 229832 - DNA, 728 bp, Homo sapiens
agacatgggcaaagattttatgatgaaaatttcaaaagcaatagcaacaaaagcagaagttgacagatggtatctaataaactaaagcacttctgcacagcaaaagaagctgtcatcagagtgaacagacagcctacagaatgggagaaaatttttgcgatctatccatctgaccaaggtctaatatccagaatctacaaggaacttaaacaaatttacaagaaaaagaaaaccccattaaaaggtgggcaaagtacatgaacagatgcttctcaaagcagaaacaaatcttaaatgaagttaaacacacatataaaaacagtagcaggagaggttacctgtttgagcacctatattttcttagagggaatcatgtcttaccagccagattgcccataaacctcaaaaaaagtcacctgggagaaaaatataacacaagacttgattttgcaatgtctgtaagccccctcaaaccccaaacttggggctcactgaatgaagataatttgtttttccattttcttcttgagaaaaagatgatttttaaaaatcagtgcctttgatatattttcaaagtccgacaatgtgattgattaaatcaagtctcttgttgaatttttctaatgctccagggtagttttctgattgacagcatatacagaagtatttcagcattcattgtagaaaagctagcagaaatgaccagtcaattataggcacccaaaaaa

SEQ ID NO: 229833 - DNA, 332 bp, Homo sapiens
gaagaaatgctctaagaagagtcaggggccttaagtcaggaagaagcctgcctaaaatttagtcaagttgaggggaacattaaggctgtatcttgatcagttcttactctttttataacttcagactcagaaacagtagtttccttcctgttcctcaaagacaccaagtatatttctgttctataatctttgcatttgttggactctctggaacaatattctgccagcttactacatggcttgttctcttattttcttctgatgtatactcaaatgtcaacttaccaccagagtgatatttcatgaccaccctatttaaaacagcaatcctc

SEQ ID NO: 229834 - DNA, 449 bp, Homo sapiens
ttgccttctcttctccccgttatctaagactttcaaaattaagacattcataaaatatttagaggagagaatgcagaaataagggtataatagaaggatcaaacactattggatttatttggatttatttgtgattacaagtaatataatggaaattgtattggctgggctccgtggctcacgcctgtaatcccatcacttagggaggccgaggcaggcgggatcacgaggtcaggagatccagaccatttgtgctaacacggtgaaacccgtctctactaaaaatacaaaaaattagccgggcgtggtggcaggcacctgtagtcccagctactcaggaggctgaggcaggagaatggcgtgaacctgggaggcggagcttgcagtgagccgagattgcgccactgcactccagcctgggcgacagagcaagactctgtttcaaaaac

SEQ ID NO: 229835 - DNA, 265 bp, Homo sapiens
cttttacttgaattccctgcctctatgcttgctcttcccaagcctagactttaaagctgtttttgcaaagtacgcactcatttcactctcatgcttcggtcttttcagttgccttccttaggataaggtccagaaaaacaaacaaacaaacacagcttgggtactacatacatcacctgggtgatgggaccatccatattcccaaacctcagcatcatgcatgtaacaacccccaacatgtaccttctgaatccaaaatataaat

SEQ ID NO: 229836 - DNA, 583 bp, Homo sapiens
gattcatccaaaatatttaaagatgaaatggtacgatgcttggaatttacttcaaaatattcatgagggagtagatatggatgaaataaaacatatttggttacatatttataattgttaaagcttaatgatggatgatttgagtttttaaaaatgttctatcagggccgggcatggtggctcatgcctgtaatcccagcactttgggaggccgaagcaggcagatcacctgaggtcaggagttcgagaccagcctgaccaacatggcaaaaccccgtctcttagagttttcaaaaagacttcagttaaaaatatttcaactggacctttctgaatagatggaaattgtatttcagaaagttgtttctttcgagacctataatatttttaaaattttaattcattgtaacatttttatgccatatgttttccctcacttcttgagagacttaagtacctccaacttttaaattagacctgtgtctctaattataatgtagttttttatttatttatttacttattttttgagacagagtctcactgtactccagcctgggcgacagaactagacatctcaaaa

SEQ ID NO: 229837 - DNA, 417 bp, Homo sapiens
aaatgctgcacataggcaatttttgcctgaacttgtagattgcattattaattccacatagattctttattctaaaatcaacctaccaatgttttctcatctctaaccaagtattcaaaattaatcaactctctaaagcagcatgttttgtgacatgacagtaatgtgtatgccataaccaatcaggtgaaacatcattgtacggcagacatttcaaagatgagactttaaaaattaatgagcaaagagtaaaacatgtatactttcaacctttcttttttctttgaaagatctaaagaagacagacatgaagctcagttttcttcaaagatacttatttaaatttcaaattgactattttacattgctaaattttatataaaattaagtattgtatagtaatgtaataatgtcttt

SEQ ID NO: 229838 - DNA, 556 bp, Homo sapiens
tgttaatattggaaaaagccacacaccaagacaaaccaatcacaacacctttcggtttgcagcaaagtactctggatcgaaaacagtcacaaggcccaatggtgtggagtttgcccatgcatcttcccagtggctcttaataagaaatccatttccagaatcagcagcatgacccagcctacattactctggtcaggccagttatggtccagccctccttgggacaccctacaatgaagggacaagactgccttgtgggtcagtcactgcatggcacaggaatacagtagggagtctctggaagtttaatgaggacaaacattgcaagttttctctcttctttctttctttgtaaactgaaaggactttcactaatgctccataaaaactggtttaatatacagttattacaaaacttcagatttttgacagattaagtgctattaaatcaccctagtgtgaaggcactaaaaggtcacaagatgaattagttcaggccatcttctctcagtcttcagcaagtagcttctttcagaactgcctcctcccgccaaga

SEQ ID NO: 229839 - DNA, 397 bp, Homo sapiens
gtgtttcatccccctcgctgctcagcctttggaactgtttctctactctctgtttctatgggatccgcttttgtagattccacataaaattgagattgtatagtatttgtcattttgtgttggcaggaaagtaaattagtgcagctattttggaaaacagaatgaaagttctacaaaaaactaaaaatagaattaacatatgatccagcaatcccacttgtgggtatatattcaaagtaattgaaatcagtatgttgaaggcatctctgcactgccatgtttattgcagcattattcacaacagtcaagatgtggaagcaacccaagtgttcatgagtggatgaatggataaagaaaatgtgatgtatacatacaatggaatactattcagtcttta

SEQ ID NO: 229840 - DNA, 390 bp, Homo sapiens
cattggcataatgtttttatatattgttcttctctttaaacaaattatctatgaacactcataatgcccaactaatgtattggtattataaaacaaaatattatattagaacattattgaacacttttctaaaagtattaaaactctaaagaaaaacatttcacatactgtagattatttgcttatgttcttattaacactctaaaataaagctagtaaattattcaccatgattgtaacaatttcagaaaatatggtctctccacactggtgtgtaaatgctctatgactctagacatttaggtgtgttcaaataaattactctgtattttagagtttttgtatttctgcagttcacagcgtatttcaatataaatttctccactaaca

SEQ ID NO: 229841 - DNA, 440 bp, Homo sapiens
  misc_feature (298)..(298): n is a, c, g, or t
ccacttatgtgaaatgtccacagcaggcaaatccataaagaaaaaagtaggttaataattgccatgggtagtatgctgaaattcttttcattttgcaaaggaagctggatgagagataaaaactgtgagatcatatagttagtaagtggattgaatgggatttaaacttggatattgtgttccagcacccccaccaggccatggggtaccatgtgcaaattagaaaagatgtaggagggccaggcgcggtggctcatgccttggcctcccaaagtgctggggtcataggcgtgagccnacgccccctggcctggtatttctatttttatatgccctaatatttcttatttagaaacatttgaagcctattaaaacattacaagagtctcgggctgggattacaggcgtaagccaccgcgccaggcctttttttttttaag

SEQ ID NO: 229842 - DNA, 412 bp, Homo sapiens
caacctgggggcccgggttccaggttcaggtggcacagccccagagagctcccctttatccacagccccaggccctcccaccttctgcagggggttccacagccttcttcatactctgaacgcaggctgtcttagtatgtcatgctggttatagtagtgacagtataattatgtattatatctcttatgtaatagtaatggtagtgatttgcatgtgtggagcacctgtagggtgcaggcccgctgaggacctcatgcacgctgttgtatctcattatgtcaatgagaaaactgcctttgggaatggtagtgaactttgccagtgcagaacagtaatcctagttttgaatccagatttttctaacattttatttctagtataaagagtatttattttgttttacagtcatta

SEQ ID NO: 229843 - DNA, 560 bp, Homo sapiens
catgagtaaagaaattctgagagaggccgggcgcagtggctcatgcctgtaatcccagcactttgggaggccgaggcgggcagatcacgaggtcgggagatcgagaccatcctggctaacacgttgaaaccctgtctttactaaaaatacaaaaaattagtgggcgtggtggcatgtgcctgcagtcccagctactcgggtggctgaggcaggagaattgcttgaatctgggaggtggaggttgcagtaagccaagattgcgccactgcactccagtctgggcgacagagagagactccatctcaaaaaaaaaagaaaaggaaactctgagaggttaaatggcttattcagattactcaagttgtagatggaggaacagtcatttacattttggtctgtcagatcccaaaaagctggtgtttggtcccatccacaatgcagcttccaaagcctgtaccaaacgtaagatgctttgtccaaaggactcatttttgcctccctattagtaaaacgggagtagggggaaactacaaatagaaaaggcctgcaagtttgagtca

SEQ ID NO: 229844 - DNA, 383 bp, Homo sapiens
gaggagttggatggaggctgaggggtttgtagcagtcagccctgaccagtcctacctgggttgtcactttattgatggctcagggaatgtctcctttttgtttgcatttgatagcaagatgcctttagatttcttcccttgcccattaagtcaaggtgcagtttttgctttagaaatttcagaatcgagtttttccagcacttctttttctgatgcattgggttaaatatggatgataaaattaaaaaaaaacactcattcaagtgacctcatgttttgtgtttgtcacctgttttcttgttgtgctgagtgttaccctcagattgacctagctgtttgtgtacacccagtcactgccagatacatagctgaaatgaatttta

SEQ ID NO: 229845 - DNA, 186 bp, Homo sapiens
agatggcccaaggcacagagccaggagtggcctggggttcacagtggctggtgcacatatctcctgcacactcacagccatgttaatgtgtcctgaagggagaagtctacccttgcaatttccagatattgggacatgctgtccctacgtctggccattgatgcacctgctcctcctggagctcat

SEQ ID NO: 229846 - DNA, 1583 bp, Homo sapiens
  misc_feature (939)..(939): n is a, c, g, or t
cagaaggggctagctgacctttctcttcccacatgcagtaagccatcaagattcctctgggaggggtacccttccagtactggggtgagaaaacagcccttaccaccagacattgagaactggggctgcaacagacctgaataaatatacttaatgaagtaacccttatcttccactagttttatacacccctctatatatctcagtaactcccctagaaaatttattgcccctcaccaaagtttacttgtcctgtcatttcttctcaaattcattgttctttgtcaaaaaagtatacaagcatcttgctgtggttacttcctcggattcactcttttatgaagatccccatgaacacgtcgatgatgtatatgcttttcacttgttaatatgcctggtgtcaatttagtttgcagatccagccaaagagcccatttacacaagagcaaaaaggggagtcagagatgatctctcactcccctatactacccagctatccataataagaggaaattaaagagtcattaaaatgctttttccatcccagggtaagtaagccataaaacaagccattcagtcgcagtcgaagagcccttttattatttctaaaatgagggccatgaattagatcacctcgagtgtccctgctggtaaatgtatttctgaaactgtggttctctgcccatggcatcacagcagagcagctaagaaggtcgcctgtagaatcagaatgcctcgatctaaaaccctgccatgccatgtgtttatgtatattgttggccaagtttattagcttccccgtaactcagtttccttgcttgtatagtgggaattatacaagtatccaggtaataagattgttgtgagaattatatcaccttctgataaataccattacctcattagattacattttagttcccataaacctactttacncaaatccctatataaataacactcaaatttcaaataacaaggaatttatagattgcacatcaatgactaaattacctttcctactctagtaattcttcaaggctccatccagtcatctacttcctgtttaatgataatctaacaatcatagtacctacatactaataattcactcactctcaaccacctttctggcaagctaacctttaatgaaaaaatgtctcagctatcccaatgtttgctgaaaacctaagtgaagcgatgctcttgatttatttttccatcctttcttcccatgtaccattctgcataatagcagcaagggtccagtacaaatcttcctaaatcttcctttttcacaggttttcttttattcaaaattcactaagcagaatgaaatgaaaggactgattgagtcataacttcattattcccccatctccatctactccagtcatatacgcaaaacttgaatgtgatttagaacaccctgtcctggctgtccccatctaagaacccactttcactattctatgttctgctgctaaactctgggaatttctaagacccaaagcaaacaactgctctaattcaatactgcctttgatacgctaatagtcctatgaggacttcgactatcagct

SEQ ID NO: 229847 - DNA, 635 bp, Homo sapiens
aacaacttccttctttcctactttaaattttatatttattatcatgatcttatggattcttctttctttcttattcttaagtggactgtgaattattatcactattctttttgatttcccaattgatttgaccagtgggaattccttcaaaccaattcctatgttcttttgatatttcgccatcaatctttgagtacctctttgttttctgacaacaagagattctcgacttaccttatattttctttgccccagagccagaatcagctgtttctctaagaggcagtggttctttttagtggagaatggtatttagaaatcaagatgtagacataatatgtgctctctgctactggggtatcattgcttctgggccctttcattacagagctaaaataaataaatgtatgtatatgtatttctgtctctatcttcatctattggagtctctgatggttagttttatatgtcagcttgggtggatcacagtgcccaaatatttggttaaacgttattctggaggtttctttgaggatgtttttggatgagattaacatttaaatctgtagactttacatgaagcagattaccctccttaatgtgaatgggcctcatccaatcagtcgaaggcctga

SEQ ID NO: 229848 - DNA, 545 bp, Homo sapiens
ttactagggagtgtgaggggcaggggacacatgccttccccagataacctgagggactacatccctcctccacactccaagtcaaatatttattgaggcaagagaagagactggagtgctccaagttgggaagacctaaccccaacttggagatgtgatggaaggctctcccaagatgtcagtatctaaacttacacttgaaagataagcaaaagccgggtgcagtggctcacgcctgtaatcccagcactttgggaggccgaggcaggaggatcacctgaggtcaggagtttgagaccaacctggccaacatggtgaaaccccgtctccactaaaaatataaaaattagctgggcgtggtggcgcatgcctgttatcccagctactggggaggctgaggcaggagaatcgcttgaacccaggaagcagaggttgcggtgagctgagatcgcgccattgcactccagcctgggcaacagagtgagactccatctaaaaataaaataaaataaaataaagataagtaagaagtggccaggtaaagc

SEQ ID NO: 229849 - DNA, 511 bp, Homo sapiens
gtcactacacaggtgttgtaaacctctctaaatggtttcttcagcattcaagtttgacatgacaaaatgtgcatgcatgcagtattcaattactgtttagcactgtaccctctgagaggaggagatcctggggtatggtgtcaccccttccaacttcccctcctttgcttatccatttcctttcacactttatttttagagtccatccaagtaagaaatttatccatatatatttttattattgtgaaaaatttggaagttcatacctaaccattataatgcacattcttattcataaagaaattaaaataatgtttgatgaatgcacattcttattcctaaacaaagtaaaatagtgtttgatgtggtttatattatgtattttgttctttgtaaaggaactaaagtgaaattctttcttacctgaagttaaggaaatgttttgagaaggactatttgccagactcaccatgtttgaaagttatgtaaataaatgttttattcaatgtca

SEQ ID NO: 229850 - DNA, 430 bp, Homo sapiens
agaatgctgactcttctgcccggcctactttgacttttactctgttaggttttccagaatgctgactcttctgccccttgaaccagggactccaaagaataagattcatgggggcgggggcaaggagttaatgtattctgtctgtggccagccatcttccctggtacatcttcttttctcagttcaaactgaggaacgggttagttggaactggagtctttctcttcccctattttcctctgaaagagttcattgtaaaagtttttttacccattagctgggtgagaatgccagataaatggcagaacaagttaaaaatgagattgttccctcaacttcatgtgaaaggtggagtacttggctagatactctgtttattgtgtaatggattgaaccttgaaaaataaaaccccataagaatagcaaaaat

SEQ ID NO: 229851 - DNA, 316 bp, Homo sapiens
aacctgaggcctaagttgaagagcccagtgtagttcccaagaaggaatgattgtgcatcagagcccttgggaatggttttaacccaggaatgctgaacttgcatggctgctgttggggggcagtaaggcggtgaccggtgactgcggagagaggacatgccctgttcacaagcctgtgaaggcagacatgcccgtggttatgggaggtggtagttcctatacctgacacatcctaaagcatctgatatcacatgcaaactatatgaagaatgactaagaaaataaaaaataaattattatcattgttctgacaaga

SEQ ID NO: 229852 - DNA, 523 bp, Homo sapiens
tctttgtctgttggttcctgcgtgataatcaaagggacactgatcgactcttctatcaacgaaccacagctgcaggtggatttctacactgagatgaatgaggactcagaaattgccttccatttgcgagtgcacttaggccgtcgtgtggtcatgaacagtcgtgagtttgggatatggatgttggaggagaatttacactatgtgccctttgaggatggcaaaccatttgacttgcgcatctacgtgtgtcacaatgagtatgaggtaaaggtaaatggtgaatacatttatgcctttgtccatcgaatcccgccatcatatgtgaagatgattcaagtgtggagagatgtctccctggactcagtgcttgtcaacaatggacggagatgatcacactcctcattgttgaggaaaccctctttctacctgaccatgggattcctagagcctgctaacagaataatccctcctcaaccccttcccctacacttggtcattaaaacagcaccaaaccgtacat

SEQ ID NO: 229853 - DNA, 298 bp, Homo sapiens
tcttcaggctctggagtctgactgcttaggttccaatgctggctcctccactttctggctgggtgctctcaccttgaacttgcactgtctctaggacctgcttcagattcactttgtgtctgaaggggagtcaaacatccccttccatattttatgctgaatctctaaggttattaaccttacacaaacagaaaagaagttctctagcttcttgaatgtctctgtctttctggccaagactgttttaatcataaagacttggctttgatcattaagttttatagagtaagtggaagtt

SEQ ID NO: 229854 - DNA, 489 bp, Homo sapiens
ctttctatttcttaaatattgtttgtttactcgtgtgtgaaggtaaattgtatttaatacagaacttcctgtggtgtgatattaaagatgacagtgaaaacccgcaagtcaagaaatgcaaactggtgagccttagagctgtacttactttcccgtgatgtggatgttgcctaataatacacggacatatttcacagcctaactagttacccatcatttatttgatgtgtgaagacaaggccaacttctcaaatttagcgtgttgacataggaattttaatctcttcctttcttgaaagaggaaaaaaatgtaacgaacagtattaaattcagcgaggtgctgtggctcacacctgtagtcccagctactcgggaggctgaggcaggaggattgcttgagcccaggagttcaaggttacagtgagctgtgattgtgccactgtgctccagcctgggtggtgacaaagtgagaccctgtctctaaaacga

SEQ ID NO: 229855 - DNA, 602 bp, Homo sapiens
gcgtggtgtctcatgcctgtaatcccagcactttgggaggccgaggcaggcggatcatgaggtgaggagatcgagaccatcctggctaacagggcgaaaccctgtctctactaaaaatacaaaaaaattagccgggcatggtggtggacgcctgtagtcccagctacttgggaggctgaggcaggagaatggcgtgaacccgggaggtggagcttgcagagagctgagatagcactactgcactccagcctgggtgacagagcgagactccgtctcaaaaaaaaaaagaaaaagggcagaggccttgaatagacatttctccaaaaaaatgacatatacgtggccaataagatactcaacatccttagtcactgggggaatataaactaaaaccacaataaggctgggtgcggtggctcatgcctgtaatccaagcactttgggaggctgaggtgggtggatcacctgaggtcgagagtttgagaccagctggaccaacacggagaaaccctgtctctactaaaaatacaaaattagccaggcgtgatcatgtgtgcttgtaatcccagctacttgggaggctgaggcaggagaatcgcttg

SEQ ID NO: 229856 - DNA, 366 bp, Homo sapiens
attgttagtattttttgttttctgagcctttatagaattttaggtacaatatatataaactgtaaactggcccacattcctgagctgtgtctgcaagaagtgtgtcacctggctatttcctttttcttgatagtctgttaaaatttggcaatagaatagtacccagctttccatacctctgagactcttccagaatacagagttggcagttgttggttcttccttccaatggaatgttcccaagagtgtgagaaaattaccgttgaggccagaattttgtcccttttccaaaacaggtgggctctagcatcaatcatgaggtgaattaatgaaggccctttttatagccccaggctagtgatagtc

SEQ ID NO: 229857 - DNA, 450 bp, Homo sapiens
aatcgactttggggactcaaggggaaggttgggagcgggtgagggataaaagactatatattgggtacagtgtacactgctcagatgatgggtgcactaaaatctcagaaattaccactgaggaacttaaccatgtgaccaaaaaccacttgtacccccaaagctattgaaatgatagatagatagatagatctttcataaagtatttaaaagtttaaatgagaattatctgatttagacaatcaaatgtctaattttttacacactgttgtggaataattcacaaactgctctacatgtattatctgatttggttcttaaaacaatgtgaggaaatttaaattattattaattctatgatgctgatgatgctgatgatgtggtgatgatgctcctctttccagatcaggaatctgaagcccacagagccactaaagatattagatcgga

SEQ ID NO: 229858 - DNA, 441 bp, Homo sapiens
agtcctccaatcattggatatgacaacttatgctttaactttcatttagtcactttttaaaagaacaaatgacctgaattctgacaccattaaaggatgcactctcgagacattatttattatttctgtgattgtttttaaacaatttgagtcgtttctttgtcaaggtgtaacaaagtaaagctgtgtaatatattacaaattaatagacagtttcacctggagatttgctatattttttgatgtgtgactatacatacacagatgtgtacacacacatatatatatacaaacatacagacagtatgtattttcataaacagaacaatgttcattcagagcatcagctagactatttcattcctgtacttataaatatatcctacagtgtagttttatttaaaattattattataataaacatttgtgaaagttccatat

SEQ ID NO: 229859 - DNA, 637 bp, Homo sapiens
aagacatgtcaaaccccacctgtatatctgttttcaaccatttggagtcgaggcgagcctgggcagccaaacagaaagattcagagggcatcttttctccagcttcctcccaggtctcaggcctgcaagtaaacacatacgctgaagacctaacgctttttaatagtttacaaagacactcccgaaaggttcaatgcagaaaagaaaaaagagagagagaacagaaaggggggagagaagagctggtggaggggagagaaggggagagagggaaagagggaagagatggagggagagggaggtggggaagggaaagcctccttccaaggtaggcagggtgtgccgagtttctgcaccacgctgacgagaccttgagaatggacggtcacaggaagccaagtcacaatgtcatccccctgccctcaaatccaagaagtacacacacataacacacatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccg

SEQ ID NO: 229860 - DNA, 492 bp, Homo sapiens
atatatggagattgacaatccattgttggtatggtaggcttactgccatcagggacccattcttcttctatatttccatcctactatgtcggtgtgtagcttgcatcctcatggttaccccccatcatgttccaagatggctgctgaagctccagtcatcacacctgcattccaggcaagaggtaagggagctagaaaaaagggcaaaaaagatctagccagctgtttccctcctcaccctcttcttggagagcttttttcaatgtcccaccaaaaaaactccctcttccatcttagtagccaccaatagctgtgggaaaggtgggaaatgtagtcttttagctggatgtagtcctgataccaaagaaaaaggggtgaatggacattgattgggccacattcacctcatttagcatctccatacaacagcaagagcaatattttaaaaattaaaaatagatgaccgatttgtttcctgttgggactcataaa

SEQ ID NO: 229861 - DNA, 319 bp, Homo sapiens
gaggctgtcttactttctggatttaataccgtttatctcatttctttatcctttaaaattgctttatattggaagtaaaatccaaaagctcagttggactcagttaaacatttttgatgagaattcttagtgattctgggagcatagtagacacctaataatctgtaggggtgatattttggcaacctttgaatttctgatttctcatcaacttttcttgtaaggtttcctgaattaatattttattacttttggcaatatgatagttttctaattctgttctacattcttcatttttttagctgtaattatttataag

SEQ ID NO: 229862 - DNA, 477 bp, Homo sapiens
aaagaaagaaaaaaaaagaaatggtagttggttgttctcttcatttagactttcatagttatatttccgccttaaaagtatgtattatttatggtcttttagatagtaagaaacagatacccactcagtttatcatagataacggcattttattttaaggataaagggaggtgaggaaaaagatgatggggacgcctcttccgtcaacacctccctgaggaccgcgatgcctctctggatgtctgcattcctgggattccactttcctcttgcccacctctgccgcagacctccctttcttggcagcttctgtggttccttgggcgcatcctgccattcaccctgccccctgcctcaaggcttctcactattcctggcttctctgcctcctcctgtgtttcactttttgctctttctggatgtaggggagggaaaaatgtcttccctccacccgtctacttatttggttgggctaca

SEQ ID NO: 229863 - DNA, 1863 bp, Homo sapiens
ctgagcagagtggacgaggccttctacctcctgtagcccccagctggcttgatttggctggtcttggggtgatgcctgacaccttcaactcaaggtctccctctgtggagggttctctgtgggcagtgggcacagagagtcagggtcgagattggaggcacctgccgaccatcacaagtgagctctctggggctccccgctgccacactgtaccctgtgctgggagcacagctctccaagagcctggggagccccaggggccaccagccagcccttcgtgcccagaggaggccttggctgccacatgggagcagccatgggcttcggaggtattcgggcctgagagaatgcccccctctggagctgctcgaagcttccaagaagtaacagagccagctgtagtggcagtggaccggcaggccatcttcccagatacctgggactctcacggaggaacatggcctacagcaggagaggccaaggccagagccagggaggctgggaagcagctcccctgcctcagttaccacggagcagctaggtgcaaagatgaccgagaggggaagtgtggccaggccaacccagggacctgaaaccccaaggagcccagagggcaccacggaagctgccacccaggacgggaaggaacagccagagcttccatgtgccatggccatgggcacacccagcaccacggagaggatttccacctctggccaggcaggcaccagctcgcatggctgctgggcatggccattggcgggtctgagtgtgggccgctcctcgctaactgcatgcagcctcccactctgcgcatgtctgcttgggcagaaaatgctgagacactgtggccggacctgacagtcagcacttggcagtgggctctgtggacccagcatttctcatagcgtcaacccacctcttgccttgttgaggctttttcctttcagatgagctgtccttgacattctgatgtggtgaaatggttagcagcatggactttggaaccagatagacctagatacaaaccacatgtctaacacttgctacctctgtgaccttgggcaaccccctccctcagcctcagttttctcatctgtaaagtggggagaatttccatcaagattgtccggagacctaaatgagataattcctggaaagtgtttagaacacagcatgtggtccctcaataggccgtggctgacagtacttttattacttgctttttgcttaaattaaaactttatgccgggccaggtgtggtggctcacgcctgtaatcccagcactttgggaggccgaggcgggcggatcacctgaggttgggagttcgaggccagcctgaccaacatggagaaaccccatctctactaaagatacaaaaagattagctgggcatggtggcgcatgcctgtaatcccagctactcaggaggctgaggcaggagaatcacttgaacccaggacgcagaggttgcggtgagccaagatcataccattgcactccagcctgggcaacaagagtgaaacttggtctcaaaaaacaaaaacaaaacaacaacaacaacaaaaaactttatgcctcaccctggcacagtagcttatacctgtaatcctagcactttgggaggctgaggcaagaggatcgcttgagcccaggagtttgagaccagcctaggcaacacagtgaaaccctgtctctacaaaaaattaaagattagctgggcgtggttgcacatgcctatagtcccagctgctggggaggctaaagcaggaggatggctttagcccaggagtttgaggctgcggtgagttgtgatcgcaccactgcattcagcctgagcaacagatcaagacactgtctc

SEQ ID NO: 229864 - DNA, 490 bp, Homo sapiens
agaaattagcatctatgctcaatttctaataatggaatggtgcctaggtactcatgtttgtctaggtgaaaacagcttctaaatccaggtgcttacatcagaattgctctcctggaaatttaggactgagacattgagtcacttacctgtagggtaacctgtagaatcagagatttctcaaatttgacctgtcttattttgataccatgtttcccagcaatgtaacctccccttaagtatcagtttttgtaaaatctcctaatcaatttcttatcagattatattatataaatacctatcatctagagtactccagaagccaaatgaacattaaaaaaaaaatactgagatagggccaggcatagtggctgagtgtaatcccagcattttgggaggctgagttggaaggataacttgaggccaggagttcatgaccagcctgggctatatagcaagacgctgtctctctaccaattctataaatattaaa

SEQ ID NO: 229865 - DNA, 399 bp, Homo sapiens
cattattagctttacagggatgttgaagtgatcaggatatcaatgacataattaagtggtattatatttttaaaatttgagaaataaggaaaccattgctttaggatatgtctcttatgtactcagaaaagcttgcttttgtaagttaagcctcaatgatgaataaatagtgcatttgtggctgggcgtggtagctcatgcctgcaatcccagcactttgggaggttgaggcagacagatcacctgaggtcaggagtttgagacaaggctggccaacatggtgaaaccctgtttctactagaaatacaaaaaataagccagacatggtggtgcacacctgtagtcccagctactcgggaagctgaggcaggagaatcacttgaacccaggaggcagagg

SEQ ID NO: 229866 - DNA, 675 bp, Homo sapiens
tgtaaagaacaaaaatttattttctcttagttcttgactgggaaggccatcgtctaggtgccggcatctggtgcgcttttttgctgcatcctcacagggtagaaggtggaagcgaaagaggacagactcgtcctgtcgagccctaaacggcacctaatcctgttcacccgggaggggagccctcatggccttatcacctctttaaaggccccatctcttaatcctgtcacattggcaacacctgaattttggaatatttgacgtgaatctggtggtaacctatgaataagtaagcattttggtgtagggctacagtatgtgaataatttcatgttgacatcaagaacccattttacctttcaaaccatagtacttaccactcagctccagaaaagtcaaattaggaaaggggaaaatatctttatccttaggaataatgaaggctgggcatggtggctcacactggtaatcctagcactttgggaggctgacgtgggcagatcacttggggcccaggagtttgagaccagtctgggcaacaaggcaaaactccgtctctacaaaaattagctaggtgtggtgatacatgcctatagtccctgctacttgggattataggcatgagccaccgtgcccggccttaaaaaatcacttaaaatctttaaaaaaaaaaaa

SEQ ID NO: 229867 - DNA, 492 bp, Homo sapiens
  misc_feature (405)..(405): n is a, c, g, or t
  misc_feature (479)..(479): n is a, c, g, or t
  misc_feature (487)..(487): n is a, c, g, or t
  misc_feature (492)..(492): n is a, c, g, or t
tatagtgttataatattctgttttgttttgtatcctattagcagtgaggatttttttttacctttaggtgatcatttattactcattaatgtccttttcttcctgattgaagtactccctttagcattcctttaggacaggatttgtccccagtgccttatttagttcacttggtgaggtcatgttttcctggatggtgttgatgctagtagatgttcttcagtgtctggacattaaaatcttgggcatgcagcaccatatgagaagtttaaaaaataaaatttaaagagagaaaaggctttggtatcaggatgattattgcggcactattcacaatagcaaagactgggaaccaacacaaatgtccgcaatgatagactggattaagaaaatgtggcacatatncaccatggaatactatgcagccataatgatgagttcatgtcctttgcagggacatgcaggaagctggaccatcnttctcagncttcn

SEQ ID NO: 229868 - DNA, 571 bp, Homo sapiens
taaatacagctattttgaattctctgtctgaaacatcacatatctctttttctccaggatttgtccccagtgccttatttagttcacttggtgaggtcatgttttcctggatggtgttgatgctagtagatgttcttcagtgtctggacattaaaatcttgggcatgcagcaccatatgagaagtttaaaaaataaaatttaaagagagaaaaggtgagtatttattgtagtcttcactgtctgggattatttgtagctgtctttcttgggaaggcttttcacatatttgaaaagagttgggtgttgtgatctaagccatatctgctttatggagcaccttatacccaataatgctgtaattcttccagactcagagaagtaccaccttgacagccttcaacaagacccaggagaattttctggattactagctacagactctttccctacccttattttctctcaaagatacagtctttctctctgttctaagccacctaaagctgggagaagaaagacacaagcacctcaggccaccaccactatgactgccctggatcagacctgaag

SEQ ID NO: 229869 - DNA, 484 bp, Homo sapiens
tcagctgcagggactccctccaccacgggacctaactagtgatgggcaccctagcagcagccaggaggcacaagccaaagagagaagcagctgacatgtggttgaggatcagacaggacaggaaaagtacttagaatagtcagcacaatctcatacctgaaatgtgacaagttttaagtgggcatatgaccacccactacagaccccatcctcccacctgtctggtttatgattatggccaataagaatcgagtcaaaggaatgtgtgtcacttagatgaagccatgacaaaaatataatcccttgcccttttcctttctctgctgagaggtgtccatgggatcagccaacctgaattcagaaatggaagtattgtgaagatgccagagttccccccctcccagctctggaaaactgagctctgcaaaatgagaaaaataaaaacatgtcttgttaaaaaaaaatataaaaaaatataaaaaaa

SEQ ID NO: 229870 - DNA, 1061 bp, Homo sapiens
agcggaaccgctcccgcatccctcgcctgcacagtgggcagtctggcgcctgtggcgtcgtgtttgctgagggcccggctgccgttgactgaggctgcgatggcggcggcaggccggggtcgggagcaggactcggcgcgcttcgtctatgtgacgcgcttcggctcgcatcagtgcagtggcgtcctgcaactgggcggccgtggagctcaaggcctttggggtcaggggcctggggcaggctgtcgccaggagaagccgagggaagcaatggcggtggcgggcgttcagggtggcagcgagctgcccctcggttcccagctcagggtccccacgacccctggtgtggaggctgcggcctctgcctcctcccagctgcgggcatcgagagttcagagcggcaccagacagtcggcgcgtgcaggtttaatccagaaggatgcagctaaaaagtatgattttcccataccattgaatgaagcttccaaaataatgaagaaaaagaaaaaggttttagtatggaatagagtatacaaagtcatttcaagaatgcttgaagaaaatgaaaaatatagacacaggctgaaatgccaaaggttatctagtgaaagctcaaattacacaagatgaatcttcttatcttctggaataacctatctttggatgtttcccaaagaagagtatgaagaatctaaagatgaaacattaaatgaatcataattatttgttacttttgatgtgttttattagaattgggactttagtagtcgaacagaaaaattaccttctttataaattaataatatttctttgctacttaataatacctttagttaaatattgttaaccatatgcatgcaagtgttattttcagaattaatgcttattctacatacttttaaattaacctcatacataaaattaaattagcatatcaatgcaattgcatgaattttataattaccagcttttccattttattaatgagtctacaactgctgctttgttcatctcttcttttagatgtaactcttaaattaaacttggattcatttaaatta

SEQ ID NO: 229871 - DNA, 406 bp, Homo sapiens
cggtgccgcgagcggaaccccggatgggtccggacgtgggcggcggcggcggcggcggggccggggcgcagcgctccgcagagggagccgcgggctgcttggtcggcctgccccgccggcccctcatgttggaaccgaggcggagggagaagggaaagcggccgggaaggggcgggcgcaatgggcgcagtgggggcggccggggccgggtggggaggccagaggggcagggcaggaggggcccggcctgcggaagcggttggagggagaaggctcaatccgaatggctggggcctcactgcggatcgccttcagccgccatcttgtttcttccgttaccggagcgcggtcacgtgagctgagcagcctacgagcctgggacggggcgaggtggcgcggcggccgc

SEQ ID NO: 229872 - DNA, 345 bp, Homo sapiens
tactgttcctagatacaagatactttgaaaataaatttattattaaaataaaatatgcagccaggcaaagtggctcatgcctgtaatcccaacactttggaaggctgagacaggaggatagcttgaggccaggagttcaagaccagcctgggcaaagtagtgagaccctgtctctacaaaaaatatttacaaaattagccaagcatgtggcacaaacctgtaatcacagctacacacgaggctgaagcaggagattcacttgagcccggcagattgaggctgtactgagctatgatggcaccactgtactccagcctgggctaaagaggcaagaccttgtataaa

SEQ ID NO: 229873 - DNA, 829 bp, Homo sapiens
agctgaagggaggccagggacctcactgggctgggcaggtgcaggccaccgccgtcccagtgccctcagaggcacctagactcatgtggacccggccgcagaccgttctgggcagctctgtccaggccggccctgccctctgacctggggccgcaggggctggccactgtgggctcggttccctgccaccccaattcatctgcaccccaaggaaagaaaatgaggggttgcagcgccccaggacccaagagcccccgaacaccagggcagcacatacttccagtgccagggccacagcagagaggggcgcaggagctgccgcggccaggacaaaccaacctcaggctgacctaggccggtaatgggtttagctgcatcaggtgcaaaagagaaacaccccacaaatcagggagaggagggaagccgcccaccccatgggaggaagctgaggagtgaacgccagggatgggcagggccggtcctcggagcactgcagacaccagaccaagggcgactgtcatcaccacgagaaggccccgtccatggcagaagccaacctcaccgcgccgactgcaccggagacgcccacgaggacagccggcctctgagaacgcagctgagccgtcacaggtcgccatcagcaaaggcaagagtccagattatgcaaacggaggcaaggctgccatggactccagagcctcagacgccatcaacaaaagcaaagtggacacatctgcatcaaatccatcacaaagacggccttcgagactccgtctcataaataaatatataaataaatatataaataaataaaataaataaaaataaa

SEQ ID NO: 229874 - DNA, 489 bp, Homo sapiens
aataaaaaatggttagaaaagaaatgatgaggaaatagaaagaggtggacagaatcaagatatatttaggagctggaactgacaagtgactaattgcatgggagaacgaggaataaagagacatcatattctggctgcgtgggcagtggcgctattcactgagaaggaacacaagagaccctgtgtggatgtataatatgtttggtgagaggtgatgccttagacctcttccatttgaagtgttcctgggtagggtggagaggtgcaatttgctgtatggagttaagagagacagctaaacagaagttatcagtttggaagttgtatccatttgaaattgtgtttagcttttctaacaataacccaaggccaggtgcagtggctcacatctgtaatcccaacactttgggaggctgaggcgggaggatcgctcgagcccaggagtttgagactaatctgtgcaacatagtaagaccccatctctttagg

SEQ ID NO: 229875 - DNA, 1901 bp, Homo sapiens
atataccccccttcccccatgttcctttatctcaatgaatggcctcagtaatcctgaaaccaaggtcggctgcatcttcttcctccctgcaccctccaggagcaatccatcagtaagtcctatcagcgtgacaccgtgaatgcctctcctcctcgcttccttccagttgcccctgcctggtcacaggcctcatcctccctctctggcccaattggatgccctctgcttgcttgcctcgtctctgactgtatcctgtgggtgacatgcatgcatacccggtaccacttaaaccccccatgggctccaggggccccacttgtggtgtaccaagccactctatccccttggccctgtgtcccttccttttcctctcttgctccagccttacttgtaattcctcagttcacacctccatcatgtctgtgagtctcaagatctcctagcccttctccagacctgttcaagacacccctagcccttctccagacctgttcaagacacccctagcccttctccagacctgttcaagtgcccctttcatcactccccatgtgcagttccatagttgtccatttcacattgacttccatgtatctggagggcaggagccagctctgacccaccttgccattcccagagtaccctctcagtgaatgtggatgggtccccctgccttgttaataagtcatgtgattgagcagattgtgtgacttgcccctcttgtcttggaaggtcatcctgcccagagcttgtgaaggtgcagtggcctgagccaggcttccaagaggacaaccgtgatgggctctgtgtgcgttgctgggaggacttttcaatgtgatggcagcctgggggaagacagtgtcaccacgacagtgtcacggaacatgcaggaaagatactgatctctgttcttggttaagttccaagaaccatctaagtttcgtgcccctcagctgtaaaagggaagtacatttcatttgtttattctgtaaaactctcggtgtgtgccatggccatgcactgatgatgagcacatgtgtgcggcccctgcccccgtggagcgcatgcatggtcctccagccagagaccgcgctgggagaaatcaggggttcactcctggtcggaggtgagcatctgcctctgcatgtaggaaggcatctcatgaaaccccaaaggcctggcagcccctgcacatggaaggagtcactctcctccatgtggggtgagccacgctggccttgtggcattcacatgttccctccacctgcttctccagcgtgaaggggacctcaatgtcctctgatgaccttcttgaagagagacatttccttccttcattggaggctttagacggagccagtgacagctcagctctggctgtttcccatctgtgaaatgggaagagggaggatggcacgagtcccttgccctcaccaaactggccgctagagagaggaaagatgtttccattctgatccccactcacctccaccccatccttccaggcttctgatcctcattgtaattttggagctatttggtgatattgtctttgtccttggatccgaggcttctcctaccaactcattgttttttcaacgtgacaaaataaaagccctgagctgggcgcggtggctcacgcctgtaatcccagcactttgggaggccgaggcaggtggatgacgaggtcaggagttcaagaccagcctgaccaacatggtgaaaccccgtctctactaaaaatacaaaaaattagctgggcatggtggcatgcacctgtaatcccagctactcaggaggctgaggcaggagaatcgcttgaacccgggagccggaggttgcagtgagtcgagatcatgccactgcactccagcctgggcaacaagagtgagactccatct

SEQ ID NO: 229876 - DNA, 321 bp, Homo sapiens
accaaatacagaactggccctttggtgactgtaattaaaatgtgggtccctggctgggcacagtggctcacgcctgtaatccccagcactttgggaggctgaggcgcacagatcacctgagatcaggagttcaagaccagcctggccaacatggcaaaaccctgtctctactaaaaacacaaaaaaattagctgggtgtggcaggatgcgcctgtagtcccagctactcaggaggctgagataggagaattgcttgaagccgggaggcagatcgcgccactgcactccagactgggagacagaacgagactccatctcaaa

SEQ ID NO: 229877 - DNA, 331 bp, Homo sapiens
tgtgtggtttgcaatttattttttaaattaccagataaaaatcttttactggctgggcacggtggctgacgcctgtaatcccagcactttgggaggctgaggtgggtggatcacctgaggtcaggagttcaagaccagcctggccaacatggtaaaaccctgtgtctactaaaaatacaaaaattagccgggtgtggtggcacatgcctgtaaccccagctacttgggaggctgaggcaggaaaattgcttgaatctgggagatggaggtagaagtgagccgagatcgtgtcactgcatttcagcctgggagacagagtgagactccgttt

SEQ ID NO: 229878 - DNA, 422 bp, Homo sapiens
gagttcagaatggagagactgggagctgggctgtcaggctctccattgcctttgccttcaaaggtggcatagtggaaaatgaaccacagtcccaggaagtgtgtccctgcagaaacaatagccagccctgccgggcgcactcagcttccactacccagctcagagcacaggctttataaatacttaggactgttagtgaaatacgccatagatgctgtattttttaaaagtcttaaagtttctttcatgagcactctccttaaactgatttctggtgttttcagagacttcctgtgcttagctacatgtgctgctcttctaaatgcacactacagctcagtttgtttggggagctatgttactctagtacatttccttcctcttctctctgggtttacagggctttttcctttccaaaaaac

SEQ ID NO: 229879 - DNA, 367 bp, Homo sapiens
cagctgttaagtggcagagttggggttcagatcctggctggcctgaccctagagccaggcctttatccctaaaaatgactgcctggctgggcatggtggctcatgcctgtaatcccagcgctttgggaggccgaggtgagcggatcacctgaggtcagttcgagaccagcctggctaacatggtgaaaccccgtctctactaacaatacaaaaaattagccgggtgtggtagcaggcgcctgtaatcccagctactcgggaggctgaggcaggagaattgcttgaacctgggaggcggagcttgcagtgtgcagcgatcccgccacagcactccagcctgggcaacagagcgagactccatctaaaa

SEQ ID NO: 229880 - DNA, 502 bp, Homo sapiens
agatagtgatgaagctggatagttaaaacagaaacttgaaaagcaagatgtggaactgggatataggatttcagagtttaaaagaaatgtgacatttcttagtggattgtccttcagttgtgtttactaagcaactgtcagctagtgagattactgtgtatggccaatccagataaataagaccgatcaagtcttaatgaaaaggaaagaaaaatttggaatggccatctctgtccagctcaattcctcactccttttttaagatggagagctgttaggtttgtctacacagtaggaaacacctgattaaataacagcatggagccaatcttgacaaagaaattggctgcatccaatagaatcccagggccggtcgtggtggctcatgcctgtaatcccaacactttgggcggccgaggtgggaggatcacttgagctttggtctcagggctttgagaccagcctggacagcatagtgagacctcgtctctaaaaaattaaa

SEQ ID NO: 229881 - DNA, 550 bp, Homo sapiens
tagttggagatttatttgaaaatggtaccacattaaatcccaggtacgaatccaagttttgagttctagaaggatcatggcatgcttatcctttttgttttcaccaaccctgagaggtagtctacattccaagattagaacataatgaagttagaagggctgcattctatgaggcagggagaattagacatggaattacagagcttttcattgcaatttccatgactgttatttatgtgaacttacacaaatctaaggatcactctgagccacagtttctttatcctattctgaaatctctttaaaggacttgagtccaagctctctcccacactgcaagaccccactgcaatggctcctatagctgctgccatggcctcctccaatcaagtcagccttactatcttaaaaaaagtaaataagggcagctaaacgccatggcaaatgtatacctatgtaacaaacctgcacgttctgcacatgtatcccagaacttaaagtaaaatttaaaaaaaagaaaaaataaataaataataacatctctttaaaa

SEQ ID NO: 229882 - DNA, 496 bp, Homo sapiens
gttcaccaatcctatagatgctttcatctggaatttatgttataggaattatgtattttttattaagatttttaatttcaggtaaaagtattccacctcatacatgtgattcagacatgcaagttaataacaataatactttagagaagaatatttaaaatagatctttcctggtccttttttaaagtataagaattacataattacagttggagatggctggtgataaagcttagaaattaagatggaagattctgaaatatgatatatctgtcctcagttaccaattttctgctctgaagcttgggaaattgcttaacttctttatcgggttttttattttttattttaattctgtaaatagacaattggcacagagtttgtgtcagacttaaactacataatgtatgtaaagcatgtagaataatcttatatagtttagttgcttttactattttctgtaatcccactgattaaaataattatattgtaatga

SEQ ID NO: 229883 - DNA, 544 bp, Homo sapiens
aatgaatggagggcggcggcgactgctgcagctgggccagctgcgcgggctgcaccccctcccagcctgcgagaggaggaagctagtagaagatttgtaccaacaaaaccaaggagtaaacaacttgagaataactgcatgagctcagggcttggactgtcagattccatttctaagcttccagaagagcgacacatagacactggggaagtcagagcctttgaactccaatgccatccccgtcacccacctccaccaccagcaccaccaccgaatggcactttggacaatttttccctctcatgtgacttttgtcatttcttacgtcagttggagccagcacctctcaaatccatcttctaaaacccagaaaattgtgtgtaacacatgatgactgaaagggagtaggctgaccagttaagagcctgccactggaatggaaggctgtgggaaggtgaggggacggtggacatcaaccgggaagagctgaaagatggcgttaccaggtatctaccctgctaccctgcatagaattcccaagacc

SEQ ID NO: 229884 - DNA, 618 bp, Homo sapiens
agaccacattctgggccacaaaacactttaacatacttgaagaatagaaaacatagaatgtctattctcagaccacaatgacatgaaactagaaatgaaaccagaaagatagctagaaaatcctaaagtacttggaagtgtgttacttgccaataacacgagtcaaagaagatatctcaagataaattttagaatattttgaattaagtgaaaatgaaaataaaacttaccaaaatttgtggaatgctgtgaatgcagtgcttagagggaaatttatagcattgactgcatgtattagaaaatgggaaagatctaaaatcataatgtaagctttcactctaggaaactagaaaaagaagagcaaattaaatacaaagtaagcagaagaaaagaaataaaaattcaagcagaaatcaatgaaatggaaaacaggaaatcaatagagaaaatcaacgaaaccagaagatggtttgaaaaaacaataaaatcagtaaacctttagccagactaagacaaagaagagagaggacacaaaatactaatatcaaatgaaagagggaacatcactacagagatgtcccacagacttttaaagggtaataaaaaaaaaaagatgaa

SEQ ID NO: 229885 - DNA, 466 bp, Homo sapiens
agcatatgctgaaattttcattccagatgtctacaaaagagaacagataatacgaagttcgttacctatttcaagttacctctgagattccttacgctgaagacaaatattctattaaaaaagagtccttaaataggccataagaacccgaatcctttcataaagagtgaaagagtatggttatttttgataacaattattatcaaaataaattatttttacttctaaattagtactgattacatctgaaggtttttgtttctctgataccaggatttaaaattatttcagaaagcatgattagttttagtgtctgtagatctttgctgtcagtgaattaaagtatttttgaaaaaggaatatgtattcctgaaaagtgatctatactttatagaaaattacctatttgtgtaaatataggaaaacagctctaacattaaaatatgtgcatcaattggaaaaagag

SEQ ID NO: 229886 - DNA, 1097 bp, Homo sapiens
cgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcactcattagaagaattcctcaattgctgcttcaacacccgccacgatggcgttcaacctggcagattaatttaacaactctctgatgggttgccctgaaatttgaaaaacagtgcctagggctgggcgcgatggctcacacctgtaatcccagcattttgggagaccgaggcgggcgaatcacctgaggtcgggagttggagaccagcctgaccaacatggagaaaccccatctctactaaaaatacaaaattagcggggcatggtggcgcatgcctgtaatcccagctactcgggaggctgaggcttgaacccgggaggcggaggttgcactgagccgagatcacgccattgcactgcagcctgggcaatgagcaaaactctgtct

SEQ ID NO: 229887 - DNA, 814 bp, Homo sapiens
gtcatattatgtccttatcatagtaaatcttgttatttactttgagtttggggcactgtgtcttctctttatatttgtttcaagggggacatacggaattcaagcggaaatgcagctttggagctgtgggctggtaattcccacccctgcatttgtgtcataggctgtgttcttgtccccaaccactgcttgcttatttatttatttttattttattttttgaggcagagtctcactgcgtcacccaggctggagtgtagtggtgtgatctcagctcactgcagcctcctcccaggttcaagcaattcttgtgcctcagcctccttagtagctgggattacaggtgtgcaccaccacacccagctaaattttttgtatttttagtagaggcggggtttcaccatgctggccaggctggtctcaaactcctggcctcaagtaacccacccgcctcggcctccaaaagtgctggaattacaggcgtgagctcccgtgcctggccaccaaccacctgtggattgagacactgctggtctgagacagaatccacagtaacagacgggtcatatttctccagtcctttcattgcccttcccaaagttgtacttgattgtccttgtttcaagaagagcaggttctatgcctttgactgaggaggggtagtggggtggggagcctgaagtactggtatcactggggacaactaaccagccttgtccttgtggcccccaggatagacgtgcataggaaggagaacgcaggtgcagctgaaaaagccatcagtgtgcactccacccctgagggctgctcctcc

SEQ ID NO: 229888 - DNA, 2431 bp, Homo sapiens
cgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcaagccatcatgaagctgaatggccaccagttggagaaccatgccctgaaggtctcctacatccccgatgagcagatagcacagggacctgagaatgggcgccgagggggctttggctctcggggtcagccccgccagggctcacctgtggcagcgggggccccagccaagcagcagcaagtggacatcccccttcggctcctggtgcccacccagtatgtgggtgccattattggcaaggagggggccaccatccgcaacatcacaaaacagacccagtccaagatagacgtgcataggaaggagaacgcaggtgcagctgaaaaagccatcagtgtgcactccacccctgagggctgctcctccgcttgtaagatgatcttggagattatgcataaagaggctaaggacaccaaaacggctgacgaggttcccctgaagatcctggcccataataactttgtagggcgtctcattggcaaggaaggacggaacctgaagaaggtagagcaagataccgagacaaaaatcaccatctcctcgttgcaagaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttca

SEQ ID NO: 229889 - DNA, 384 bp, Homo sapiens
aggcaggaagatccctgaactcaggagttccaggttgcagtgaactatgatcacgccactgtactctaacctgggcgatagaccttgtcttaaaaaaaaaaaaaaaatcccggagaattattgagtctaattatcccctcaactataattgaattatatccttccatcctttgaatgctcactgactgtgtgctttggtggttttcttttttagtttctaaaaaaaaataagagagaaaggatggctctacaaaaaaaaaaaaaagtcttgctgtatgcagcgccagtagtcccagttacccaagaggctaaggcaggagaatcgttgagagtccaggagttcaagtccagtctaggtaaaatagatcacgtctcttaaaaacc

SEQ ID NO: 229890 - DNA, 581 bp, Homo sapiens
acatatgttgatatatgccagcctatctcagaagcgtgtctcaaggccaccaccatgtagaacagggtgctggactccccaggaggtactttaaaagcgcgcattgaggactacaccctccgcaatccttggaactagggattgtccggctgtctccttgttcttgttttgctttgcaccatagagagcgcagtgtttcccagtgacaccctaattaaatagtggtcaccaaataaatgaatcaccagagtcaatcttacaaaaactattttagaattttcctatcaccctagctcaatttgaaattgaaagcagtatctcctcatcaaataattaagccgattgcttttgtacattggcaacatcattttctgtctaatttgatattctgtgggaagctgcaaagccaatttaactaataaaatgaggcatcttttatattagtgttggtgattaacagcaatatgtgcctattttatttttgtttaacttgccaaagctgcagtggttagaaactgagtcgaattctgggccctgccagaagcgtggaccagttatgacactgcaggaaagaattatgt

SEQ ID NO: 229891 - DNA, 557 bp, Homo sapiens
agtgaggcaggtgcccaccctggtccagtcatctgtagcctactgggaaggatcaaagagacatgcaaacagggttctcagtgccccgctcagagaagggggatcttcgttagcttccaaacacatctcctggaattcttagagtgccgatgtgggtgcaggcagttgggcctgagccccaaacttccatctggacagcagctggagaaaaaaggcctggaattgtgacttaaaggagagtcttttcctgggcagcagtgctcaggacaggctctgaagaacctgtcaaatgtcattcagaggcctgaggagagagagggagaagaaagcctgaattttctcaccttgctttggagtgaggagagagggaagaggaagccaggaacaggcagaagagtttttccccacgaaaatcttcatcctccaagatgtaactcttttcatcagtgaaaaaccaaaccatgtctacctcaccttccccctgtcactcattcttgacctgtattgattctgttctttgtgcttccctggtaataaacattttttttaagcaaaaa

SEQ ID NO: 229892 - DNA, 443 bp, Homo sapiens
tccctcgccccagtgcctgtaaatcaccattctactttctgtctctatgaatttgactactgtaggtacctcatataagtggaatcacatggtatttatccttttgtgtctggtatatttagataagcatgtttttgaggttcacccatgttgcaacatgtatcagaatttcattcctttgtaagactgaaaaatattccactgtatgtatataccatcttctatttattcattcattcatcaatgaacatttgagttgtttctaacttttgactattgtgtataatgtagctataaacatgggtgtacaatatctgcttaagtccctgcttttaattcttttctttgtgattgctgtggttcagcatttcccaaatgatgttttgaggaattgtgtttacaagggtgttaatcaaaatatataaagaaaggattccatggcc

SEQ ID NO: 229893 - DNA, 427 bp, Homo sapiens
tgcgtcacctgtaagttaatcagaatgttactttcaaaagttccctgcaggtgaggaagctaaaaggtattcttgtatttttttaaatgaaacttcataatagaggtgtaaacagagtccattctccccagccttagaatcagacagcttgagtttaaaacccacttatgagcttgagcatactactgaacatagagtcacttgtctatgcctcagagtccccatggtcgaatggaaaatacagtgcctacttcaaagtgttattgtgaggattaaatgagataatatatgcaaagcacagcgcctggaacatggaaagtgctccagaagttttattgttattaacattattattattgccaccatcatcattaaacttggtaatttttactctccccaatcctttagttactttttcaaacttcta

SEQ ID NO: 229894 - DNA, 551 bp, Homo sapiens
ctctgtatatgttggtgttcaaatttgctctccttataaggacaccagtacacaggattaggatctaccctcctgacgtcattttaaatgacctctgcaaagaccctgtgtccaaccttggtcacgttctaaggcgctgggagttagggctttaacatatgaattctgagggagtcacaattcagcccatagtaggaggaaaacagtaatcattataaactacaaaatgcaagtagtatctcagcctgttctttcctgggcttatccacagttctgcatttccgaatgtctttcagtccctaagaatattcagtaactacttactgactctctgtggtttgtaattttttaaagttccgagtctatgaaaagggtggtcatactggctactttttgaaggctttttatattatggcgagtttatcttatgtttaatcaaatagcattttgtttccacattgccaaaggcaatggttttcagctagacaatagaatcacctggtgttttctgaaaacatctattttttattggtctattcaaagaaaaaaaa

SEQ ID NO: 229895 - DNA, 396 bp, Homo sapiens
ctcaaggagaagcaggtttgcttccacttcactcccccttagcctctttgaactcactgcacttgccctgtgagatgaagttcttaagagatttctagagatagagaggttttaactgggtttagatttatctgagacagacacctgaacaaaaactaagttaaccaagtgttgccatctgaattcattctcacttaggaaagagcaaagcccccactgaatttgaaagaaaaggtcctgcatgggcccatggaatagctgctcccctgagctgacaggtggaagggactgacttcctcatgcttgtaacccccataggtcctccacagatgtacactggatgaaagtatgagaccaaatgacttagggtcttggcaaataaagatggcacactca

SEQ ID NO: 229896 - DNA, 579 bp, Homo sapiens
caggtgatattgtgccatatacttgagagaagataaaaaaattataacaacaactcctgtacctagagccagaacatttgcaggatggtgactctcatccctgaacctttccacaggtgttgttgtgacatacacctttgccaagctcctgagtgatttaataatcctgcctatttatagcccagagataacagtttgatatatacattggccaaaaaccttggtgatttgacttccctgtcttagcagtgtcctcagaagggatcgtaacaaatctctggacccatcatctagggtatttgacttttctctcctgcatgaaccctgcttccagtgaagagtgtagcatttctaagcactgcatttaaatgacatgaccctcttgcctgggccctttcaataggaggcattgttacatttctctgggcccatcatttaggttatatgactctcctctcctgtgtggacactctccagcaaggacattatgccaacgacctgggcctatgaccaaattttgtggcttttctgttatggcccttcctgcaaataaaatattggaacatttttggctcatgg

SEQ ID NO: 229897 - DNA, 638 bp, Homo sapiens
ccattctacagacgaggaaacaggccaaaactggttaagtaatttgcccaagagcacaccagtaaacagtgtagctgagatttgaacccacacagcctgactccagagcctgctcttaaccatcgcatgttatacaaaggtgagttcacctgtgttaaaaggcccaggcagggcagataaacaaggatgatgcttcagcaaatgctggtgagaacaaaaaactcagagtgacagcaagtgcaggtggaaggtcgcaggacaaggtcagatgctagagagcttggccctagatcccagagaacatcaacaggctgagtttcaaatggagctgagctagaggagtacaaaaatccccaaaactgctgccctccactcagggagcagagagccatttgccccattggcaaaacccacaatcacagtgagcaaagtgtgctcagctctcacaactttaacagaatttgtaaggcaaagagacagctatgaaggggagggctgggcacagtggtgcatgcctgtagtcccagctactcaggagactgaggcaagagtttggagttgtagcatgctatgatcatgcctgtgagtagctactgtactccagcctgggcaacatagcaagaccctggttctaaaat

SEQ ID NO: 229898 - DNA, 354 bp, Homo sapiens
tgttatttacacgcgtgcctggatgctctgacctcaggcccgcggactttccctctgagcacatgctgagatgcggtccgggggcgccagcctcagaatgcctcccgcagggctcggccccgaggcagcagatgccagaacgccctgcgatttctcaggtggaccagtcggcatctccaaggaacaaattctcagaagcctcctttagttccagaaatgggcttaaaaaaaaccttgcttacaaaggaaatgaaaactttgcaaacattagaacgtctccttattttgttcccaaatgataacacaagcatttcctctacagcataacttactgataattctttaacttttgac

SEQ ID NO: 229899 - DNA, 492 bp, Homo sapiens
aattagtcaggcgtggtggcatgtgcctgtagtcccagctactcaagaggctgaggtaggagaatttcttgagcctgggaggcagaggctgcagtgggctttaattgtgccactgcactccaacctgggcgacagggccagacctggtcttaaaaacaaacaacaaacaagaaaaccaaacaaatgttgtcatggcagcataatgatgttttggttaaggatggactgtgtatacaatgctggtcccataatattataatagagcggggaactttctaccacctgtcataactccacagacaacacattactcgtgtttgtggtgaacctggtattaaaaaccctacggtactgccagttctatcaaagtgtagcacatgtaattctgtgccatatataatacttgatagtgataagaaatgactgtgttgctcgtttatatatttactatattatacttttatccttagagcacactccttctacttatta

SEQ ID NO: 229900 - DNA, 376 bp, Homo sapiens
gaaagatgccatagatgtccaaaggtgatcatattatagttattgaaattggaaacaccaataatgctgagaactgaatatatatttggtttcaagacacccagtatgttatgaacccacagcacttacagggttactgcttcaaaattagtgttttgatatacatagaataagtcctaaagagatactacatgtagggtataaaccaaatggatgtaattcgttcatagctggcaaaaacacagagcccacattatttctatgttcttttatagaaagtggtgcagtagaatgtactggatctgtacttaaaattatgtaatgtcagaatggtctatttagaaagagaatcaataaataacatgttaaaaatgct

SEQ ID NO: 229901 - DNA, 397 bp, Homo sapiens
ttttgttcttcttcaaaacagttaaaatttgacctttaggaaaccttcattaactcctctcggtctgggttaggtgtctgttctttgtgcacccagattgctttctcctctggaaacacttatgtaactgtttctgtcttcctgtgtttatgtgtctatcatgtgtagcacatatgtttactaggtgattacatgaatttgtgaaagcaggaactacacacatccaccactgaagtctagtgtgttctaatgtgaaggagataaaaaggacagaaaaaagtggagatgatggaggatattataatttaaaattagtgggaaaaaaaacccacaaaaggaaagagagatttatctacataaaaattgaataacctaccaaagaaaagaaatgacaacc

SEQ ID NO: 229902 - DNA, 497 bp, Homo sapiens
ataagacattctgaaagtaaaggaatattccatatatcttcaagctcttggtttttaatttatccttttaagtactggacaagttatttcatgatgaatttaagttaaaaataaaaatcagaaaaccaactgttttttgcattatactaagaaaaaaaaagtcagtataatccaggagatattttaatggcactcaagaatattctccagaaagggctgggcacagtggctcacgcctgtaatcccagcactttgggaggctgaggtgggtggatcacgaggtcaggagatccagaccatcctggctaacatggtgaaaccccatctctattaaaaatacaaaaaaaattagccgggcgtggtggcgggcgcttgtagtcccagctactcgggaggctgaggcaggagaatggcatgaacccaggaggcggagcttgcagtgagccaacatcgtgccactgcactccatcctgggcgacagaacgagactccgtctc

SEQ ID NO: 229903 - DNA, 236 bp, Homo sapiens
tgcatgcagttggttgattacttctatagcacttctgaaaaatgggcaaattttttgctggcgtttggtctaagaactgcctctaccaaagggcaggtaatttaagcttcttacataagggcagggactacatctcactcatctttgcatcccagtgacacctaacacagtcactcgaagtacattagtcatacaaacgaacttcacactttttagttttatgtatttgttattac

SEQ ID NO: 229904 - DNA, 536 bp, Homo sapiens
aaccatttatatttctacataaaccactagaatctccatactagaacaaaataagtagaattataatacgaattaattttgtacttaaggaaaattaaaactaacatataaaataatttattgggtctatattgtgggctgagtatacagtgatttataagcataatcttctttaattcttacagtaactctatgaggaaggtaaggaaggcatggttatttcctgtgatacaagcataccttgccaaatgcacacatttagcaagtgggtggtgagttaagacttgagcctaattttgtcggaagcataagcctatgtccttgaccagcttgaatagaaatgtttgatgggagctaaaacactacgtttaagtgactatagtatcttattttcttcagctatttataatcaattactagaaatatacactcttaaggaacaaattatccctatattctatgaattctttgaaagagaaaacatttttctgatttatttaataagaagcacaataccaaaaaagtaaaaaaaaaaa

SEQ ID NO: 229905 - DNA, 138 bp, Homo sapiens
caagtccaagcttttacaggtaataaaatggcaaagctgggattccagctgctgccgacctgactccaagcccattctgtttacatacagcatagtttctagggaaattaggctgctcgggttaaattatgtgaagga

SEQ ID NO: 229906 - DNA, 403 bp, Homo sapiens
gcacctccctgaccagcgatttgcaatatttttatcacatacgtaaatttccacattgtaattgggtctaagatatattttcttttttccccgcattgatcttattgtctacttatgggctaatatactgtttttattagagactatatttcagtatctggtagggctagactgcatcattgctgttttcttaagtgtttttttaatgctgggttattttttcatgttaactatagaatatagccccataaaagtactttcaaaaaaaaaatcttctgcataccttttcagtttatgatgttgcattttccttttgaaaagcaaggtttattttttctcgtgctcaagtttcagctttgtgtctttcaaggaagcatcataaaggtttttcacttgttaagtt

SEQ ID NO: 229907 - DNA, 497 bp, Homo sapiens
ctgtgcccagcctatcttgaacccactccctcaaaacagctcttgccaaaggtaccagtgaccttcatgttgctgagtccgctaacctctcagcttttggcacagctgttgactcctttctgtttgaacataacttccaggacaccacattctccacttcactggtgcctccttttcagtttcttgggctggctcttccccatcctcaaacccttcatgttggggtgccctcaagtctcagtccttagtactcctctcttctccacactccattggtaatctcatgcagtctctcagctttagagaccatccagaagttgacaacttcttaattaaatggttcaaatttagtgcctgggttcaaattctggttccacaatttaaagctgtgcaactttgagcaaggcactttacctttctgtgcctcagtttcctcatggtagatactttagtatttgctgaaggaatgaataaaacaaaaataaaactaatcaaga

SEQ ID NO: 229908 - DNA, 2137 bp, Homo sapiens
  misc_feature (496)..(496): n is a, c, g, or t
gatgccatcagtcactgtgacaaatggtgtgtggggggagcttgctggctgaagcattgtcaccgtgggtaattatacacttaatattcatgtgttatcgttccacctggaatctttaaactcttcatccaggagacactaatcttcaccttattattacgtcctaatgtcactctagcagaagaatggggctgccaacagggggagagaacttcctccttctcctctaggttgtaataaacatggttatttgttatttgaactctggctgaagataagacgctatatgcccctgccagatatggcccaggtgtagagatgagtccaggttattgttaaaagagtgaaaatgcccctgtcacattccccatcgttttcttccatctataaagatgatggcaatggtgttggcaatggtggtgataatgatgattatcaagtgagcattattccatttttaggcatgatggaaggaaaagtcaaatgcagtgttctnaacacttcttataacgttcagaaaccaccagatagagagaatgctgtctgtccttaatgcaagcagcccttggaattgtttctagagctgtcatgagctgccgatgggaaggtgacatcagtgtcggtcacaaattctcccttcagcctgatctatgcctctagagagaattcccaggaaggcaagtttttgccctaactttgggaatccagtatgtatggactgaaccagggttccccataactacccctcttttatgtacaccacaatcaccctgtgattgacccatttgctgagcagagcgtaccaagagggagcctagatcttaaacagagctttgattgattggggctgaaagggggcagattctgtatgagaccagcaggcattacaaacttctcaatttgaaacaaaaatgctttaatgctacttattgttgttgtcttattgtgaaagttagtcattcttatatatggttggctttctttcaaggtcaattgcacagtctgttctttgggggcaccgcatagccctatagcatgcttaaaatgcataaagcttagaggaagactagttctctggagagaattctgtgtttgtccaagaactggatccctgcctcctcccacacagtcactccacagccagttgcatacttgcagagagatttatggggctgaacatacagctgcaagttttcttttcttctactttttttttcttccaggaacagtgtcctgctgtcaggtctgtgtgcactagacacaaacacataacttatttactacagcagtatccaaaactcctaagtagtgtccttgctgaatgtgagtgttttcatgaatatgaaacattctgaagatgtaaggaattcctagatacaagccaatcttgactcagtttacatctctgtctaatattttggtgaaggaccatccaggagtctagttacactgtacagctgtttcagttctaaagcaacttggttaccttatggtcaagatcagaaattccttaacggaatttgactgctctgtttcctttaaaagtatgctgattgtttatagtagcttctggattctctgtccttgggaggttctcttagattgaagcaaattctctctcataccttgtgttggtttttgtttttattttaatttttcctttgtgatctgaatgaataacatcatcacttaacacctattgccatttcaaagacagaatcccaacaggcttttctgggtatggacccatgcaatggtttgtctgcctttcaacaatttgtatcatcttggccattttggggaacagggattgtgcatggggaaggatggaagaggaaaaccaatatttatttaacattcagtggtagtaaacactgggattagtacttaattagagttgatcctcataataaacttgatccccattttacagatgagtaaattataactcagagaatttctaacttgcccaaagtcatacaactaataaattgtaaaggtgggagttaaagcaattttttattgaactatatagaaaatgtacaaattatttatacacatctccagttattacaaagtgaactgctaggaatgtgagtggaattggtaatgtcagttaaaggcagaaggacgcgct

SEQ ID NO: 229909 - DNA, 174 bp, Homo sapiens
caatagttttaaaaatagaacggtctgcatttagtgaccgtggaatctcagtcatattaaaacagaatataacctttaggtatccgcatgtttcaaggctaaaatataacgtggtgtcatgggtgtttctggttctctgccacggggtaactttcccaacttgagataactatg

SEQ ID NO: 229910 - DNA, 157 bp, Homo sapiens
tgccttattatactagctatgacctctggtacaatgtcttaagtagctttattcatggtcgcaaagggaacactttcaacatttcactggtaagattgatatttggaagccgaggatagcctgtagtctcagctacttgcagccacttgggagggtg

SEQ ID NO: 229911 - DNA, 321 bp, Homo sapiens
atggttgtgcatcaatgtagaatgtacttaatatcacagaactgtactctttaaaatggttaaccattggtaaccattgttacatttttaaaccatgataaatttttgttttatatatatgtgtttttttgttgttttttgttttttttttcttgctctgtcgcccaggctggagtgcagtggcgccatctgggctcactgcaacctctgcttcctgggttcaagcaattctcctgcctcagcctcctgagtagctgggactacaggtgtgtgccaccatgcctagctaattttttgtagtttttagtagagacggggttt

SEQ ID NO: 229912 - DNA, 488 bp, Homo sapiens
ctggggtaggggtgtgtcctgtcagccgtgggggctgctcttcctggtggtggaggccaggtcccagtccttccccacacttgtagaaacatgcattctctggtagggcctgcaaacctgccctaccaaacctgaaagagggtcggctcatctcggaacccgctgcgtgccaagccaggcacgaggaggtggcaggcatcccgacccccgtggggcctgtgttctagagtgcagagacagaactggctgggaggtgcggggcattggattgtaccagtgctggggaggagagcaaagcaggggaaggtctcggcagcgccgaggtgtggccgagagggttgtgctctgcaccatgctgggatgcagaatggaggcctgtgccgcccagatggactcagcctgcacagccgtgacccctgactgcatctgggtagcttcgatccacgcacatgtggcgggcacagtgaggctgccacctggtcagacct

SEQ ID NO: 229913 - DNA, 302 bp, Homo sapiens
agaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggta

SEQ ID NO: 229914 - DNA, 541 bp, Homo sapiens
tgatggtgtgagcttgagcgagatgaatcccgctgccctcagcttgcctttgggattgatttaatctctgaccgaaaccacggtgccacagaggcagcatggggctgtggggacagaagtcttatgctcaagtcccgcctgtgcactggccggagtccctaggcaaggtccttccccactccgaacctcagttttctcatctgcaacatggggaaaactgcgcctgtaaacttcgtggagttggtgagggactgatcgaaaagtgcgttcctaataggcgtgatcattattggttttataaatagtcctcatttagaaacctctccccaacctctgctgtgatatccttaattctttctttctttagaccctgtgttattccacagaaggtctgagtgccttacagaaaacaggctgagtaatattgagaaggtttaaaaagcaaaactaggtccgggagacagagattagaagacgctagcacagctgcacacagagaggcaggtcatgggtcctgcctgggggtcaaagcaaagaaaaa

SEQ ID NO: 229915 - DNA, 348 bp, Homo sapiens
gccttcacgtctcttcctggctcactgttaccacctccaattctggcatctctccagctgctgaagccccagaatgaacttctgctcatctgatccactgtataaatagtttctgggtttatgcaccggtactcaaccttattgcctgtccgtttaatagctcatagtctcttaatccctgcagtctttggcatcctgtctgggcttgagtatttactatgtagtaggtgagtgaaaaaagcctgagatacttggaagtgactaattttgtagataaagaatcaaaacttgaacagatctgtaggctaaaaatagcagagactgaattaaaactttgatctccatata

SEQ ID NO: 229916 - DNA, 510 bp, Homo sapiens
catcatattcaaccagtggctcaggcactgctaaagggagtagctccaccaggtttaatcctcacgacagcatcgagattgtaagtgctgtggttatctgcattctacagagtcattcaataaataccaaaaaaggactaagttctggacacttcctctaacacttaaatctttaacaaagaatataaagggccaagtgtggtggctcacacctgtaatcccaacaatttaggaggctgaggtgggaggatcgcttgagacctggagttcgagaccagcctgggcaacacagcaaaactcccatctctacaaaaaaaaataaaaaattatccagggccagccttggtgcctcacgcctgtaatcccagaactatgggaggctgaggtagaaggatcacttgagcccaggagtttgtttgagaccagcctgggtaacatagtgagatcccatctgtattaaaaaaattaaaaataaaaaaaaattagccaagtgtggtggcacccacctgt

SEQ ID NO: 229917 - DNA, 526 bp, Homo sapiens
actcacagtgtggccagatgatggttaccttaaaaattaaaaggttagcttttgcaagacaaaaaaagtgagcgactaaatggaatatggatgaacttttgcatgcagagctgaagtgatcagcaatgcccagtgtggctggagggagctggctctgagtgtccctacctggcaggcagcatgagggagctgtctcctgccatatggtttaaactcagtcaaagaactaagagttgagtacagcttatcagaatggcttgcgggattcgagcccctgtcgtgtgaccgccagggccacccgggcatctctattcttgctgtaactgtcctgaatcttctcagcaccagagcctgctggatctctacttcagaaatgaatttcaaattcaattaaataaagagtttgctattgaatctgaaatggaataagagatttgattttccaagagatactttttacccagttaagatattaagtcagtcttttataacactgtccaagatatatcttatcagaaggcaaaga

SEQ ID NO: 229918 - DNA, 484 bp, Homo sapiens
caggaggcaaaaaaggattaatagtaggagaaaccagtaaaaataaaacctgattttcaaaagatctttaagtttccacatgtaagtttcatatggtagaacagtttttttttttgactacattaaagttcctcattttatttaaaccataaaaacattgtgtcaagaagatattaacatgcattaatgttatttaaacatgattaaaaatcatggaatctggaattttgaaaatatgggtcctgaaaacttttggccatgggcttgtttttaaagtaattgcttttttcacccatgcttcccaattagcagcagatccagcaatctggaatcctcctagccaagttcacaccgatcatctcaggcttgttctttgctcccacttttgttttcatcatttgctgcattctataactatattcagcttctggtcctttattttttaaaacaatatttaattgacaataaagattgtatatattca

SEQ ID NO: 229919 - DNA, 518 bp, Homo sapiens
gtttataagccactcagtttatatttttgctataccagccccaatggactaagacacccttaatgcaaagtacaattgtgtattttttattacttttattacttcattatccactccattaggccgtaagttggaaccacatctgttatgttcatcaataaccagtgcctagtactgtatcaagcatgtagttggcattcaatacatatatgatgaagtaatttaccaataaattaacagtactataacaagaaagaaatatgagggtcaataacagagaaaataaagctttaactattaaatatctaagtttttgaatttgacataaaaataaataggcagatgggtaatataggtttggatacacaagtaagagttaggaaaaacatttaaggcagggcacggtggctcacgcctgtaatctcagcactttgggaggccaacacaggtggatcacgaggtcaggagttcaagactagtctggctaagatggtaaaaccccatctctactaaaaata

SEQ ID NO: 229920 - DNA, 781 bp, Homo sapiens
ttttggatttttagtagagatggagtttcactgtgttagccaggatggtctcgatctcctaaccttgtgatctgaccgccaaaaaaaaaaagaaaaagccaatgcagcggttctatcaaacagggcgttctgagagacatttgtgaaaaagtgcctttaccgaccaccccttccccgagagaaagagagagagagagaagaaagtgcccagggagttaaacaacttgagggctgcaaagagcctttaaagtcccttggtaaaacctgttaactttcagatcaaaaaatcatgctcagggaggttaaggccaagctcacgatgatttaaaggccactctgctctccaggcacatccgcaactcctgccagttacgactttgctcccctggaaaaccctagcccagtggttcccacccctggctacacactaaaaaccccagggggagcttcaaaagctccctctgcccaagctgcacctgagatggaggcaccagtgttgtttaaggctgtccgctggcccgatgtgcagccagaacaccggcccaggcagatctcactgcaggtctcctgttaatccgccttccgctggccgccctagctgcgggctttccaggggtgtctcgcttactcactgggtgtagtgataagaaagctgtgtgaggctgtgcggaaggaacctcgcagaagcatctcctccttctccttgatgagaaagaggcgaaagtcctgtagtccttggctgcgccatctttcactccctcttgcccaacccctaaaagcc

SEQ ID NO: 229921 - DNA, 482 bp, Homo sapiens
ctgctgcagcatttgtaaagcaagagatgaaattcagtgtatgatcccagggaactaattaatggaagtcttctgggaatacatattagcgatgattacacctcaaagctgctgcctaaagactgaaacataaaataaaataagtaggaaacagactactttggcccagcacatctcataaacccataaccttgccttgataatgttttttcaataatataataactattattaaaagtaagcaaataaagccgacagtgactaaaactgccaaatttcattatagatccaaaaagttgcagaattacaccttggcatcacagaaaactataaatattcaccaaggataaacaaataactactgcctaccataatgctttggactaccagagtgtagtccattatttgagtcaaataatgaatcaaatcactgatgcaacaaaaaaattagaaattgttagctgtataaaaaattgaccaaa

SEQ ID NO: 229922 - DNA, 557 bp, Homo sapiens
aagcctccagattcctttgtgatattctgcaaagtgagttctcaactctttatacaagaaaaagacacactcaagagtctcaccctgtgccactcaatagaacgtgacatgtattataaaatatataataagatctggaaacaaaggtcttatatttattctttttttcttttgagagatgagatgttgctatgttgcctaagatgcttggaactcctgggcttaagcaaccctctcacctcagccttccaagtagctgggactacaggcatgagccattgctcccagctaatatttgctttataattgcagtaaaactctgttgagaatcattttttgctaaaaagttatatttcaaaagaagtttatgcatctgaaattattaatatgtcttgaatataagaacgttttctggaactctcagactcaaaattttaacctatagtggccaagtacttaagattggaagaacttgacacttacctgtcttgtggtgtctgctattggcacagtgagtattttgatgatcatatgggctaatcctgttaaccagcatg

SEQ ID NO: 229923 - DNA, 1273 bp, Homo sapiens
gaaaacctcttccttctttcccactgtgtgctttacgaagtgaaagtgaagattcgcagagacacggtctgatacacctctatagtatgactatcatcatttaaatttttttttttttttaatgggagtaggagacagaaatgtgtggctattccagatgattaaacttcttggttcttgaatgttctgagtcatagttaactcaggtggccagccctttgcactgacagagacctgcatttaactccccataaaatatggattttattgcagcagtgacacttcttagcaccacgctgacctctccagcatctcccatctcgagatctacggtaactcatgacagaatatctaactacggaagaagtaatctcagctctgcaactgctgcagtccacaacattgcagcgtccctttttattaaattctgggattaacgcattgggggctccaattttccagcatctggcaccgaaaaccaagcgcactccaaccactctccaatcagtccggggaaggctttatcccccagatttgagcctggccagccgtggaggagcacgagcgaactgcgccttccatatgacttttccctggacagtgtgctccattttcggagtccaatgttggactttccttgcaacctaagcatttctgtcctagatgagccggcaggcgttgcccggaacgtgcaagctaacagttttctttagctccttctaccagccaaatcgtctctttagtttaagttttccttactgggagcattccagagttttcagactacctgattttctgctttaccccaaaagctaagaaatgtaactcagcccaagcagtcaccacgcagacccttatgatgcgggcaggtggagataaatcaagccccaaacggctcggcgggacctgcacgcaccagcgccctttggtaattgaccagccaactttgcaaatgccagagctcccctggcagcctctgccggcgtagagaaaggcagcgggttcttctgcggcggcccgcttcccggtgcccccacccagccccacggcggatcggtcttaccaggaggcggaggagcggtgcccaggctccccgggaagcggcgtcggtcctgagcagcggcagcagcgccgcccgcgcagccggacccgcgcgcccgccccgacccgggctcgcaggctgagagcatccctcccaactccggcgcgcggcacccaccgggcggagagggctctctctctgattggcttctatcaacgctacagaattaaa

SEQ ID NO: 229924 - DNA, 690 bp, Homo sapiens
acataagttaaagagagcctcaggggaaccccgagccctctcccaccactctcccaactccagaatgagatccgcggcggcccggcgagggggttctggggaggcgcaccccaggctggctaccctgagcccaggcccaaggctgcccctctaggccccagcacccagcccccttcctctctccgctccccgcccctccttcctcgcatcagacaaaggtggatgaagttcttttcaagtttcaaaggcagttgctgggcagctttgcagaaacaataactcttttattgggaacaaatgttgacatttgacgggcgcgggaggcagcgcccgcgccggccgccgggcaagcgccccggtgctctcggcagcccccggcccccggggcccacctgagattaaagcgcgaattccgataaatcagctctaaggaaaccctgggccgcggagagcagaagggctgtcgcggatccaccacgcgggcgccgggccgcggagccgggagcgcgcccaggcctgcacccgcagcaaagccaaggccaccgccccaaagcccatctgctcctggtcgccccgttttgccgacgtctccccggcctcagtcaacaacagcaaacttctatcttggagggctaggtaatttttgactatgaaaattttaaagcaaaaataaaattcagaccccattaa

SEQ ID NO: 229925 - DNA, 3577 bp, Homo sapiens
taaaggtacaaaaattagccgggcgtggtggcgggcacctgtaatcccagctactgaagagcctgaggcaggagaatttcttgaacccgggaggcagagcttgcggcggtgagccgagattgcacgccattgccctccagcctgggcaacaagagcgaaagccagtctcaaaaaacaaagaaagaaagaaaagcacctggggtgcgtctggagccgcgttctgggagccgcgcttcactcgctggtggtacagctccaaggctggagcttacttggcatttttgttgccacagaagcagatgggaaaattctaggtctgtaccttgtgtgaaaaaaggctaagtaaaattttgcatttacgtgacttctgtgtggagagcagcgtcggcttttgtttgtctttggttctgtttggagcacaactagggtagagaggggtttggaaggttaggacagcgccctcggacgccagtgagacccagaggcgccaccaggccctgaacctcatgaacctgcgcggccctaggcatgcggtgaaaacgggacgttgccctcgtcctagcaccagagcaggcaggggcaccgctgctggagagcgccaggtggctcctgcggaggacggtggcccagatcctaccctgacgaagaaaggttcacgtcgtgaacagatgcctggcatgagggaaccttccgtgtgttccacctgtcagcagtaaaaagccaacaaatacacggaaatgcagaggcgcctgtagctacatgcctcgctgtgctgctctaaccttggcctccagacgcgcgtaagaaggtgactgagtcagctgcatgatcgcactgcgctgtggatgccgttctgaagccttttacttctgtccttcccaccttccctacgtgggggagatgggaaggggtggaaggagacagggctggggctggccctaaacctttgagttttccattctcccaccatctttatattaagattccctctctcctcattgtcctgtttcctgaagacttttctcccaaaacttcaatcatgttcatcagtttgtctagaaacaaatgtaagggaagagttttagcaaacacgaaattctgcccatggaatcaattccatttcatgaagttgtgttgccaaagcaaacaacctcttcctgtgagccgcccggacagtgtgaattacagctctgcagcccagccagccctttcccctctcctttccttcctgcggcttcttggggcttcagcttctgtcacaggccttccttttggaatggctgtcacacatgcacacaggtggcagagtggaaagaccccagggctgacccctgatgctcttcgtacagctgcagagctagcaaactgggtgcaactggctctaaagagaatctatgcggagcagacggccccctggccacctcaagtccctgctggggctggcatttcccacatcattcatccgaatggaacagtggaaagggattgtgccccccatggcttccagggtcaacctccctcacggtctgcggttgccgtgggggtcagtttccacacataggggacctggaggtaccgtcattgcagggggacagcgcgggccacacgtcaccagggagaggccccggggacatcaccagggacacacccgggaggcttctgagtgcacagctcggatttacagtggctttctaggaaaacctcgggaagaaaactctaaggcaacacagggcaaccagcccgggtgggaggtcccgcagagttgatcttgccggatctgccggaccacgcacgtgtggtgtggcctcctttgtataggtagctcccaacaaaaccccgtagaagactgaagtgccgctgatcttaggctcttccgtgaacaagcatgtcctgaagttgggttcgacagtgaggaatgtgctggacgtttcaaggtgtctgcagcagtgccgggtgaccttgctggggatactgatgcaggcggccctccctccaccgctgcaccctgatctgtatgaaactcacatcctgtctccccagcactcagcacccttgtggctcccatcgccttagggtctcccctgctacctgcggccgcccctctgccaccctggggcccagtggccctttccacccctctcagtcactgggtccacctactctgggcttctcctcgtgccactgtccccggcttgactggccctggggaggaggggcccctcctgctgctgatccttcgggcctcggcttagagttgcacctgcccacccccgccagccgtggtcattgtgtctttacccatgggtggctctggccgctctcccccgccacagggcaggctccccggggccagaacttgccccaccattgaccacagcttcccagaagtctctccgcaattactttttgagttaatcgtttgaggagaccaaagtagacgtgaaacagaacagaatgcagtgtggagctgcgggaaaggcgaggaggaacagcagccttggcagttgagtgaccaggacccctcaaagggacagagccctttggccagatcacgtagatgccgctaccctggtgccctcgaatgctcacggaggggcagcacgattcccaaggacccactggcatcggctacgtggccctgtactcaacaggcctgttcagcctccactggcacgccggggaccacgctagggtcagcgtcagccacagagacggctagggcgctcttgactttccttggggaactggcattcctcttagagagatggggaagtcattaatctctgtgtccccagagggtggcatttggcagggccttgccctatgtggagggtcaagcttgcagggaaggctctccagactctaaattaaaagtgggaaggctaaaccatggagcaaagcacagagcgggtaggcagaactgagcccggcctcctgccctgaggcagcctgccgggtgccctagcagtgtggagccaccccagccctgagacgctgggtccctcgaggcccacctggaaagcccctctgcctgcctggcactggccagcatcacacgctgcttcctgaactgttgttttattgttatttattttcttaagtgctttttgtaacaaaggagttttacttattttcttaagatcagtgtcatagcttttgaaaatgcgtcgtttagagcattagaatgggtcgaccattctaatccagacatgacctccctgtgcatggttggctgtgttgcttgccataaacacgagctcaggcctcagagcatctgtctgcttccaagaacactgtttctaaatatagaagacgaaggggctggggcggtggctcaagcctgtaatcccagcactttggaaggccaaggtggacagattgcttgagcccgggagtttgagaccagcctgggcaacatagtgaaaccctgcctctacaaaaaagtacaaataattagctgggcgtggtggtgcacacctgtagcctcagctattcaggaggctgagcccaggaggtcgagtctgcagtaagccgtgattgcaccattgcactcagcctgggcgacaaaaaagagaag

SEQ ID NO: 229926 - DNA, 559 bp, Homo sapiens
tacgataccatgttatatttttcaattaaggaaccaatattggtataattaactaaactccacgctttattcagatttcactagtttttacccatatttggtcatcatgtgtccttagacccctcttagccgtgacaatttctcagactttccatgcttttgatgaccctgatagttttgaggagtactggtcaagtattttgttgaatgtacctcacattgggtttgtctaatgtttttctcatgattcagctggggttgtggactttaaggaagtgaattgctcttttcattacatcacatcgagggtacgttcttatcacctggctgaggtagtgtccatcatatgggcacaatttaagcaatccatcaaacattcaggttgtgcctgttttttatcactgtgaataacaatcagagatagagaaatatatatcttgtcagaatttccaattattgatcgaaggtggtaggtccttaaaatgaaagtacaaagcatgaactcttaacagtaagcaccagcctgggcaacatggtgagactccgtctctacaaaaaa

SEQ ID NO: 229927 - DNA, 733 bp, Homo sapiens
ataagttggaaccattcctgctagactagacttactgatttttgtttcactctaatgacagaaaatcaatgtgttttggctgtgtttttctaatcttgaatctatttttgttgtacctgctgtgcccaatttaccattcattcattcaaaaagtgtttactgagtgcctaatatgtgcccagcgctttgcttggtaataggaatacaataggagacaaaagagagatggttgctgtattaatggaacttccagtctagtaagggagaaagacaagaaattagttacagttcaaggagcaggattgtctgaaaatagccttgaattctcactctaggtttcctggactgtgagaacgggggagttctcttctatgtcatgggaggggctgtgctcaaatcttatgagactggtggctttgtcttcccagcagaggtgatttcaactttgcaggaaagctggcattcttaaacaactccagtaagcagcctgctgggctgtcaaagtcagactgcctggcaccaagtgtattcctccaatgttaaggctgtataaacagggagaatagcagagaggccattgtctctctaactagaagcaaatccccatagtattggttcttgtaggaggagaatgagatacccatatcttttgttctctcactaaccgtggcattttacttgtaagttttctctttccccaataaagtatatctttaacccatgctatgtaatg

SEQ ID NO: 229928 - DNA, 460 bp, Homo sapiens
aacctgcgaacgtgaccttatttggaaacggggtctttgcagatgtaattaaagattttgagatgaagtggtcatcctgattatccaagtgagcctgaaatccaatgacacatgtcctgataaaggacacacagaggaaaagacagaaacatggatgaaaaggcaaagtgaagacagagcaaagccgtccaagccaaggaatgctgatggcactagaagctggaagaggcaagaaaggagcctctcctagggccttcagagggagcgtggccctgctgacactgccgacacctggatttcgacttctggcctccagaactgaaggaccatgtaagaacatagcaagaaggcagccatctgcagaccaggaagagagaccccaccacaacccaaccataccagcaccctgatcttgggtttccataactatgaaaaaataaacttctgttgtttaagctat

SEQ ID NO: 229929 - DNA, 296 bp, Homo sapiens
aatccccagtgtgactgtatttggacatggggcttttaggaggtaattaaggttaaataaggtcataagggtggggtcctaatcaattgaattggtgaccttgtaagagagggatgagagagatattgtgctctctctccctgtgcatacatccaggaaggaccatgtaagaacatagcaagaaggcagccatctgcagaccaggaagagagaccccaccacaacccaaccataccagcaccctgatcttgggtttccataactatgaaaaaataaacttctgttgtttaagctat

SEQ ID NO: 229930 - DNA, 449 bp, Homo sapiens
gtctctctcctttcagggttcaacctccaaccttatttctgcttccttcatgttggaattcacactgtgagtgctgctaccatattctgcgttggatgtgagttctcaagttctggtccatggggaatgggcaagtgaagatgagaattgcaaaaaactatactccgaccaatagaattgttgtcatcctttctctacgactccaagagaaactttatactggaggaagaatattctaccactttgggatgcttccaaagaaatgggataccaaaggagtgaacttcaggtcattggaagtggccaagctggagggcgacctatggagacatgaccttcagttcttcctgagatcgataaagcttaaaagaaaagaaaaagccaactcagcttgtgcgtggatcctggaccttgctctaatacagaccccgctcctggagtgtaagcca

SEQ ID NO: 229931 - DNA, 443 bp, Homo sapiens
aggagagaggaacctgcagcttgaggaagttcagagaaaacccagccctttcaccaagctgtgaagaagccaagcagttctcatggaaaaaccacatatatgtatttctgccaagaggcccagccaagatcccagcaacagccagcatcaactaccagacataaaccggccgggtggaggatgcagccgggcgtggtggctacaaggaagtgccctggtgttaagaactcagcctctgaaacccgccgcccagcttcgagtcagcgacgtacttttgttgtcccggccttagtatccccgctgcaataagaggtactcagctcaaaccatctgggtgaggattaaaggagttcatatccataaaggactagaacaggtcctggcaccacgtaaacattcttatcatcaaatgtgaaaaaacaaagttctctaagatttcgaaa

SEQ ID NO: 229932 - DNA, 333 bp, Homo sapiens
aggttcttcctgcccactgaacgaagaaaatcaattctcagcattgggccagctgcagtggctcatgcctgtaatcccagcactttgggaggctgagacaggcagatcacttgaggtcacgagctcgaggccagcctggccaacatggtgaaaccctgtctctactaaataaacaaaaattagcccagtgtggtggtgtgcgcctgtaatcccagctacttgggaggctgaggcaggagaatcacttgaacccaggaggcaaagattgcagtgagccaagatcactccactgcactccagcctgcgcaacagagcaagactctgtctcaaaaa

SEQ ID NO: 229933 - DNA, 188 bp, Homo sapiens
aaactgcagccagaaataacaaagagtccctactcctcagcttcagaactgttcaaaaatcactttagggacaccatgatcactgaaagatatacaaagcatggggatgggagagtcaaaactgcttccttagattttacatcttcccagtcctctactgcattaagatcagtaacctcaaataccgt

SEQ ID NO: 229934 - DNA, 539 bp, Homo sapiens
tactcacccacaaaagggagcaggaaaatgtaaagaggtcacctaaccaggcgacagccccagcgtaccccagtgcctcataggaggggatgggagaggagtcaggtgaacactctgtccttagtgagctggaggaggttcaaggaaggaagctcatcccagtttatttttacaaagattagaaaaggatagcaagaccagagtgcagcatggattttcctagctgtcaagagtttcagttgggaggactccaccatggggccactatgattgagctgaagaggagacagagggtgtggtagatgccaagcctttgcctccagtctgacctcacctgacctggaggtgattgggggtaagtattaaattcttcaattataaataggataagactctaactctgcaatgaaaacacagcctgatgaggtgctccaggaatcttggaagaatctttcttttcttccaaaaatgtatggaagaaaaaatgtacataacatgtacattaaaatgtatgtaacataaaattcaccattttaata

SEQ ID NO: 229935 - DNA, 505 bp, Homo sapiens
caaaattggtagttgcggaataaatttgtagctcttgggaggttcggactccgcaactccagagagctactctcgcgtggggtttgggcagtctagcatctgctgcttcaaagagttctgcaagtccacgccctctaaaaagagatttctcattcccaatttagtatcctgctaattttcacccctccttgagccaaaggccctcaactactccaacgagaagagtacaaattcattggtcagtggtgtgtggatatggaggcttgccatgtactcttaccggaatctctttcttggagattccgtctagattttgaatttcttaaggacgaggactggtcatcttagtttttcgtgcagtgctttccatacggtggccgttaataattattaatctgaacagtcagcctccctttgcgccaatggacccaaatctgtaatcccctccctcgagctccagaccttttcctttcaacataataaaagtaattgtcgtatatttaaa

SEQ ID NO: 229936 - DNA, 378 bp, Homo sapiens
ctcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggacca

SEQ ID NO: 229937 - DNA, 446 bp, Homo sapiens
atggctctcctctctgctccatcttccactgggatatgtgtggtagactgcttgcaaaaatggcaccaactctccaacccccacttctgtggagtcaatttccccccttgaatatgggctagctgtgcaattagcttgacaaacagaatgtagcggaagtgacatgtgccttacctacattggtttctcagaattctacaaccatcaagagaaaaaaacccagctagcctgcaggaggatgagagaccatatgggtcagtcacccccatcagctcaggggacagccagccagctcccagaagcaaggctgcctagctggcctgtagctcccgacagatgcatgaagcaacctggccaatatcagaaccacccagctgggaccagcctaaattgctgacccccagggtcctgaacccaataaacggttgttattttaagccattaaa

SEQ ID NO: 229938 - DNA, 571 bp, Homo sapiens
aaaaaactgtcaactaagaatcgtttgtctgtccaaactgtccttcaaacatgagggataaattaaggcattcacagacgaacaaaagctgatggagtttgttaccactagacctgccttgtaagaaatgctcaaggtaatcctgcaggatgaaatgagaagacaacagacagtaacttgatgctatatgaagaaataaagatctcaatagagataaattcatgagcaatatacaagctagtttataacttcacattttgttttctacatattttaagagactaatgtgtctgaaaggattactagtttatttttggggtacacagcatataaggttttaattttttttatgttaaccgaaaggagtaaacagagctttaaaggagcagcatttttggatgttactgaagtaaaactggcataaattagaattagagtattataactttcgaatgttaaatgtaatccccatggtaaccacacacacacacacacacacacacacacacacacacacacacggctatagaatatacacaaaaggaaatgaaaaaggaacttaaacatttca

SEQ ID NO: 229939 - DNA, 472 bp, Homo sapiens
aatcttgccccctttttttactgctatgtccctagtgtctgaaactgcccagtattgaatctgtccattaaatatttgttgaataagtgtttgtggaggcacactaattgaccggtttgtctggaggacacttgaatgtgagctttttaggactgggatcattgtggccttgtttattgctatagtgccatatagttttggcaaaatgaatgaataaatgttgggatcagtggcgttgaggctagaaggcagaaattgataatgtggattcttttttttgttgagatggagtctcactctgtcgcccaggctggagtgcagtggcgtgatctcagctcactgcagcctttatctcccagctacttaggaggctgagacaggagaatggctcgaacccgggaggcagaggttgcagtgagccgagactgcgccatagcactccatcctgggtgacacagcgagtctctatatc

SEQ ID NO: 229940 - DNA, 493 bp, Homo sapiens
gcctcagctggggattcatctgaaggctgcttgctcacgtgtctggctgtgaatgctacctctcagctgggcccccacaagggtagttggcggcacactgcacccggcctctccgtgtggcttgggcttcctcacagcatggaggccaggtcccaagagcaagagccagagccagctgcaagctgtatcacctccttgcccttgtctcaaaggaaccaacctgccacttgtgctgtactctgttttcctgcctgcctgcctgtcttcctccctctctccttccttccctcataaatatttgataagttgcttgctatgtgcaggacagtcttccagtgctggagatacagaaatcaacagaagactaaaaaaaatggccaggcatggtggctcacacctgtaatcctagcactttaagaggccaaggccgtggggtcacttgtgcccaggagttcaagaccagcctgcgtaatatagtgagaccccatcttgg

SEQ ID NO: 229941 - DNA, 657 bp, Homo sapiens
ccaggatgctcgctccattttgtgtctcagccttccgtcgaaagttttcatttgttcgtttgctttttaagaaagagtttttgataattctgtcttagaaggatgagtagttgtctcattaagaagactcttggtggtagcatggtctgactagcttaaggtacagtctttcctctttgagtttcctgtggttttactaactctttgctttccctctgacataaaaactagaagccataaattacggataaattccactacgtaaaataagagatctttaaaactctgcatggcaaagccactataagacaagtaaaaaactaaactgggagaaaaatagttgcagcttatatctcagaggataatttccctaatgctggggttgggaactacagcccaaggcccatatctggcctgctgcctgtttttatgaatcaagttttattagaacacagccacactcatttgtttgcatattgtttgtggctgctttcaccctatggtggcagaattgaatagctgcaacagggaccttatggtccacaaaaccaacagtatttattatctggcactttacaaggtttgccaactcttgctctgatgaataaggagttgctacaactacaaatcaatatgaaaagaccaacaaaccagtag

SEQ ID NO: 229942 - DNA, 613 bp, Homo sapiens
ccaggatgctcgctccattttgtgtctcagccttccgtcgaaagttttcatttgttcgtttgctttttaagaaagagtttttgataattctgtcttagaaggatgagtagttgtctcattaagaagactcttggtggtagcatggtctgactagcttaaggtacagtctttcctctttgagtttcctgtggttttactaactctttgctttccctctgacataaaaactagaagccataaattacggataaattccactacgtaaaataagagatctttaaaactctgcatggcaaagccactataagacaagtaaaaaactaaactgggagaaaaatagttgcagcttatatctcagaggataatttccctaatgctggggttgggaactacagcccaaggcccatatctggcctgctgcctgtttttatgaatcaagttttattagaacacagccacactcatttgtttgcatattgtttgtggctgctttcaccctatggtggcagaattgaatagctgcaacagggaccttatggtccacaaaaccaacagtatttattatctggcactttactatgagaaggacaacagcccagttgattaggcaggg

SEQ ID NO: 229943 - DNA, 378 bp, Homo sapiens
ccaggatgctcgctccattttgtgtctcagccttccgtcgaaagttttcatttgttcgtttgctttttaagaaagagtttttgataattctgtcttagaaggatgagtagttgtctcattaagaagactcttggtggtagcatggtctgactagcttaaggtacagtctttcctctttgagtttcctgtggttttactaactctttgctttccctctgacataaaaactagaagccataaattacggataaattccactacgtaaaataagagatctttaaaactctgcatggcaaagccactataagacaagtaaaaaactaaactgggagaaaaatagttgcagcttatatctcaggtggcctgctgccttgtttt

SEQ ID NO: 229944 - DNA, 361 bp, Homo sapiens
  misc_feature (329)..(329): n is a, c, g, or t
  misc_feature (361)..(361): n is a, c, g, or t
ccaggatgctcgctccattttgtgtctcagccttccgtcgaaagttttcatttgttcgtttgctttttaagaaagagtttttgataattctgtcttagaaggatgagtagttgtctcattaagaagactcttggtggtagcatggtctgactagcttaaggtacagtctttcctctttgagtttcctgtggttttactaactctttgctttccctctgacataaaaactagaagccataaattacggataaattccactacgtaaaataagagatctttaaaactctgcatggcaaagccactataagacaagtaactctggcagatgngaactacaagccggcccatttctgcctgctgn

SEQ ID NO: 229945 - DNA, 378 bp, Homo sapiens
tccccccttatccacagaggatctattccagaacccacagtggatgcgtgaagccccaaggatagtgccaggcccagttgccatcagttggaagatgtttctgttcatgtcttctacccacaaattttatgccttttccatcttaactaagcttttgtcatgcactgtggccctaacttttgcagtttaaggtgtggcagcaaaactagaattcgtttttccttcttcatgatttcacagatagaagattcattcctggctgggcgcggtggctcacatttgtaatcccagcacttcgggagaccaaggcgggcagatcacatgagcccaggagttctagaccagcctgggcaacatggtgaaactcttgtctctaca

SEQ ID NO: 229946 - DNA, 509 bp, Homo sapiens
ttcttctttcccctcctgtagcctcgtcatgtgggagggctcctctttgttctgaggagtggcacccctgctgatgaggaggtgatagacaggcgggaggccccaggtagggacaaagaatgactcacttgttaccttaagatctcaagatgtcccaagcacagacgggtttgtccctacagtgccaaccacagcatagaatcatacaattctgaggatggctgaagggggccctggcagtgactcatagctgtttgtgacacagacacttgtcgctttcctgacactttgcattgttttatgagtgtagctccacagttttgatcaacactgggagctgaggatgcatttgaaagcattcacagttaaacaaggtagctagggtgtccctattcactcttttcccagcatcctgatttttcatcaaagtcaccaacagcaggagggtttcagagttcattagatgtgatcattctataattaattggcatctcctcttttgcattgtt

SEQ ID NO: 229947 - DNA, 532 bp, Homo sapiens
cagggaagagagctcagcaagatatatcaaaatgttaaatgcagctacccttaaacctaatgattccactcctaaaaagtttacacaaacacacacacacacacacacacacacacaatactgattaaggaggttcattgtagcatttgtttatattaccataaaattagaaacaactaaaaaaagtctgttaatagaagcctagccaaataagttaaggggcagccataccatggaacactcttaatcacttaaaatgctgaggtggacctctatgttctgacatcagaagatatccacaatgtattttatcctgtttgtgtttttaaaaatatatgtttgcagctgggcgtggtggctcatgcctataatcccagcactttgggagaccaaggtgggtggatcacttgaggtcaggagttcgagatcagcctggccaatatggtgaaaccccatcgctactaaaaatacaaaaaattagccaggcgtggtggtgggtgcctgtaatctcagctactcaggaggctgaggc

SEQ ID NO: 229948 - DNA, 602 bp, Homo sapiens
gggtagagatttcttttagtaaaaaatcttctaaaggtcagaagaggtaggatactatggctcatgcctgtaatcccagtgctttgggaggtggaggtaggaggattgcttggggccagggatttgagaccagcttgggcaccatagcgagaccctgtctctaccaaaaagtaaataaacaaaattagctggcgaggtggtgtgcacctgtagtaccagctactcaagagcctgaggtgtatgtgagtccacttgagccaggaaggttggggctgcagtgagccatgatcgtaccattgcactgcagcctgggtggcagagggagatcctatcttgaaaaataaataaataaatagctacacttgctgagaagcatttattgtaaatcatgttaatccagttaatttgtggtaggcaagaagagatcaaattatggtggataagaataaacaaaagctgtaatgtatactacccagatatgtcctatatatagtcttcccttggtgaagttaggggattggacctacagcataccaaaatacattcatactcaagtgccacagtaggccctgtagagctcacatacaggaaaagtcagccct

SEQ ID NO: 229949 - DNA, 1316 bp, Homo sapiens
tgttcatcttatgtgaaatatgcttggaagaaggctttaaaactcgtgattatatatacgggtatgcgtacatatccatacacaccactgaaaaatcttaaaatagttttgttactcctctgcgtattataattactcagtaaatttagtttaggtacatttaagatctaaagtacaggacaattatttgtgtgagatttttactgtgacacattttaaatacatcggtctaacaaatagggtttttttgaaattagatatttttattaactctttaaaaaacgaatcattcatcttgggtttataactctttcatctgccatgttggataaattgcaaaattggataaattgatctcaacttatccaattatctttggataaattgatctcaacataattacctaattggtaggatgcctttgcaacgatactaacgttaataaaatgttgatgcttttaaaaaatacttatgttaaaaaagcattttctcgtatttctggcaagaaaagtcatggaacttttttccttctatctggaacaaggtcagccataaatagtttctaatacatagtgggcacacatttggtaactaagattaattatatctactgaatttactgaattccatgtccttcaagggcagtgactaggtgactttgtatcttcacacaccaatgttgcagtaaatgtttgagtcagattgaagtttcatcccggctaggtaggtgctaacttaatgacaccagtttccacatcttcagctttgatgtttcaacctgcagaaggatttgggcacggaagtggctgtgtcctaattgtcttcaaatatttgaaggtctgtcatgcagcaagggatttcatttattttgagtaattattgagtacagaaaaacagatttcacttctatatgaaggcaaaagttgtttatggtgagaactagcggtggaaagaaggggctgctccttccctaggggcttttgggatcagctggttccccacttggcgtgaatggctattaggaggtatcacagaggtataggagggtctttctgagagggactcctgggtattccgatggcaactatattcgaggacttctgtacttcccttttagcactgtggcttttgttttttgttttcttatgctggcttctagagttgtggacgtagcaacatccgcagacacctacatgaaccctaggaagattttttagtagattaaagacccacctgctatcgaagatgattcttagtcgtgctttgcatttgtatggcacattacagggaataaagcactctcgaattcaatgtgt

SEQ ID NO: 229950 - DNA, 771 bp, Homo sapiens
gcagatgtaattagttaagatgaggtcacactggagtagggtgggtccctaatgcaatatgattagtgtccaggtgaagacagaaacacgggaaaacaccacgtgaagacagagaattgtagtgatgcatccacaagccaaggaatgcccaagattggtggcagagccaaagctaggaagaggcaaggaaagattcctctctacagttttcagagggagcatggccctgctaacaccttgatttcagacttctggcctccagaactgtgagacagtaaatatcggttgttctaagctacccagtatgtggcactttgtttcagcagtcctaggcactaatacagaggttctgccatggtactgatccctcttctctgcatcccctgagtacacttggttcttggtcttgaagatggtccaactgagtagtggctacaccctgtccaagctgtggctctctaaactgactcaaaaactgcctctcttgcttctgcttactccctgtctgtgatgtgccctgggggcagacaagtttcattatcattatattggtttttcttcatttcttgactctgctctttactacactttgagattgagccagtttgcttcctgacatgctccaggttgagccttgcagacctgcccttctgcaccttgcctgggtctctgctgaagtgttcttattcatcctcctagaccagattggggccacacctctggtgtccagtttttcccagttcctttggccccaaaaatatctttgatagg

SEQ ID NO: 229951 - DNA, 483 bp, Homo sapiens
ggtgtgtatcaaaaactcagctgtattgatggaccacctgcctgaatgagagcctgatcacagactcgggatctttgtgagagtgtgttcagggtatacatatatgtttttttttcaaagataaacacataattatcacctaggtctggttaaaatcaagtggtctaattttctggatcatgtcatttttatcttctccccccctccatgttcactcattttagattacagattatgccaatatggtcctgaaatacttacaccccattgaacttgagcaatatagctgcctgtaatgtctataattaatacaaagaacacttaggtttatttaaaatttgggaagccctttcattttatatccatgaatctttgttaagttcaagaaagtattattttattctattttaaactattgtttctattgtaattagtctggtttctaccacagaataagtaataaatcttacgttggatttcaat

SEQ ID NO: 229952 - DNA, 438 bp, Homo sapiens
tctgtgaaggaaaagaattaagtgggtaatgaagaactttctaagggctcacgcatacatgagagcctagaagacagcatcactggcacgtgaatggcaggctgggcttagtcttctaccccctgaacagctccatcttaggccacatctctttgtgagaaaagccaaagagggtggctgaagtatgtttaatcaggtgcccatctcagaggttacaccaggtctctctcccctctcatatttcagtgatgctgggtttttttaataccagcctcatctttgccaaattaaaaccctccttgtatcttgtttgccctaattattttgaatttagtccatcataaataatatacatgtaataaggccaaggcaggcagatcacttgaggtcaggagttcgagaccagcttggccaacatggtaaaaccccatttctact

SEQ ID NO: 229953 - DNA, 421 bp, Homo sapiens
ggctggtctcgaactcctgacctcaggtgatttaccggccttggcctctcaaaagtgctgggactgtaggcatgagccaccaaacccagcccacattaaaggctgttaacataaaagagatggggtctttgctctattgctcaggctggagtgcagtggcattattatagctcactgtagcctggaactcctgggctcaagagatcctcgtgtcttggtctcccaaagtgctggattacaggcgtgagccagtgtgccgcgccacttttaaccttttaatgcttgagtttgttttgtgccacaaatatcacaatttgctcacatttgcttgagccactgagtacttttaaggttaagaagcttggggagtatcaggtgctgattacagaaaatgggcactactttctaatccttggaatta

SEQ ID NO: 229954 - DNA, 414 bp, Homo sapiens
ctagggtataattgacttactaggtttgttggaaatccttctgtgtgactcttcagtacaataatatctccaagaagtaatatttgttaggtagggatcttattttttaccctctaagagtaagaggctgggtgcagtggctcatgcctgtaatctcaccactttgggaagctaaggcaagaggatcactggagcccagaagttcaggaccagcctaagcaacacagggagaccctgtctctacaaaaataaatctaaaaattagctaggtgcttaaaaataagcacactcctgtggtccatgctacttgggaggctgaggtgggaggatcacttgagcccaggatgtcaaagctatagtgagctgtaatcacgccactgcattcaagcctgaagatcctgcctcaaaaaaaaa

SEQ ID NO: 229955 - DNA, 519 bp, Homo sapiens
cctcactgttttagaattttgattatttatgcaagagctatgctaaagtgcactttattctcttcatgaatttaggaagcctatttgtcattgatagtacaaataaaactgaaagaaactatttatctccttgggatactacaaatagtataattaccttttaaccagaagctatcattatttagaatctgcttttcatttaataattatagatcattcacagttgttcattgaaataagtcaagactttaccagacagagtcaggtgcagccacctaagtcctgatggcccgctttgcgtcccatctgctccagttcacagtgtgtcttgccagtctctcctataccattgtgtttgttttgttccttatccgctctagagcctcacacaatgcttgctactgagaaggcacactgtaaatgttgactagttgtggctgggaggccgagttgggtggatcccttgagcccaggagttcgagaccagcatacgtaacatgacaaaacctcatctctaca

SEQ ID NO: 229956 - DNA, 440 bp, Homo sapiens
ttggcctctgctgtgagatggcagagaagcaggaaacacgttggggaggagggcaccccccagagatagaattccagggccattgtctgtgcagccacagagcaaacactcggcctttgttcccgggaccctgcgggaggggggcctcgggatgcccattccgccagtgtggcccgcaaacccgccggacaggtttggttctcctggcctcccggccccccgccaccccgttcacccgaagcctgggacccagccttcatccccagtgtctcccccgcccgagccagcagggcggctgggcctccccgcacgtgcacgggttcgaatcccgccgacgcaccgggtgccaggaccgagggtcagccctctccgcgcgcagcgggagcgcccaccccaggggcggaggcgcggacgtcctgccggggtaacccgcggccgcc

SEQ ID NO: 229957 - DNA, 534 bp, Homo sapiens
aattaacttattttggctaagtatatatacaatgttatagaatcacagtaatgtttgaaaatgtaaatttagaaggcttttgtattaaatcaaaatgtatttttttaacttttatatctacagaatatgtaattttaaaattataaatagactttaagttaccaacttttaagacatggcagccattgaaaaactggcttcctgatgtttttctaaatattaaagtacttaaaatatttctatgcaataaatattgataaacagacattatttaatttgaaaacccattgttaaaaaagataaatatttttatatgaaattttcattttttaaaactttgtgttaacaattcagaagaataccaagagaacatatatattgagtaaacagtcaaaggaaagtactcttgaatgttttataggaaagctgtctcagtttccttccttttgttgctatatcatgtatgaattgaataaattgctctagaaatgtaaaaattttattaaaatattataatcttcgtgttatgctatt

SEQ ID NO: 229958 - DNA, 655 bp, Homo sapiens
ctctatagtatcttcactctggagttagtatgcacacaaatacctaacctttccaatgtaggccctagttacttccaaaataatttagaagtgtttacagatatgttttgacgattttgctatgatttttcatttattggtatcagaattgaatatatttagctgttgctctctgctaagtaaactgagacctaggtgtgcttaccattgttttctgtgaaaaccagctgatccgtgttacaaatgactgttttagctatggaaacaagacacctctgtgaatatgattccttgtgtggtgggcatcactagagagcaatgactgtattccctaaagagaaagtgcgagagcggcagtacagaccaaggcagaggtggctgaggagattgttccggtcagcaatgtagaattcctgcccctgtgttctgtgaccccaacagagggagccagcacccactgtgcacctcccacacagcccacactgcacaaggcatttagacagtgccttaaattcactccatcaatactgtgagagccccactggcttcccctttggggttttagacatttagggtattcactgaatactttacgttgaagtgtttttctataacattagaaccaggttcaacttaaaaaaaaaaaaaaagctct

SEQ ID NO: 229959 - DNA, 582 bp, Homo sapiens
cgcagtttgcctcctccgggaagccctctgagcccctcccttgctccttcagcctcgcctccctctggcccagccctgatccactgacctagggaatctggccctgtctccccaaggctggagacccctgggctggggcttagtgggaggggacacagaggtatgctcaggagcaaggggagggggtgatgctgacatgtctaattctcatgggaaaacggggcaaatagcgacacttctgacttccataaccatcacaccccagggcgatggactgtagccccaggagccgaatctcggttagagggtacccccagcttcctctccgccagataagggagtggggacgcccctctaaacccggatcctctgcaaagatgcccccgctttcgctggcatgcctggcgcaggtgcctgcagcgccgcgcagcagcccgcaggtcccccacctacgctccgcccccgcagacggggcggcagcctcgcagggtctgcgggttagagggcggctcaggtttcggcctgggaagagggtgtcccgggtgggggcccggcgcaccccctactctggcctgcggccgc

SEQ ID NO: 229960 - DNA, 666 bp, Homo sapiens
gggtgtacctttcccagtccactgactcaaatgttaatctcctttggcaacaccctcgaagacacacccaggatcaatactttgcatccttcaatccaatcaagttgacactcattattaaccatcacagtaagcattttttacaatatgtttagtatgtgctaggcaccatgctgagtacttcacatgcattgactcagtaatctacaaaaagtattgttagctagaacttacagttgaggaatttgaggcatagataatttgataatttaggaaagttttccaaagttacaaaggcagtaagtggcagaatcagtattccaactcctgcaacttcagtttatagtccttatgtttaacctctgcacgacactgtttcttttctagtcgatcaaatatgttcatttttaacatttttttactaattattacctctatgcagatatatgtacaaattccctctattcctgtctttcctcacccacctcccagacttacgcttctcagccaagctgcatctttctccacatcactcaagattcacttttcatttttttcaaagatggtggattagaggcttttagcatttttcagccacctggaaacagaaaaatagtgcatcaagatcaactctgtgagctttcattcaagaaaaaaaaaatagta

SEQ ID NO: 229961 - DNA, 612 bp, Homo sapiens
gggtgtacctttcccagtccactgactcaaatgttaatctcctttggcaacaccctcgaagacacacccaggatcaatactttgcatccttcaatccaatcaagttgacactcattattaaccatcacagtaagcattttttacaatatgtttagtatgtgctaggcaccatgctgagtacttcacatgcattgactcagtaatctacagataatttaggaaagttttccaaagttacaaaggcagtaagtggcagaatcagtattccaactcctgcaacttcagtttatagtccttatgtttaacctctgcacgacactgtttcttttctagtcgatcaaatatgttcatttttaacatttttttactaattattacctctatgcagatatatgtacaaattccctctattcctgtctttcctcacccacctcccagacttacgcttctcagccaagctgcatctttctccacatcactcaagattcacttttcatttttttcaaagatggtggattagaggcttttagcatttttcagccacctggaaacagaaaaatagtgcatcaagatcaactctgtgagctttcattcaagaaaaaaaaaatagta

SEQ ID NO: 229962 - DNA, 475 bp, Homo sapiens
ttggctctgttgacattttagaccaggtaattatttgttgtcagcagggggtaggatggtgacagggcttgggggaagacctgccttgtacattgtagaatgtttagcagagtaaggccagaagattctacccactggttgccaatagctgcccactagttgtaacaatcaataatgtctcttgacattgccaaatgtccactgaggagcaaaattgcctggagatgagaactgctagtatagaataactcactattaccactgaccaactgaatctgacatgtataaagcactctacctagcaactgcagaatacaaactcttttcaagtacatatggaatatccactaacacagactatattttgggtcatgaaacaagccttaacgaatttaaaggagttgaaattgtacaaaaaagtacaagctggttctttgaaaagattaatgaaacagatagccagactgacaattta

SEQ ID NO: 229963 - DNA, 535 bp, Homo sapiens
  misc_feature (522)..(522): n is a, c, g, or t
tcttcctgcactggggtaggatgggagcagagagtccaacatggatctgtaaattatgtggaagtcagaatggggttggagggcttgggcggcagggaagggagacctcaggcagcaggtaagcaaaaggcttgagtggctgggaagggaggcctccctcagaacggcttttgtacagggacctaaagtgggggcagccatggctgcctctgggattggtgttccagctggtggacctgtggacagaagctttgggcaagcagcaaggaggtccctgagggtggccagaagcttggggacaggtgcagggtgagaggtgacagggctgggggatctggccggaggactgctggcattttcttgggagccactggactgttttgtgccagggaatggcctgtgctggcccacgtgttcacaggggtcaagaggagagggcttggggcaggcaccgggttccccttaggaaaaggcagatccactagttctagaacggctaataataagcgggccgctctagangatccaagcttac

SEQ ID NO: 229964 - DNA, 467 bp, Homo sapiens
cacttccatcatccatatatgatagtaatactagtatctacctcataggattgttttgaaaattaaatgagataacacacatgaaacaacttagaaccatttctggcatatcataaaatttatcttcaccattatcattattcttcgtttggtatcacagtttgctatttttaatgtgaattatcagctggcacacatgattctttcttgacgttaaattgataatatctatttttcaagactaatatgttaatttttgaggagaaatataactcataaaatatgcttgaatccctcaagttacactgatcatataaatctttgaaaactttataatttttcttggtagccataacaaatttctcctccagacaacatgagccagctcatataaagctagtagatgacatttatgacacaggtccaagctgggcagacaacagctttccctgtcacataatgataaa

SEQ ID NO: 229965 - DNA, 402 bp, Homo sapiens
ttcgagttcattccattccattcgagtccattccattcgagtacattgcattccattccattgctttcgggtccattcaattcaactgcattccataggtgtccattccattgcattccattccattccatcccatcccatcccatcccttccattcccattcccattcccattccattatattccattccatttgagtccattctattccattccattccattctattcgagcacctttcattccattccattccattccattccattccattccattccattccattcgggttcattccattctgttataattctattccattcgagtccattcaatgccattccattccatatgagtccattcaactccattccattcgagtccattccattccattcg

SEQ ID NO: 229966 - DNA, 1085 bp, Homo sapiens
agaagaaaaatcacatcatcttatgtcagttaatacacaaagagcatttgaccatattcagtacccattcatgataactcagaaatctaggaatagaaaccttacttgataacaagcatttacaaaaagtctgcatggaatattatacttaacagtgaaagactgaatactttgccactgaggtcagaaacaagccaaggatgttcactcttaccactcattcaacacagtcatagccaatgcagtaaggcaaggcaaggaaaaaataaaactatctcattttccagatgacacagttgtccatgtataactcccaaagagcctccaaaaaaaagtcttctagaattaataagtgagttcagcaatgtcacaagatatacagacaatgcaaatcaattgtatttctatatactaacaaagaatatttggaaattgaaattaaaaacatatgtaccatttacagttgctcccctaaaaatgaaatatttaggaataaatctaacaagacagatataagatctatatgctcaaaagtataaaagttgggtgaaagatgatgatggagttaaatcaaagaagacttaattaaatggagtgacccactgtgtccatggattgaaacattcaacatagtaaaaatgttaactctctctgaatgtataagtttagtgcaattcctatcaaaatttcagcaggatttttttgtagatgagcttattctaaagtttgtatggaaagttgaaggaactagaatagctagaattttaaaaagaagaataagtggaagaaaacacaccacctgattttaaggcttactctgtagctatagtaatcaagacaatgtggtattggtggagagaaagaatcatagatcaatggaacagagtagagaacctagaaatagacccacactaatacaactgactgatttttgacaggtgcaaaagtagttcaatggaagacaaatagtcttttcagcaaatagtgggcatccataagcaaaaaatgagctgtcacttaaacctcataccttaaaaaaaattaattcaaaatagatcatagatttaaatgtaaaatgtgaaact

SEQ ID NO: 229967 - DNA, 448 bp, Homo sapiens
cagaaatgcttgggttcaggtcctaccaagccactgctgatggagtgacctgcttgttaacttctctgtgctcagtctcctgatcgttaaaatgggaatgacaatagtaactaacgatacaaaggtgattgtaagggatgaatgaattctatgcgagtcccttggaacagtgcctacgacacggtgtgtgccacaaaattgctagctgttattaagtcggctttgagaagtgaacatttagaaataatgtagaagatctcataacagctgggcctcagagtcccacatgaagatgaaacaaacttcataaacttggatggagcaagtataaactaccaaacataatacaaataaatgtaaattttcctttgaagttaacatatttattttattataactaaataataaaaatatatacttacaataaatattaaaaaattaaaaaaaa

SEQ ID NO: 229968 - DNA, 390 bp, Homo sapiens
gttaataagcaataacaattgcagtggacagtattattaatgcttgggatatgggaatttgatgtttctatcacaaaggttaaaaaatggtttatccttggccgggcatgatggctcaagcctgtaatccaagcactttgggatgtcaaggcaggcggatcacaaggtcaggagatcgagaccatcctggctaatacggtgaaaccccgtctctactaaaagtccaaaaacattgctgggtgtggtggcgggcgcctgtagtccccgctactagggaagctgaggcaggaaaaaggtgtgaacccaggaggtggagctttcagtgagctgagatcacaccagtgcactccagcctcggagacacagcaagactccatcaaaaaaataaaa

SEQ ID NO: 229969 - DNA, 354 bp, Homo sapiens
ataaaatacgaggaaagtagagaggtatataactgttgttggggtgaattagatagttaatgagaagaaagtcagaaaactactgaaggcaaccacggtgaaattggcttccagatcaggccctcaggccagataggtttggccttgatggaaagaccattagaaagtatccaaagctgccattatagccttaatcatatgacctatccatcctcagtttctaacttggtaaactgagtgttagattacataacttctgaaatctcttccatcttcaaagtctgaattttgccctgaatgctttttagctcacagggaactagatttcaaggacctaaccacagatatcttaaa

SEQ ID NO: 229970 - DNA, 920 bp, Homo sapiens
ggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaaaaaaaatgaagagtatgtcgtgtaaacattcttcgggggccaaacaacactgcagttgtatgctttaatttaaaacacacatgtgcacacacacatcctctgcggaaacactatatgaagttcgaatccctgaatatcaataaaaggaactgagaaatattttggtgcaagaacaatgaggaagttgatcctgtaacatgaaggaagtgtaactgtttcacgtagactaaatatttaaaaatgggtttcatgttttttatactgtttttaactaaagttataaaaatgtttccaacaagttctctctccttatgttttaagaatcccaactatctcagtaaattgaaataagggtattagcagttttctaattagtaacacaaatctgtctaaacaagaggacatcctagtacacaaaataatgtcactgtttcacaccagtctagaccaaaaaaaaataaaattgaaatgttcagagtcaaaaaggaacttctgaagataaattaattcatccctaaaaattaaagtgtgttcaaaatagaaaaactattgtcaaaatcatttcatagtttaattgcaacacgtcactaacagatggtgattcttctcttggaaagattcaagtaaaaactctgatacaaaagcaaggtaaaacgcacagggttcccttatgtagatgtacacatggcattgcatatagagattaaattattatacttgtcgttaagttctttattaatttttaaataaaaaaatcaaagatgaaaaaaaaag

SEQ ID NO: 229971 - DNA, 977 bp, Homo sapiens
ttggagttttgaacaaagaatggaacaaaatgcccagcaaagcagagaaagaatgaggcaacgaaagaatgaaagcagggatttattgaaaaccaaagtacactccacagtgtgggaacgggcctgagcaagtgactcaagggcccagatacagtcttctcagtccaaataccccttggaggtttccccttggccacttcatgctcacctcatggaaatgaagtagtggaccacaattggtctgattggttgcaggaagcaaccaatcagagactgaagtggagttacaaaggtcacgctcctgtgcaaacatctgattggttgcaaaaagcaaccaatcagaggctaaggtgaagttacaacgttgcaacgaagactcggctggcaatcagtctgattggttacagacagccaatttcccagcgttgaccaggttttggggggaacaaaattatctgaataaaatgaagacagcaaccgtcgtggatttggtgaaagttttctcccatctccctctcaaggccttaaacaggtatgagttgattatagccaatgtttacttttctcattctgattcattataaaactggggtaaatacgttcaggaattagaccacgtaacaattataattgtcgaagactttgaaactgcatagtagattgtgacattggagctttttgttgtgctcattagaaagcagggtctgaaactcagcctgtgtagcaagcacgggtggctcacaagcagaactgggaaatgacacttctgctccccagagccccctttcacatctggggttctcattgtttgcctttttacttaatgtattttgtaatggctgtgaaaattaagctacaaaatgagtgaacattgaagacaatgattgctattgaaacttaggatttctcatttcaaacttagcgtgtgtttatccttcgtattcattcaataaatatctgtggagcaactaccatgt

SEQ ID NO: 229972 - DNA, 1183 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (8)..(8): n is a, c, g, or t
  misc_feature (706)..(706): n is a, c, g, or t
  misc_feature (754)..(754): n is a, c, g, or t
ntnggnangaggaattatagcattcttaaattttagaactgtaaagtatttttaggtcctttttagctttattttttattatcccctcattttatgtctaagaaaaatcaaggtttaggtgaatgagatgtatgagtaaatgtggtaaatgtttagcaagcttagaatgttttaaaatttgcacaataggagctttcatattttctgacagttggtggtaatattgcaggagagacttttttttttaaccactagggaatgctgaaatatcaactgatcaactataatgggaaaaattttttttaaaattttaggtattctgattgctgcatcttttctgtttagcaaaataacaggacttacttagtagcctgtatgcattggggtgagagggtggatgtcgagaacactagtttagatttgtttcaagtcatatcatttcacattgattctaactcagaacattccttgtagataaacaaattttattctcctcctctagctttgcagttctcaaaagtgtactagaaaaaatctgcctcttttgttagttaagcaaagctgagcccatattcatggaagatgttggaccataacctgtattttagtaatttggtgaaaaaggaatgtagttacagtggctctgccctcaggaaattgtccaacctcagagcctcccaggttgtatggcagctgagtgagggtntgcgacttcttaggcaaacctcgtcctgagatttggttagggaattgnatttgtgagtcttttgttctttctctacctttactctgccatttagaaaattaaagttattaaatttccatttttattcctcgttccagagaatttttaaaaggaaattttacattaaattccccgtgtcattttttaaaaaactcatctttcttgtgttttaggttgttttagcttctaatcagagaatgaggtgcctttgcaactagatgtcccagtgacataagaaaatgatgtgtaatctctgtatagtcacaatattgagcttgttgattatctccttcagatccctaatatgtttcctttagcttacttgacctgtcagattatgaaagaattaaaattttccactgtgatcagattttatcatgttctctttgtatttctagaagtttaacttggtacttgactcttacattggttgtccaa

SEQ ID NO: 229973 - DNA, 846 bp, Homo sapiens
ttctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttagaattttctgc

SEQ ID NO: 229974 - DNA, 457 bp, Homo sapiens
gttgtctaatttcagtaggtacacagggtatgtatttaagaccagtttaatagcgtttctttttttgaggatgagttcgtattatttgtaacatagaattcaaagacacggtcatcaggacagaagtacccaagttaaaacttcatcagtggggccacattcttgatcaaatgctttacgaaaacattctatcatctttgaactttgtgtgttataaatctttcttgcctttaattatttattaggtactgatagaggcgttatgctggcatatatcagccatcctttaaaaatgacctcttaatcagggaaatatttgttttaaaatatttagctttaatgaatgtttaaagaagattttgttttgtaggtgcctggaacattaaggaagattcttatttatttcatttttctgggaatcatatgtacttgtcaataaacagttacggagaagtga

SEQ ID NO: 229975 - DNA, 498 bp, Homo sapiens
ggtctgcagtcccatgagtagcctagttggctactatgtcttgattctccctatggtcattcatcccctggaagggtcactcacattatggtcttggagttccaagtatagcaaaagaaggcaagccccagtgcacaagcactcttctagtctctgcttaagatatatgtatttaatctcgactaaagcaaatcacatagccaagctcagagtcggagtgggaggcagctgcccaagagtacagatagagaaggaggaagaatctgtggccatttttgttatctcccacagatggccaggaaccttggcacctttaagactcaagtcaccagtcgagtgtggtgactcacgcctgtaatcccagcactttgggaggccgaggcaggtagatcacaaggtcaagagatcgagaccatcctggccaacatagtgaaaccccatctctactgaaaatacacactgcactccagcctgatgacggagcgagactccatctca

SEQ ID NO: 229976 - DNA, 474 bp, Homo sapiens
cagaacctccaagccacgggtcttgtctgcagctgggccaggtggactgcacctgccaagggagcctccagggtgggtgctggctggccgggcgccctcctcacacacgagggcgggccaacttgagtggagccgtgtctgcatgcaatgctgtctctgcccccagcagctgaatgccacctgctgagctaatatttgctgaaccatcgagtcatggattccttcctgacaacgttgcttaagtgtttatccgagcaagagcttgggtcaaggttgccctcgtctccctgcctccctctgcaaacaccattcaactgccagcagtgcccttgatgtcccgtgtccagctcctctgagtgtggtttcctggctcatagttgcccaatgtacggcattccttgtggtgaaccacagggctggcccaggattcttagatgtcggaggaggcgaagatgccacgtccagcagaaagag

SEQ ID NO: 229977 - DNA, 654 bp, Homo sapiens
caagattgcaatttttacctcctcatggaagtaacactttgatttcaaacaagtaactcagcgttggtggaagcaaaatttaggatttatcccctttttaatgcagttaagtacttcaattttggcagattcttacatagaactcaagattttcatatagggacaaagacatatgttaaatttgtaaggtttaaaatgaattatagctgaagcacgaaacaagaatgagagtccttaccacatttagtgactgtgcagtgtattagtaaaatgaaaatgctgagatgataacccaaagaggagtgattacttatgcagacctgaatgttaaataggtaaaaattaaatattaagaaattcatttatctttttattttatcttttttcttttcttctctctctctctctctctctctctttctctccctctctctctctctctctccctctctttgagacagagtcttgctctgttgctcaggctggagtgcagtggtgcgatctcggctcactgcaacctccacctcccaggttcaagtgattcttctgcctcagcctcctgagtagctgggactacaggtgcctgccaccacgcctggctaatttttgtattttcagtagagatggggtttcaccatgttggccaggctggtc

SEQ ID NO: 229978 - DNA, 444 bp, Homo sapiens
ctcacattggtgcttatatgacctcttttgaactccttctgtgtcatctctcttaatcacttctatagtaatcctcacctaaattttctatcatcggctgtctaaaaccgaactcatcctttccttcaaacaagttctctttgtggaattttcaacttttaaaaatgttatcggctgggtgtggtggctcacacctgtaatcccagcactttgggaggccgaggtgggcggatcacgaggtccggaggtcaagaccatcctggctaacacggtgaaaccccatctctcctaaaaaaatacaaaaaattagccgggcatggtggcgcatgcctgtagtcccagctactcaggagaatcgcatgaacccaggaggcggaggttgcagtgagccgagatcatgcctctgcactccagtctgagtgacagagtgagagtctgtctcaa

SEQ ID NO: 229979 - DNA, 448 bp, Homo sapiens
aagcttgctgaggggcctgggcacacctccttttataagggccctggggcactgactataactctgctgcatacaaagggaaatatgagggactgttttataacataatatcaaacatttcatttgaagaccatgtgaggaaggatagtgttttcaaataccatctaaagtactttgtttctcagtgtgaggcccttcctttgtgaaaactagcccaaaaactagaggctaaatatcaaaaaggagagagcactaaagaacaaagaaagaacagggtaaaattcttgtctttgagcttctttgtagacttttacaaagatatagaaaatacaaaatcttgaaagccatgaccatcaaattcagtagtgaaaggaaaaatattttgacatgccaaaaagattggcttagaagatcaagtaccaaaatctgagggaaaattgtacaaagc

SEQ ID NO: 229980 - DNA, 185 bp, Homo sapiens
cacctcatgacaacacttcaaaaaaaattatagcagggtgcagtgacaggcatccatagtcccagctactgtggaggctgaagcaggaggatcttaattgagaccagttcaaggctacagtgagctatgatcatgccacttctctccagcctggatgacagagcaggaccttgtctctaaaacat

SEQ ID NO: 229981 - DNA, 225 bp, Homo sapiens
ggtcttaagaccaggcctttgacattcacctgaagatggctctctgtgtgagagcgggggagtgcggatgagagacacagttggcaggggttctcgcatgccatatccctccgtgtcccatcctgccctgtctgaccccatcagccccactcacttcctcacctccacgctcttgccagcttgtgcctcatagccagctcttttcattgccttctggggatagga

SEQ ID NO: 229982 - DNA, 270 bp, Homo sapiens
acaatcccccctcccctgccactcagtcttcgtgtgacattggatgtgtcacttcttctttctgtgctctgggccatgagaacggggtccttgggctatgatggtgacctctgattcagactcctgcctgtctggtgcctctgagtcagtgagaagagcgcggctgtgacctccctagactgttgtggttaagattgagggactgccacttcctagaaattaccttggtcacagtggttaagccgtccaatctaagataaatattgtacc

SEQ ID NO: 229983 - DNA, 529 bp, Homo sapiens
gtacgtaaatgtgctttctggtggctagtaacagtcattcatttccatgtttagcatttcctcaggatctcttttaaggaaggtctggtgatcattgccttagcatttacttatctgaaaagaattagagatttttttttcttatgaagcttagtttggctggatatgaaattcttggttggaattttttattacggatacagaatataggccctcaatctcttctggtttataggatttctgctgaaaagtctgctgttaagctgatgggattccctttgtttgtggcctgccctttctctccacttgcctttagtattttttattttgtattcaccctgaagaatatgctgactctgtgtcttgaggagggccttcttgtctatcttgaaggggttctctaaattttctgaccatgaatggtgactttgctagcaaagctgagaaatttttcatcaacaatattctcaaatatgttttccaagttgcttgctttctctccatttcagggacactaatgcatgataga

SEQ ID NO: 229984 - DNA, 544 bp, Homo sapiens
cagagcattttgttggcacattgctggcttccaaggtctgggtgcagtcacttgcaggaaccagcagtattgactatttagcacaccactgaaccttttttaggaattcatcattttgttctctttctctcttaagccagttcaaagggggtctgtcactttaaataatgcctaatccgtgtttatccttttgaagatctttacagaagggagaagaatgccttttgtgactactgaaagtacaaagaactacccttcactcatggaaatgaacatggccataggttttcttttccttctttctcttttctcccccttcacttcataccttttgactctgctaacgtgttgagttctcattatgtactgtggattgtttcacatagctcttctcattttatctcagcgagctattcagtattttttaatttttttcataagatgaggtacacctatttcctaatcaaacccgttttgtattgtgtttgtttccagcctttgacatttagagaaaaaaaaaaaagtcgacgcggccgcgaattta

SEQ ID NO: 229985 - DNA, 391 bp, Homo sapiens
atttgcattttcctttaaataagccaggtataatgacacttcccaagttccaggtatttcacagcacaactgtcagtacagaaccaccatttaaggctagattatagaaggtaattcctgtatagtgttgaaatacggcattacaaatattataacattttccttcagcttttcatatgctttccatctttagtgttcaattcactacagttcttggaaaaccacataaactttatacaacaatagacctcgcatttttagccttatgttctatggtacgtcaagctgacagcccacacaggagatcactctcagaagcaggagaacctcaaacagatctgtgctgaaattatggctaggtggctccaggcatgatccctctgttatacta

SEQ ID NO: 229986 - DNA, 433 bp, Homo sapiens
ggaagtgccctatctatgttctttatagtataaatcacctacttaggcactagctgttctatgtttctaaggacggattcaagaaccacagatttagcagctcaagaaagccagatttgcttttccataaaaggagtcaggagatatgcaagggtatctttgtagcaaatctggtaacttttagtcttattttaagcacttaaaaaatagttatactccaaatggcctctgggagtaactgcttggcaggttaagtgaataacccacagcaaagttccaacatccagagcttggacttgggcaagaggaagagactctcagactctaagatcctgcagatcctccccttggacatgggttcaggggacatgattttaactgttagctagaaaatgtccctttttcttctttggaggtctttaaccaaggccca

SEQ ID NO: 229987 - DNA, 479 bp, Homo sapiens
ctgacttctttttctgatctagtagtgtgtttcttcaccactttggctttgagcactcaaagtgcagacagtcatcagcagtgggatggataaattctggtacattcattgaaatgaatgctacgcataaatgaaaaagagcaacttgcaacaacacgtagtatattcatcaaaataatgttgagcaaaataagccagacacaagtaatacattctgtatgattccattacataagtttaggaaaaaccaaccaatagtaaatagataatctgaacagtggctactttttgggagaaaggtctagactgaagtgagagaaagaagaatctttctggagtctgaaagtatcttgacctgggtggtgactacatgagtgtatatatacgtaaaatttcatgtaaaatttaacttaagatttatgcatttgacttatgtaaattatacttcaataaaatgtttctacaataacctaaagaaa

SEQ ID NO: 229988 - DNA, 532 bp, Homo sapiens
atccttgatactttcccctagaagtccagcatctgcttgtttaaatacatatctcatgtaaaatgggaaagataaaaaatattgaaaagtgaagttttaaaaccttatactaaagatctttatactgcagtctgtctcacacaatatatcattgtctggctttcaacaacaaaaaattactaggcgttctaaaagacaaataagtcacagtttgaagaaacagagcaagcattagaaccagactctggttttgcagaggtgttagaattaatcagactaggatttttttttaattcctaagattaatatgttaggggctctaaagggaagattggacaacaggcaagaacaggtgggtgaaggagagaaatggaaaccttaggaaagatcaaaaggaaatcctagaaaccgaaggcaccataacagaagtgaagaatgccttcgatgggctcatcagtagactggacatggccactgaaagaattagtgagcttgaagaaatgtcaaccaagactcccaaaactaaaataca

SEQ ID NO: 229989 - DNA, 629 bp, Homo sapiens
ctgtagctgcagaacctgatgctatgtgcgctgcagaccgtcaatggagcagaggcggggaaggagtcacggggcgcgcacgccggggaagactacaaggtgcgccttctcgccacgcccacctgcacctgccttttcctcccgcctggtgggactcagccccacccctgcattttctctgcattttatgtcgtttccccaaaagtatatccaaaaaatgcctttttccctctggtaactttgatccctgggttctcgccattttctggatcactgtgacctgttccttgctttgggtcggcatccactgatgccagcagtggcatctccaagccaatgtgctttgctgttagaaggccaaggttagaagtgcagccagcgtggcatgaccaggaaataaatgccagtttattaaataacgagtaagccaccgtttcaagcctgccctatggaggaaatgccagtttattaaataacgagtaagccaccgtttcaagcctgccctgtggaggaaatgccagtttattaaataacgagtaagccaccgtttcaagcctgccctggggaggaaatgccagtttattaaataacgagtaagcctctacctgcacgacaacacataaaaaaaa

SEQ ID NO: 229990 - DNA, 193 bp, Homo sapiens
aaactaaacacccaaaggaagaacaagaaagaaaacaacagcatactggataagtcagtaagttttggaaagatagcaagcaaatggagaaatagtaactgacttagcagatcaaagaaagctgaagtctaactgcccacaaatggggattccaacaataagcaactcaattcttactacagaacacacacat

SEQ ID NO: 229991 - DNA, 389 bp, Homo sapiens
tgagtaattctcttaatcacctctcatcctcagctcagctccatgactctgctttgtgctgcttcataaatgcagcaagtatgtgtatttcaagaatgccaaaatattaaaaatttttgaattttaaggaaaaaagtcgttaagcaaatatactattaaaatatcagtttgaataaagtgaccaattacttatggaaatgtttgtgtcattttgaaataagagattatactgaagtttgatcttcatagagtgagaatgtcatgttgtcctgaatgctttcccagaatacgtggaaattatgtgttaaacatgatctctaacagcttacctactccattgtttatgtgcttatacttttacacacttatctttttacgattaattgttc

SEQ ID NO: 229992 - DNA, 526 bp, Homo sapiens
actgggagccctgacccccgggcctgagtgtgcctgtatttggaaataccgtggttgcagattagttaagatgaggccacacaggagcagggtggcccccaatccaacgtgcccggtgtccttaggaaggggaattaggacacagacaggtacgcagggcccacgatgtgaggaagcaccccggagaggcctcgggagaagcagccttgagcctccagcctccagagctggaagaaagtagatttctgttgctctgggccgccgggcatgtggtgctgtgttccaggagccccagacatgcatgcagagccctgtccagcccggacacctgctccacggggggcttgctggggctgagggctccagggcttcgctgggatgggcagagaggagccctccagccggtgctgccagcagccaagggctcctcccacagcttccctcactcgccctgatcacccctcaccacacaggaagcagggaggggccggtttccacccagaagtaaaaccaagcagagcggccg

SEQ ID NO: 229993 - DNA, 439 bp, Homo sapiens
tgagagtctaatcagctcaagctcctgcaaagaacacacagcaaggtttggtttcacctgtctgaaagctgacaagggaaccacagaatgaacactggataaggagtcagaagaactgacgtctcctgattttcttcactgtttgatcttggtcaagtcacttctactctcttagcctcagcttgcttgccatgaaatggccaggctgggattgccaatatcccaatatcccagttttaatagtctatgccaactgtggaatttagtctagtgatgaaacagataaagtcacaatttagccttaatctgcaggaggcagagagatggaccaccccaactcttttaaggattcatgtttctagcttattttgaaatatacttggccgggcatggtggctcacaccaataatcctagtactttgggaggcccaggtgggag

SEQ ID NO: 229994 - DNA, 475 bp, Homo sapiens
aattgccacatccataccttcaaaacatgcaatgtgtgcaccccaatcactgcttacagtataatcagtatgacgatgagattgagggggtctaaatttaagtgtatcatctcctgtgttatgtgaaaatatccctcagtacaaaacatttgtgtatttcacagatgactcttgttttgccataacgctacaaagtttatggaaactagtcaactgaaggatttttctgttgtgtgatatgtaaaggtctgaatagtaaaatcatctttgcattcctgaagtgttaaaaaataataatcaacatgtcagattgttgggcttttcttagcagatgttttctaattcaaagtttttggttgtgtttttgttttttagttcaaagttaatttgtttgcctcttgaagattaatttgtctcagctttctaggaactgccaaacagtgatattctcaaaaggattcaataaactagttca

SEQ ID NO: 229995 - DNA, 285 bp, Homo sapiens
gcatatattcatatggagatagacaagattactaaattcagtagtggaaaatgggcaggagctatgcttacaattcatttctatccctgattctatctaaatagaagactaagcatttcatgtttttgtggactatgggtaagtccttttaatttttgctaaccgttggacaactctgcagataataaaataatgacaatgttttgcattgtcaattattttgtcctgaaataactagtctttgagttcattgaaaacatttagagaaatctaaataatccaagc

SEQ ID NO: 229996 - DNA, 548 bp, Homo sapiens
atttgcatcagatattagtgaccttcagtaactatccatccatagtagcagaaggagtgtctgtctctcattaccaagctcagtactttttagtgtctcctgaggatagttaatgggaggatagttaatgggaggagtgacctgatgggtcttcatcagggagctggataggaaggatttgaggtgggaggaggtagtgtctcagtatgtgtctccagtagaggactgcatacgctattttctaggatcaaaaagttacggttttggaattttccgttcttttgtattttcattgtttcttcctccccttagttccatttaaatttggctacaagttttacggtttctgctgtggtgaatttcactatatatccttaaagctgatcccagactgtcttacctgcactagattttgaggaaagcagtgtgaatcgtagcataagccatgttttacggggtttctgctgcaatgtcatctctagtagtattgccgaatagaaataaaatgcaggtcacatatacagtttaaaattttatggtaactacat

SEQ ID NO: 229997 - DNA, 921 bp, Homo sapiens
cttcctccttgcttgtatgtcattgtgacctacgtatatggcatatgtttttctaagcaaagtgataattttacatcagggataattgaagcaaatgaatgcttcaattcatctccctcaagaaacgatgaatgaaaaagtctgggttaccaaatattttgaatagtttatgtgattcgcttctgtaaatcagtgagagaaacttactgattttcttgtgcatgtggaagttatgaggtggttcataatgattatgaattaattgaaatgaatcatataccaaaagaaatgattcatataccaaaagaaatgaatcatttcttttggtatatgattatctaattgtataatagaaataatttgctttattttccattggtttttatagtttcttataatcagtatagtttattagtaaaagaatctgtactaagctttaaaaagtatttgggtagctcattgatcaggtattttctattttctttaaaaactgattgttaaaatttgtatttagtaccatgatcagaataattaaaaaaaaaacaaaaacaactagtcactgtgaatgttgctttgctgtcttggaattatagtagatattctggctttctcttatttatgcaatttccaaatcatggaagtattgtagagccaggtcatagatgtagcttgttttgaagtcaagtgcattcctggagatccggttttgaaatgggtcactgtaaggtgatccctcttctttggacatcaatagaaaccatcaaatgagaggattaagttggtgagacattaagtgtgtatctttttatagggagtgttgaatgtgtgatgctagtttcaaagcttgtagttgccacagtactgtttaaagactaacaaaggtggaaagcaataaataattattaaaatggtttctttgca

SEQ ID NO: 229998 - DNA, 363 bp, Homo sapiens
agcttagcgacagccaagctgttcagagacacagcaagtagcccgggcaggtgatgggggccctgtcttaggaacagaggccgctggacgtggtggctcacacctgtaatcccagcactttggggggccgaggtgggcagattgcctgagttcaggagttcgagaccagcctgggcaacacagtgaaaccccatctctactaaaatacaaaaaattaggcaggcatggtggcgggctcctgtaatcccagctacttgggagactgaggcagaattgcttgaacccaggagacggaggttgcagtgagctgagatcgtgccactgcactccaccgtgagtgacagagcgaaactccgtctcaaa

SEQ ID NO: 229999 - DNA, 746 bp, Homo sapiens
gtggatactgagcattgtatgtagctcaccatggtgctgccgttggccggatgagggtgcctttgcctaccttggttctgctgcctttgaaaaatcatgaccgctggtcgtggtggctcatgcctgtaatcccagcactttgggaggctgaggcaggtggatcacaacgtcaggagatcgagaccatcctggctaatgcggtgagaccctgtctctactaaaaatacaaaaaaaattagccaagcatggtggcggcgcctgtagtcccagctacttgggaggctgaggcaggagaatggcatgaaccccggaagcggagcttgcagtgagctgagatcacgccactgcactccagcctgggcgacagagcaagactcttgtctcaaaaaaaaaaaaaaaagaaaaatcatgaccagcggaccagttgtgataagattgacaagttggtgacagagcatgttttgtgaacctctgaactcttctgggggcatttctcataatttatgtcttcttgtctcccggcttgggtgcctagcactcatggtttttcctgctggtcccgtaacaaattccattttcttggaaaggtatgtggtctgtcatgtagcttctagtcttggctgggattcagttgccatttgccctcttagggtattgacactggaaactttcttatcgtggttcttcagtggaagtttggtggaagctgtggataggggaagtggtgggacgggaagatagggttt

SEQ ID NO: 230000 - DNA, 104 bp, Homo sapiens
gcctcagcctcccaaagtgctaggattacaggcatgagccaccacgcccgacctccactttcccttcttttcaggggtgagcagagcttgctgcaatggtctga

SEQ ID NO: 230001 - DNA, 618 bp, Homo sapiens
tctgtcgtgtttatccatgtttttattatttctatttttcttcattcctgatgttatgtttccttattttatcattttgtttctgaattaagaacttccattagccacacctttaagaaggttgctgtgtccttccttgagtcccaggtccccctggcagcccacagtgtggatctgggatacacagggtgagcacaggctgtaggagttcttgaaattctggcaggggttctgcacttgacctaagaggtaaggcaccagcacttctgaaaccagacagaattggatggaagctgtattttaaggtgattgtctgtatttatgaggattaatcttttggataatctggaaggcctgggggactcactggaaagatatggtaataatttcaataaatatttaagggctataccaagttgaggctggtaggaccagggagaagcagctgtatgctacatattgagatcatctaaagacagcaaattgatgttttacatgaggttgattttgaagagtaaggaggcatatctggtccccagtctcatctctggaaagaactgcaccagacccaatccaccctaattacctgttctctcctgattgcgaagtctatgaaaa

SEQ ID NO: 230002 - DNA, 542 bp, Homo sapiens
tgactaattaaaaaaaattgtagaaaccgggtctcactgtgttgcccaggctggtctcgaactcctgggctcaagtgatcctcccacctcagcctcctaaattgctgggattgcaggcaggacctaccatgttcagccatgctcaaaaaggaataggcatgtcaaaaggtcacaggagccaacctgaaagaatacccaatggccaaagctggaacagtttgaacaacaaaataaatggtgatagtgttttattataagccagagaaaaacctaaatatctgtaagttcatagtaatataaataactgaataaataaataaataaatgggagagaaaggacagctcttccttagagaagagttgcaactagtggctgtaggagtaatgaagagaactggaaaatcaccattaaagcaccactgtaataattgtttctggcaagatccatcagtggttgctgaattagtgggttaatgtttgagagaaacaaggtatttgcatattcctaaagtatctctctcaagatatttattaattacaaa

SEQ ID NO: 230003 - DNA, 458 bp, Homo sapiens
tgggcccctgccaggctgccgaccagccaggggaagtgaatgtgctcagcgtgagagtgccagctggctaggctttctccccaggggggaggctgtaagcacagattaccagtgactttgttcagttctgctgccgtgctccccgaggagaggaacatcacagcccagcatcagtactaataggccctgatgcgccagacccaggctaagaaggccagcgtgggggtgggggtgcagcagagaggaggacaaaagccacgcctctgaagctgtcaactggctctgaggctgacaaggaagcactctctgcagcaagttccaatccctgccgcaggaaggaataatttcaccactttctcactatttactgtccacagcaaaaagaaacccccacacctccacttagcaccatcgtgagcatccctagagtccaataaattacagaagagaaactaaaa

SEQ ID NO: 230004 - DNA, 1146 bp, Homo sapiens
gtttatgctgagcgttagtgtgtatgtatgtgcgtacatgcgccaggtgcctgtgccctctgtaggatggtttgcttaatatggttttataattcagtttacacaggattctttattttttttaattttgtattttggcaaacaccattcagttataagaactttgccaaatatgatagaataattcaagagcatatacagagagttaccacttgacccagctatttaattgcaaatacagttgttttcatttcatttcctaccagaaaaaggaatcagaaacctagtttttgaaaacacaagtgtaattcctcttttgtacttctttttcacaaatgcttttatttattctaaattgaatttaaaaatccttcctaaagccattaactctttaattctcctgatatgcctttacttcctatgaagttattggtagatgttgaggcccaaaaactggtagaatattgaagatcttcttaaatgaccaatttaaccataaccaaatattgaatatcattcttcagtcacatctaagtcaggcactttttcacatagatcagggcttttggctcagtcacgaaatctacaagttagcaaagcttacaaaacattattcgtcaggtatgggaatcaaatatagacacttgtttgtctttgctttccatttctatgtgtcacatacatatatgtgtcctcttataactttagtcttcaaaattatttcaatatccttcttctcactatatttatttgtgtgatggaaatgctttcaggccgtagatcattgttggtgttaatctgtggttaatcctcattttagttccgtcttatctgatacttagaaatatctcagccattttggaggctgtgcagtatcagaagacgtggagtttgttctgtctctgcctgtagctaattatggtggttcagtcatttaataaatatgttttgagcatctattttgtgaaaggcactgtgttacctgtgtgtctttagtgtcctcactggtaaaatgaagaggctggccatgagctggaagggttaagtttataattccagctatttcacacccgtcttccttgaaggaatgatagtgatagatataaaaacactgtaagtccctcttttaataaactaaatgaaaga

SEQ ID NO: 230005 - DNA, 523 bp, Homo sapiens
gtaccttaacaatgctacaagtgaatttaattctttttttaaacttatatacaggtcaataagtataacatctagcataaaaccacaaatacttggtggaaatgactttggatactttggataattactttggaactgggtaggttttatttcttctgtagggttgggagggtacttttaagtcactacttcatgaaaattctgggccttggggcttagctgggcgtttagtcatataactagattcactgaatttgctattactgattgtctgaacttcaaagttgtggacaagccaacaagaggtaatcatacttatcaaagagtagaaaactactttctctcactacttcattgttagctcttttgcttcaatctgcagtcaagtactcaagtttgttatgaaagactccccagctcccagaaaaaagttggtgacactgtctaagctttaaatatttgagacaactggtcaggataataggtcgacgcggccgcgaatttagtagtagtaggcggccgc

SEQ ID NO: 230006 - DNA, 554 bp, Homo sapiens
gtaccttaacaatgctacaagtgaatttaattctttttttaaacttatatacaggtcaataagtataacatctagcataaaaccacaaatacttggtggaaatgactttggatactttggataattactttggaactgggtaggttttatttcttctgtagggttgggagggtacttttaagtcactacttcatgaaaattctgggccttggggcttagctgggcgtttagtcatataactagattcactgaatttgctattactgattgtctgaacttcaaagttgtggacaagccaacaagaggtaatcatacttatcaaagagtagaaaactactttctctcactacttcattgttagctcttttgcttcaatctgcagtcaagtactcaagtttgttatgaaagactccccagctcccagaaaaaagttggtgacactgtctaagctttaaatatttgagacaactggtcaggataatagctggtaagtacatccaaataagtatgaatagaattagtcttctggtcaacccctaaaatactgaaactgt

SEQ ID NO: 230007 - DNA, 636 bp, Homo sapiens
  misc_feature (38)..(38): n is a, c, g, or t
  misc_feature (57)..(57): n is a, c, g, or t
agacaagggtgccgtcaaagctcactgagtcgagctcncaggtcaagttgatcctcnaccaggtagagacagggtcttgctatgttgtccaggctggtctcaaactcctggcctcaagcagttctccaaccccagtctcccaaagccctgggactgcaggcatcagccaccatgctcagcttgttgcctaattagtagtttaagatgacaaaactacatggatgataataatttcaataataattctaaagcagtggtagcaaattcttagattttgcttactatatagcagggactattctatgaattttacatatattaacttatttatttatttatttatgttttgagatggagtcttactctgtcacccaggctggagtgcagtggcacgatcttggctcattgcaacctccacctcccaggttcaagagattctcctgcctcagcctcctgagtaactgggattacaggcgtgtgccactattcctagctaattttgtatttttaatagagacagggtttcatgttggccaggctggtattgaattcctggcctcaagtgatccacctgcctcagcctcccaaagtgctgagattacagacatggccaccatgcctggcctaaagtgagtt

SEQ ID NO: 230008 - DNA, 297 bp, Homo sapiens
aactcggagcctattgctgccacctctgtcagggaagataaatgggcatgaataatagacagatgagtttcccaaaagcccagacaggctgcagggaacacgtaatgagcagacagtgtggttcacgccggggagcccaggtttatccaggcctcatcctcactccctttctctactgataattggacccaacaggaccattccgaatcatttttctctcttcagttattcttcagttctactcaaagggtcagtttagggcataattaaagtcaattactttctgaaaggccatca

SEQ ID NO: 230009 - DNA, 603 bp, Homo sapiens
acaaacccatcagcatctctgggtgatcatttcagcaaagatgcaaagggaatagaggacagggaggatgacctccagcagtgaactggccttgacccctccagtttgacagactgtccagccagcctcttttggtgcagaaccttcttacaagacagctgcaaacgggctgctccagggctctgaacctaagcttgcactggtttgcacagtgactacccatgctgagttctgagttacagatatttctactttccagaaccccgtttccttctcctttccaatttgctaaagtggatatttattgcaaggaaaacagtactgaaagcttttattgcatttatgcagcactcagccaataaaacctcaactcagaggtaccatattttatgtagacagggatttggctttgacaagattctccccaaactgattttcagtggaaggagccacttcttatacaactactcgctaaatttccagattttaggaccagtgtatgaaatatactgggatagatgtcagtgagatggacaatgtagttttttctcttttttttctggggccgcaaaggacttcaaggcaggtaagagatgaaaccgc

SEQ ID NO: 230010 - DNA, 250 bp, Homo sapiens
tccgagtgtttggattttgtaatcctcctgtctttggccaactccccatccttggcggagcgctcgcccttggccgggctccgtgctgccagccttgcggaaccctaggcccgggcggctctgtcggaggcccacttctcactgatgcggagtggcccgagggtgggagcagcggttaatgccgcactgattaatacaggctccagtgaaagcgaaagtaagaaaataaaacggatttcattatacatat

SEQ ID NO: 230011 - DNA, 156 bp, Homo sapiens
ggatagttggagcaatggctgaatataaactatcagaaaaattgaatctgtaattctgtcaataagtgagaaaatattctaagattctttaaattttaattctgggtttttgaacacattgatgtgtaaaatataacaaaataaggtggacactgt

SEQ ID NO: 230012 - DNA, 367 bp, Homo sapiens
gtggcatgatctcggcccactgtaacctctacctccctggttcaagcaaattcccctgcctcagcctcctgagtagccgggattacaggcacacgccaccacgcctggctaatttttttgtatttttagtagagatggggtttctccatgttggccagactggtctcgaactcctgacctcaggcagtctgcccaccttggcctcccaaagtgctgggattacaggtgtgagccactgcgcccggccgagaacttgtaaaggatgtagatttgcactcacaagtttgttaaaacacataatttcttctctggaagatattttctgtcttgaattattgctaaaatagtaagaatgctaggaagactt

SEQ ID NO: 230013 - DNA, 491 bp, Homo sapiens
ttggataatgtgatgcctccaggtttgttctttttgcttggtctttctttggctatgagagctcttttttggttcctcatgaaatttaggattgttttttctagttctttgaagaattatgataatatattgatgggaattagattgaatttggagattgcttttgcaatatagtcatttttacaatattctacccatccacaagcatagggtgtgtttccatttgtttgtgtaatctgtgatttctttcagcagtgttttgtagttttccttgtagaggtctttcatgttcttggtatcaggctgtttctccagtttgtatatgagattctgccagaaatagatttgctgtcatgccctctgcttgcctttacccagctatgctagggtctcaaaaatgacaactcagaacactgggttaaatacaatttctctctcttcacccattttccactatctgcctgtccggccctggggttattaatctagtt

SEQ ID NO: 230014 - DNA, 568 bp, Homo sapiens
aaaacccaaaatgaagcccttctgaaaaggataactgctaactaatgtgtagatgatgggagctccttccctttttcacttcgtgggagattttttggagggaattcctgaggttcacattgttaacacatagccatcctcatccgctctgtttctgcaggggtacacatgccacccttgagctggctggctcagtgggcgcacacgggcgctgtggtctgggtctttctgccaccggtatcacagtgtagctggtggccttgctctgggctctcctgccacaggctgtcccctccaggaggacagatgggtaggtgggctgctctgccagcccgtgacacaggtctagcccagccaactgtctccaaggaagggtttactgctatcgcctcggtgctgtcctcatgacagcgagttcccccgagacctggctgtttaaaggtgtgcggcacctccccaccttgctgctgctttcgccatgtgacgcgcctgctcccccttctcttccaccaggattgtgggtttcctggggcctccccggagccgagcaatgccagcacatggtgcc

SEQ ID NO: 230015 - DNA, 640 bp, Homo sapiens
aaaacccaaaatgaagcccttctgaaaaggataactgctaactaatgtgtagatgatgggagctccttccctttttcacttcgtgggagattttttggagggaattcctgaggttcacattgttaacacatagccatcctcatccgctctgtttctgcaggggtacacatgccacccttgagctggctggctcagtgggcgcacacgggcgctgtggtctgggtctttctgccaccggtatcacagtgtagctggtggccttgctctgggctctcctgccacaggctgtcccctccaggaggacagatgggtaggtgggctgctctgccagcccgtgacacaggtctagcccagccaactgtctccaaggaaaggagggtggaaggggccgccctgtacaggagtcacttgggattgatgctgtgctttgcaggcatcacccatgtcgatattccctgcgtgttgctgttcctcccgtgttggtattccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgtt

SEQ ID NO: 230016 - DNA, 306 bp, Homo sapiens
ccgaccaccgtgtctgggtacgtgcagttctctgaacgtgcagctctgtggcttgcctctaaaccagagtttctcaagcatttgggtcctggcatccttttactctcttaaaaagaaggaccccaaagaacttttgtgtgtgtgggttagattcatcaatatgtaccattagaaattaaaacagacatttttaaagtgtattctttaaatgtggcaataatgaatctattaaaagttagaacaaataacacatttttttctttaaaataaccagtttccaaagtaaaactaatttaatgacaagac

SEQ ID NO: 230017 - DNA, 486 bp, Homo sapiens
atgttgatgatataatgagagtaatacatttataagttttatttgttttcagttaatttcatttggttaattagttcctagtactgatgtgttaaaattcatgaaaataattttaagttaaactcttaagttttctaactctgtgaatctgtgttagaagggttttatttaactgaaataaaagctcataactgcttcttcgagctatttgacattaacattcagaaacaatctaaattttctctagaaaagaatttacctgaagttttaacattagaatttgaaagagtatgatgaaaagaacactgtaccagttatgttgactaattttgataaaacaaaaagttttaatctaatgctattacagttactattgtttatagattgcaaatatatttgttctaatgaactttacccaaatgatatccaacatgtgggatttttccttataatgactataccactaaataaaatcatttgtttgat

SEQ ID NO: 230018 - DNA, 616 bp, Homo sapiens
gcatagtagatgatacatgaaatcacaggataaaacatacatcttcctgaagtgtcagtatacttattttttcagagttggattaaatattataactggtaatttaaagtttgcttttaactttaaatatttttatggaatgaatgataaattagcatgaattcttgagataaagtgagaaagcatcaaataagttacaggattatagcaggccctttgacttctaccccagggtgggtctggcatcgccagacctctgacatttttaagagcagctagaaatctaatttttttaaaagtgagatctgattttgaatgttggcagttaactcagaggtttttaagtaaatttttacatatcagacaaaaacatatccttgggcctaaacatctgcttgtgacctatgagatgtgtcagggatatctcctattctgagtctggctccttcagatttgaaactaaccataagcaggagtggaaagaataaagctagagacttgattagaacaaattcccacattaaacatcctctgtaggaaacagcttctataactcacaggctaccatatcccttctcgttgactccccttgttttgcagatgaaactaaggtcca

SEQ ID NO: 230019 - DNA, 437 bp, Homo sapiens
gctgggtccctggtaggttctgccaatggagggcgctagagggagcctgggggactggtggagggagaggagttgggctcatcctgtctttgtccacatcacctagcatagacagctgggtccagcagcagtgttgagttactgtttgcagtttatccacattcccagaaccagcctcaacatctccccttagagatacaagcactgtccagcctgggacccctcctcagaattctgaagccctctggggcccctcctctaactttttaaatttcaataacccctaacactgctttttgtttccccagttctaagggtggtagttgcttcctgtagttaccacctctgtgattcctctgggtcccctctttgccattttatttgtccaatttttgattaataattctttatattaaattctgtctgttaaaatactt

SEQ ID NO: 230020 - DNA, 406 bp, Homo sapiens
cagaatatacattcttctcatctgcacatagaacatactctgttatctaccacatgcttgcccataaagcaagtctcaataaattcaaaaacactgaaatgataccaaccatactctcagacttcagtggaataaaaatagaaattagtaccaagaagaaccctcaaaccacatcaataaatggaaattaaacaaattgctcctgaataacttttgggtaaacaaagagagtagggcagaaattaaaataaataaataaataaaaacacagatacaatatatcaaaatctcaaggatgtagcaaaagcagtgttaggagcaaagtttatagcactaaatgcctacatcaaaaagatagaaatataccaaatcaatgatctaacctgaaacctagaggaactagaaa

SEQ ID NO: 230021 - DNA, 528 bp, Homo sapiens
tcagttaaaatatattcttctatgttctgtgcctcttcatcgcgaacaactgttaagaattgtgtttccttcattgggggcatcaataatccaaatcaactagaacaccagtcttccatctcagtcatactacttcttgcatttaatacagcaagtcaggtttgcacaaagactttcagggacattcaaaagtggtttacaattttaaacgttttttcatctttcgttgaaatgacagtatcttaaaaaataagagctaacacaccaaatatgaaatctatgattttttaatccttcaaggtatgaaaaagatttattcctgaaaactgtttatgaagaaatatataagtcagtaaaatcctactttttaacttccattacaaagtagaaataatcctatataaaatattagatataatggcattaaaataatgttcacaatgtaagcatattttaatcacatatctaaatctctgaagtttcacataactgcaattctttatcttcgatggaaacttacaatttcct

SEQ ID NO: 230022 - DNA, 2336 bp, Homo sapiens
  misc_feature (578)..(579): n is a, c, g, or t
  misc_feature (584)..(584): n is a, c, g, or t
  misc_feature (586)..(586): n is a, c, g, or t
  misc_feature (590)..(590): n is a, c, g, or t
  misc_feature (593)..(594): n is a, c, g, or t
  misc_feature (597)..(597): n is a, c, g, or t
  misc_feature (606)..(606): n is a, c, g, or t
  misc_feature (1121)..(1121): n is a, c, g, or t
atttttttttttcctctgtgctcttagtgctattattgtaagttcttagctggttccctctcaaccattatccttaaattgaatgtgttattgtcactatgttgtgtcctggtagggcatttttgacagtgaatgttgagaaagcatatgcatgtgacagggcggatttgttagaagcagtggaaaggtgagtactaaactgggtgtttaaaatgcaagcttcagctgggcacagtggctcacacctgtaatcccagcactttgggaggcagaggcgggtagatcacctgaggtcaggagttcaagaccagcctggccaacatggtgaaaccccctctctactaaaatacaaaaaaagtagctgggcatggtggtgcatgcctataatcccagctacttgagaggctgaggcaggagaatcgcttgaacccgggaggctgaagttgcagtgagccaagatcgtgccactacactccagcctgggggacagagcaagactctgtccccctcctgccccgccccccgcaaaaaaaaaggccaggtgtggtggctcatgcctgtaaggcaggtggattacnngaggncngganttnnagnccagcctgntcaacatggtgataccccatctctactaaaaatacaaaattagccaggcgtgttggcatgcacctgtaatctcagctactcaggaggctgaggcaggagaatcacttgaaccagaggttgcagtgagcagagattgtgccactgcactccagcctgggtgaaagagtgagactccatctcaaaaatatatatatatgaataatttttccaatgtctggtgaaaatctgtcttgtgtgtcttttcgtgtgtgtgtgtgtgtgtgtgtgtgtgtgtgtctgtgttttaacctttaaacaacagggaatagtgtcattttggtatgtaactgatcatatataagtatatgttaataattcaccgaaaaccctatctctattaaaatacatctaaaggaaaaggtctacatttcaattagttctatatctctaatttggatctcttgctatcccagaggatataatttaaaataagatttcttgtttattctcggtaagaagtaattacagagcacctntaagctgagtattgcttcttaaattgaaggcactaaagataaagattgctaaatatttcgggaactagatttaactgtgtgacttgaactgaaaagcattctaattttccattcttttatgggtgctggggaagaactgctttgacatgaatgtataatagaattaaaatgtcggtcttaaattttggggagttgttctcagtttgctcttggaatttattattgtaatactgtcattagatagtttgttggaagcagctaatacgtgaaagtgaagcatcttaatatgcatctcttttctttctgacaatgaactgtcaaaaaagctttgagtttatctaacaaacacagctgaggctgggattttaactccactattaatatattctaattttaaactactgtaactgaaagggcatacagcactaattcaatccagacatgtttgagtgcgtttgatagtctcatccttgtaatagctgctgaaaaagatgtggtagagatttcagactggaccactgacgtctgggaattgacactagcacacagactgggtcaggcaaggtacaacctggtgccgccagctgttttgcatggaagaccttatctgtaaaactcatagagagtcaaacaagatgtgtgcctctgaatgaatgggatccttggaaaggagttttaaaataggttttaaaggttttctattttcccctccagaaccagcaggaactgttctggatcacagcaacacgagtctgctttctgcttcttggcagagccgttgcccctgtggtggcagttgtgtggtgggtgatagctgggagtgggaatcgactctactccagcatgagggagagattcttttccaacttccccagacccgtcccacattgctcgtgtattctgccactaacaagaatgaagacatcacattggccgggcgcggtggctcacgcctgtaatcccagcactttgggaggccaaggcgggtggatcacgaggtcaggagatcgagaccatcctggctaacacagggaaaccccgtctctactaaaaatgcaaaaaaaaattagccaggcgtggtggcaggcacctgtagtcccagctactcaggcggctgaggcaggagaatggcgtgaaccctggaagcggagcttgcagtgagccgagatggcaccactgcactccagcctgggcgacagagcgagactctatctt

SEQ ID NO: 230023 - DNA, 401 bp, Homo sapiens
aaccctttgaatgtgggaaattagtttcctcctcagcattgtcctctactacttttcggagtataatgtgtatgacattctctcagtaaaattttgatacacttgatagttgaaggttaaagaagagtagaaatcatcttaacaccttactaatgggaaattttttcataggaatacacataatttccagaaagttacctttttatagagggcatcatgcataataacaccttttggctcaaaatagaaattatttttaagcttatacttttgccatacgttagagcaactactgatttagattgttctgttttactgttctagaatcattccacacttgcctcttggcatccataatcagaaaagtaaatcaagaaataaactataaactgatcaatgtt

SEQ ID NO: 230024 - DNA, 1471 bp, Homo sapiens
gaaagattaacataaaatatacatttatttcactttgtgttatggaggaaaaacaggaggcctttgtagagttcctgcgtggggatttagaagggataggaaagccaggatttagagatgtgcaaaggtcttcctacccctccacatttcttaccagttaatcgtattgttcatgtatacagcttatggagcttataaggacattggacacccacatttatagccaggccctttgattctcggcagataatgggctcaggaagggcagcagtgggtggagacattttactagaattagtctgccgctttgaatacaatctggatttcttgctatttcttgtgcaacctgtacgccatttcctctgaacttgctagtgctctggagacttggttgtttggccaaggaatatcccctagcaggagggctcactaaggaggggcagcttgacaggcagaaaagtgatgtttgtcaactaaagaagttttcttttaattaatgttagagtcacccatggttttttgtcaaataaaaaatgcgaaatccttggagagcttgccttactgaatggggttttgataggtgaaattatcaccaggacctctacatgggtcaggatatgactcagtttgggttttggacctctgaggaatgtgacccctcttagtgtaggggatttggagtacaaaaacctgggttaaagttccagctttgccatttattcagaagttcctggaatttgatgtttgagagatctctgagctcagttttcctagttcttctagatcagggtaatcccttagggccagatagaggtggtcacaccctgattagcaccttggttccttctcccagtttgtattttgtgtcacctgaaagtcattttattttctctgtagcctctggttataggttatgtggtcattcctccagagaatggcaaagctcattgttggttggggatcatttggtatgtcttcccgggagaatgctcttgaacctagttttgagagttggggcctcaagaagagactttggcaatgcccttatttaaatgttagaaatgtttggttgcatttttgatgcattgcttacatagttaatgtttttgtatttggtacttgtcattttaataatttattaaacaggtgatttaggttttctaagatagctaagagcttagaaaaataggactgcaggtcgggtgcggtggctcacgcctgtaatcccagcactttgggaggccgaggcaggcggatcacaaggtcaggaggtcgagaccatcctggctaacacggtgaaaccccgtctctactaaaaatacaaaaaattagctgggcgtggtggcgggcacctgtagtcccagctgctggggaggctgaggcaggagaatggcgtgaacccgggaggcggaggttgcagtgagccgagatcgcgccactgcactccagcctgggcgacagagcgagactc

SEQ ID NO: 230025 - DNA, 1471 bp, Homo sapiens
gaaagattaacataaaatatacatttatttcactttgtgttatggaggaaccaggatttagagatgtgcaaaggtcttcctacccctccacatttcttaccagttaatcgtattgttcatgtatacagcttatggagcttataaggacattggacacccacatttatagccaggccctttgattctcggcagataatgggctcaggaagggcagcagtgggtggagacattttactagaattagtctgccgctttgaatacaatctggatttcttgctatttcttgtgcaacctgtacgccatttcctctgaacttgctagtgctctggagacttggttgtttggccaaggaatatcccctagcaggagggctcactaaggaggggcagcttgacaggcagaaaagtgatgtttgtcaactaaagaagttttcttttaattaatgttagagtcacccatggttttttgtcaaataaaaaatgcgaaatcaaaatatgatctcggttctccacacccatttttacctttaagagcctctcacaccttggagagcttgccttactgaatggggttttgataggtgaaattatcaccaggacctctacatgggtcaggatatgactcagtttgggttttggacctctgaggaatgtgacccctcttagtgtaggggatttggagtacaaaaacctgggttaaagttccagctttgccatttattcagaagttcctggaatttgatgtttgagagatctctgagctcagttttcctagttcttctagatcagggtaatcccttagggccagatagaggtggtcacaccctgattagcaccttggttccttctcccagtttgtattttgtgtcacctgaaagtcattttattttctctgtagcctctggttataggttatgtggtcattcctccagagaatggcaaagctcattgttggttggggatcatttggtatgtcttcccgggagaatgctcttgaacctagttttgagagttggggcctcaagaagagactttggcaatgcccttatttaaatgttagaaatgtttggttgcatttttgatgcattgcttacatagttaatgtttttgtatttggtacttgtcattttaataatttattaaacaggtgatttaggttttctaagatagctaagagcttagaaaaataggactgcaggtcgggtgcggtggctcacgcctgtaatcccagcactttgggaggccgaggcaggcggatcacaaggtcaggaggtcgagaccatcctggctaacacggtgaaaccccgtctctactaaaaatacaaaaaattagctgggcgtggtggcgggcacctgtagtcccagctgctggggaggctgaggcaggagaatggcgtgaacccgggaggcggaggttgcagtgagccgagatcgcgccactgcactccagcctgggcgacagagcgagactc

SEQ ID NO: 230026 - DNA, 575 bp, Homo sapiens
acatactatggagggagatgctctctttggcggggaggattgggaaagcctctaaaaggagctgctattttgaccagggcttgaaaatagcacttccacaggtacagttgctgggaaaggcatattgagaagaagaagagtttaagtaaaggtcctggggcagggaaagagaggtgctggtagaacatgccacaggctggctgtgcattgtcacatgaccagtgcttctccaagtttcagttgagaaggagacaattcccttggccccagaggagtccaggagcctttagggccaccaaagcccatctttattttgggtgtaccttgaaggctctgctgttgaccttacctgtacactcatggtacctctggtccctaagatgttgcagaaggcaaatctggccctttgccaggctcaaagccagcctgctagatcctcctctataactgcagatccccgggattgctctgactcctgaataagcatgggcgggaaccagtgcccctgtgggactccccatggtgcccagtctgtgcccagaaaataaagtggcaggcagtgacccctaaatggt

SEQ ID NO: 230027 - DNA, 453 bp, Homo sapiens
aatgttttcagaattacacacgtaggctagaatgacaattagtgaaatttattgcagaaataaagacaacacaatcaaatttttaaattgactctagtatttattaatatcctccatgtagaaaagataacaacaaaactggaaacataatactttaaaattacaaatactcagccgggcacggtggctcatgcctgtaatcccagcagtttgggaggccaaggcgggcagatcatgaggtcaggagatcgagaccatcctggccaacatggtgaaaccctgtctctactaaaaatacaaaaaattagctaggcatggtggcatgtgcctgtagttccagctactcaggaggctgaggcaggagaatccttgaacctgggaggcggaggttgcagtgagccaagattgtgccattgcactccagcctggcaacagagcgagactccatcttta

SEQ ID NO: 230028 - DNA, 792 bp, Homo sapiens
ggaaacagtaatgtctaagggctaggaagaagacgggaggaaatagggatgggggtagggtagtaaaaaagcccagagaagtatgtgcaagaaactaacagtatgtggttgtgggcgtagtttttcaaaggaagaagtagtcaaatgctgtaacaaggacaactcatcttgaaacacttacgcagtggtgtgtggagctggcttggaccagcttttgctagccagttattgtgtagtagctcttcccagcccatgttcagtgataccatgttggtaacttgaaactggttaccatggaaatagtcatgccatggaagtctgcaaatgatacaaaacttattttgagctgatgattatatggtgatgtggtcgtaaatatttaacactcattagaagacattgactaagtaggatgttgaaggttgctgaaaccagaggtgtttggagaaaagtaattttcagaaggttggttatgaaaagaaaatggggtgcagggagtgggggaacaatttattcagaactgttgttcatttcttgagaactgggttcactcttgatgtagttctctgcagctttctccaccctgggtcctcctgtgaattgccatgagtcttttgtgctatagctctctttggtgctgtaaagggggaaagcagcaagggcttatctgcagaaaatgcatcagttgactgacactagttgaagaacaaacctttaggcggtttcttttccgggcatgtgtaccgtctgccgaagagagcaagtgagaagtgaaggggtagttaaacaatg

SEQ ID NO: 230029 - DNA, 734 bp, Homo sapiens
ggaaacagtaatgtctaagggctaggaagaagacgggaggaaatagggatgggggtagggtagtaaaaaagcccagagaagtatgtgcaagaaactaacagtatgtggttgtgggcgtagtttttcaaaggaagaagtagtcaaatgctgtaacaaggacaactcatcttgaaacacttacgcagtggtgtgtggagctggcttggaccagcttttgctagccagttattgtgtagtagctcttcccagcccatgttcagtgataccatgttggtaacttgaaactggttaccatggaaatagtcatgccatggaagtctgcaaatgatacaaaacttattttgagctgatgattatatggtgatgtggtcgtaaatatttaacactcattagaagacattgactaagtaggatgttgaaggttgctgaaaccagaggtgtttggagaaaagtaattttcagaaggttggttatgcttgagaactgggttcactcttgatgtagttctctgcagctttctccaccctgggtcctcctgtgaattgccatgagtcttttgtgctatagctctctttggtgctgtaaagggggaaagcagcaagggcttatctgcagaaaatgcatcagttgactgacactagttgaagaacaaacctttaggcggtttcttttccgggcatgtgtaccgtctgccgaagagagcaagtgagaagtgaaggggtagttaaacaatg

SEQ ID NO: 230030 - DNA, 508 bp, Homo sapiens
agaacctgcaaagatgagctagaacaatacacaggacagactggaacccttgtgggttttcagccatctccaagcctccacattcactgacggaggtgaaatatagaaaatgccaatgcctttcatcctggggctaaacatggagctggcaaaggggtcagagaaggtgaaggagaaaattcagcaggagccatggtggctgtgctcatgattgctgaaccctgccaataaagtgagccagcagagaagcaaaactgtaccgcaacagtgtcttccagacataagaagaattcgactgctgcatcatttccaccttctaaatctcatacaggatgtctcttttgcactaaccctggtaataaaaggaaaggaattctggaaaatgcagttacaggctacttcaactgacataatataagcctaccactgtccagcccttgtcaacttgacatccatatatacctctattaattactcttaacttccaaataaagacagtgtcaaaatc

SEQ ID NO: 230031 - DNA, 390 bp, Homo sapiens
ggagaaggtgcattatatctttaacagaaatagaatgctggcatgtgaggtcaggtgatgcgttctgcttcaggcatgtggaatctgaggtaatgataaacatcctaatggagcagtccagaaggcagcaggagtctgaaaagaatttatggaaatgtttctgagaaggaaagaacctgagagataacctctctttcatgccctctcattttacagatgaagaaacatgtgacatgttaagtggcatgatcatgatcaagttgtatttatgagggagatcctatttcataacgcaaaggaattctagttttataaagtgaaaaagactgggaagaaagatctgaaagatgcctttgtagaatgaaacttgacactacagccctgaagccc

SEQ ID NO: 230032 - DNA, 702 bp, Homo sapiens
cctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccaagatcacaccactgcactccagcctgggcgacagagcaagactctgcctcaaaaaa

SEQ ID NO: 230033 - DNA, 288 bp, Homo sapiens
atttgcggctgtgtcgacgcgagaacagcacccattgttcacatgaatgtgttgatcagtactctgctgaactcaagaggcaacccctgcagttctccagagtcctctctctatgaaacccttattttctcctacactattgtgacctttggctgcctcagattaatgccttgagagaatttcctggactagagcagagaggggaaatcaggtgtagttcagcaaactccctgaattaaagagacagagctgagtatccagggagaccaaggcagctaaagctcacaa

SEQ ID NO: 230034 - DNA, 754 bp, Homo sapiens
tcaagtgatcctcccaactcagcctcccaagtagctgggattacaggtacatgccaccacgtccagctattttttgtatttttagttagagatggagttttaccatgttggccaggctggtctcgaactcctaacctcaagtgatctacctgcctcggcctcccaaagtgctgagattataggcgtaagccactgcgcccagccttattgccctgcttctgatttgcaattatcttttaagttgattcaggggtgtgaactgtttcttatttaatacatttgcttgaaaaatatgagccatcttttagtctccaaagacttttctttgtgaaggctggattttggagatagtttcagcttttttacaccattccttggttgccagtagttatgatactggctgcagtccagacatagggatgctcttagtattccttagagcatctccctgcaccctgccacctgccctggtgggcagggtgagcagccaggaaggcatagcctgagggcctgtatctagcccctgctttctcgcctgggtccttcctacccatgctgtctcccaaatcaagggattgaataggaagtgctgctcagaacatcccccagaatcagcctcccgaagagactcaccctcccctaccagaggttgggctgtggctggtgttaggggaacaggagtaggaggggagccagaggaggaggaggtgggcccttgcctaaggggtgcctgctggttggtgtgggggctgga

SEQ ID NO: 230035 - DNA, 670 bp, Homo sapiens
catttatacgtacttggttttgcaattagaagatgcagagaacaggtgatgcaattattttacataactgtgttcatgaactaagtgttccaaccttcctgcccagattgatatgcctagaaggcaccccatttggaagtaaacacaggctccatttaaggatgcacggaaggttggaacactttattcctgaacacatttatgtaaaattaattgcatcacctgttctctgcatcttctaattgcaaaaccaattaactttaaaatgctcagcacagtgtggccaagggaagggaaggcaaagaccaggctggctttgcaaactctgtgccatttgtagtggccacagtggccctaggaagtcccagccattcccatctgctggccgaggaggccctgtgggatgctgggagactctaggagatgagcaagaccctcagagtctggggctggaaacttcctagcacaagtgagctgagtggtcatgggccaggtgatggagtggacattccccagtggtggccagaatgacccaatatcaactgcccctccacccagcacccccattccctttaccctgtattttgttcccctctgccattttcactgcccgactggctgtgtagctatttgtttatcatgtttctcctcagtaaaatgttgactccac

SEQ ID NO: 230036 - DNA, 506 bp, Homo sapiens
  misc_feature (51)..(51): n is a, c, g, or t
  misc_feature (61)..(61): n is a, c, g, or t
acaacctcctatcccccacagtacgatatattagaataagaagaaaaaaanacaacgctgngagagtagacgtttgttccacttcgcatctgaattgacaaggaatggactcttcagctctgacagcaaatctctcttcagaagtctggaaaagcagaaagagaagaatgaagaaatgtccacaaaactgctcctatcctttacaccacataggaccaaactcttacctttcatcagttttcagtttgtacattaatgtatcctggtgaagttcctcaaccacttctgcaacattcaattttaatttatatttgcccacatcatttcatttgtgatttggacacatgcaggctactgaatataatggatacaaatctctcactgattcccttgagctatttcatagttctgctttcacaggcaggagacagtgaagaaataatgattcagttatttcttaaagatttcacaattctacattcaataaagaatatgtgaattcctgg

SEQ ID NO: 230037 - DNA, 440 bp, Homo sapiens
aataaataataaactttccactaatataagaaccacaaaagggtgacaaacactgtttcacaaatctctcttcagaagtctggaaaagcagaaagagaagaatgaagaaatgtccacaaaactgctcctatcctttacaccacataggaccaaactcttacctttcatcagttttcagtttgtacattaatgtatcctggtgaagttcctcaaccacttctgcaacattcaattttaatttatatttgcccacatcatttcatttgtgatttggacacatgcaggctactgaatataatggatacaaatctctcactgattcccttgagctatttcatagttctgctttcacaggcaggagacagtgaagaaataatgattcagttatttcttaaagatttcacaattctacattcaataaagaatatgtgaattcctgg

SEQ ID NO: 230038 - DNA, 809 bp, Homo sapiens
aataaataataaactttccactaatataagaaccacaaaagggtgacaaacactgtttcacaaatctctcttcagaagtctggaaaagcagaaagagaagaatgaagaaatgtccacaaaactgctcctatcctttacaccacataggaccaaactcttacctttcatcagttttcagtttgtacattaatgtatcctggtgaagttcctcaaccacttctgcaacattcaattttaatttatatttgcccacatcatttcatttgtgatttggacacatgcaggctactgaatataatggatacaaatctctcactgattcccttgagctatttcatagttctgctttcacaggcaggagacagtgaagaaataatgattcagttatttcttaaagatttcacaattctacattcaataaagaatatgtgaattcctggaagttatggtatttgtgaaatatttaacatcagttcccatggaaagcgtggacacatcaacaagccccagtctcttagaatttcattctgctagttcactgaattcccaaatgggatttgagcatcaccatgggagttgcaggtaatgttagcagaaaaggtataaaaatattctataataaagtttaactgctgactaaaatggcagctatgtttttcagtttggaagatcaataaagaggaggcttggtggatacaatcttgcttatctctctatctggattatgaatgtgaaaggatattactaaaatcaaaagcataaaaagcaatatgatgtgacaccttgaatttgtttacttactgaatcat

SEQ ID NO: 230039 - DNA, 577 bp, Homo sapiens
ttccgggaagaatgaagtacatatgcaacctccttttgttataggagtgttggccatgacccttatgacggatggggaaagacatcacatccttcctctcctacttgcagaaatatgaatactcaaggttaatgtcaaggacgtttgttccacttcgcatctgaattgacaaggaatggactcttcagctctgacagcaaatctctcttcagaagtctggaaaagcagaaagagaagaatgaagaaatgtccacaaaactgctcctatcctttacaccacataggaccaaactcttacctttcatcagttttcagtttgtacattaatgtatcctggtgaagttcctcaaccacttctgcaacattcaattttaatttatatttgcccacatcatttcatttgtgatttggacacatgcaggctactgaatataatggatacaaatctctcactgattcccttgagctatttcatagttctgctttcacaggcaggagacagtgaagaaataatgattcagttatttcttaaagatttcacaattctacattcaataaagaatatgtgaattcctgg

SEQ ID NO: 230040 - DNA, 1145 bp, Homo sapiens
agaagaataaaaagatgtatttttaaaaatttaaatacaaggatattagcaaaagtcatctaactttaaaataataatttagatgccaatcacatggatgtaaactaataaagtaaataaacaaattactgagaagtggagattcttccatccaatcctctttcctcctttcttctttccttccacaggatttacttaatttgtctcctcagcaattcctcacctagattgttaacattatttttcattctctcttctttctaccatatttaatacattaaatttgatcttagttcaatgtctccaggcttttttttgcatacgcacatctgattgtgtcactcatctagttgtgagctgcagatggcttctcaaaaccttttgttataggagtgttggccatgacccttatgacggatggggaaagacatcacatccttcctctccttcagcatcactgaaatttatatatctttttatttttcctagcaaatctcctttcatcagttttcagtttgtacattaatgtatcctggtgaagttcctcaaccacttctgcaacattcaattttaatttatatttgcccacatcatttcatttgtgatttggacacatgcaggctactgaatataatggatacaaatctctcactgattcccttgagctatttcatagttctgctttcacaggcaggagacagtgaagaaataatgattcagttatttcttaaagatttcacaattctacattcaataaagaatatgtgaattcctggaagttatggtatttgtgaaatatttaacatcagttcccatggaaagcgtggacacatcaacaagccccagtctcttagaatttcattctgctagttcactgaattcccaaatgggatttgagcatcaccatgggagttgcaggtaatgttagcagaaaaggtataaaaatattctataataaagtttaactgctgactaaaatggcagctatgtttttcagtttggaagatcaataaagaggaggcttggtggatacaatcttgcttatctctctatctggattatgaatgtgaaaggatattactaaaatcaaaagcataaaaagcaatatgatgtgacaccttgaatttgtttacttactgaatcat

SEQ ID NO: 230041 - DNA, 251 bp, Homo sapiens
ccgatcacatttctacacaactgtccactccattgaatctaagcataaagatggatagttttccctggttctttgagccttctttcagaaggcttctctgtcacgtaaaagcatgattaaatatttgtcatgcttttttctcgttagcctaccttttgttataggagtgttggccatgacccttatgacggatggggaaagacatcacatccttcctctcctacttgcagaaatatgaatactcaaggtta

SEQ ID NO: 230042 - DNA, 206 bp, Homo sapiens
gcccataatgtcctcccactatgacgttcccaaagaatctcccaaatgtggtcccatccatccctttgttgtatttacattttagtatattctgacctggttcattaatttaattgaaaatttttaactactgtgtgttacatatcgcgttcccttttctccatttttatttgtcctactttactttggacgttccttaccttgcc

SEQ ID NO: 230043 - DNA, 602 bp, Homo sapiens
atagggaccctttccttttaaataggttgtacattactgactaaagctaagatttatattcagacattatgctttctcaaccctttttacatagtagccatacaactccttaaaaagaaaatcattctgttacctttgactatgactcaatatttaagaaatgtatttactcataacatatttttgttgaggtagatattcatataaatcaaattaaggaacattgaattgtgtatgaaatgtgaacttttttttaaaggactcctgatgcttagtttatctttagagataatatagtcttaattgtactacacataaacatcctgtagtttaagtaggaattttcaggcatcagatttctagaaggaaggtaattctcaatagaaaggtcattttaaaagttcaaactttgatttacagttttttctgttgaccgtattaagtatgaaattatgggtaataaatatatttaattcattttcaactgcatattgagttataaaatattggccacatgttttctcctcttaacacttttccacaaacatgcactcattaatcaaagacggtgcactcctgctgagggcagagaggttcatcaa

SEQ ID NO: 230044 - DNA, 434 bp, Homo sapiens
tttgattttaataccatgtctcaccctcatcaccatgtaaaacccccagtttattcactgtttgaagatctgttgatgaatatttgatgttagtaaataaacagcttagggggacaaaaaaaaaacagccctgcctacctattgtaggttacttcagctgtaggctttgttttatacagtttgactacactggtagcagtttgacattgacggtccacaaaagcctgttcaaacagaatcccagtcatttaaaaaaattcttctttagtaacatattctttaaaaatacaaaatacaggaggagggtgagggttgagagataacctatcgggtacaatgttcactatttggttaatgggcacgctagaagcccagtccccatcagtccgtggtgagacccatgtaacaaatgtgcacatgtacccccaaatcaa

SEQ ID NO: 230045 - DNA, 254 bp, Homo sapiens
tcaaagccaagactcccattccttagccctagctcaggtctccatctcttaaatccgagtgacctctacaaactctccctgagaaggtgtaccagaacccttttggaaagcgagggacagtgtcactgtctttgggttgacacctgctctgagtaactcacggaaaacaagttccagctgggaagcccttggacgctccacacctccctacccgcagcccgtcctgtggcgcccgggactccagagtgcgttta

SEQ ID NO: 230046 - DNA, 97 bp, Homo sapiens
tggaaaatcctttatgtacaactaccgactcatgagacataagcgagttcacactggagaaaggccttatgagtgcaacacatgtgggaaattcttt

SEQ ID NO: 230047 - DNA, 429 bp, Homo sapiens
aggatgttgtagccgttcatcaaaaaaatcttgattctctagagaatgtgggtcacaaactggacaaaaatagaaatctaagttccttggacaaagccagagtcaagcagccaaaacactaatgtaaaaaacagtctcactaactaaagtaagcagcaggaaatagcatcatttggacctgattccaggccaaccacaggtcctgaggcctagctcagtcagaaaatatccctgccatgttctctcacagctgaagttttaaggcagcagccagagaaacaaccatctaaccaagttcgatgtcaagagataaaattttgaaattaagattaacagtccagcaaacacaaaaagtaaaaacacaaaaagaacaaacattttacttcaggattccaaaagcactgagaaagggataatgtgaaaaatgag

SEQ ID NO: 230048 - DNA, 333 bp, Homo sapiens
ggcccagggtgctagcaggggaaaggaagagagggatactgtcaggtaactgagttgcctgttgctagagtgtgtaggtgttcactcactaaaaaggggcttctctccacctccatcttttatgtttaaggaattcaaccgcaagagctcttcagaaatggatgccaagtgtgtctcctcttcctgaggttgagggagagctacctgggactgcttgttgagagcccaggccagtaaaggctttattcacagtcaccaaggcattgcctgacagtctgcatatccatcagggtgcaaaaacaaaccaggaggaaaatctctctagagccaggg

SEQ ID NO: 230049 - DNA, 304 bp, Homo sapiens
aatctcagcaggtgtaaatcttctttcccaaagagtttaagtttttggatctcaagcagtgagacaggccggaaacttgtcctagggaatcaactgctctctggtggttcaaatatattagcataaagaaatcctctgtttccctatcttgtacttcctgtcccaactcaatcacaaaatgagagaaaaattgtagtagagcaggagacttttcaaatctccgatagattcctttcttagctaaaccattccatttatacatcttggcagtagtcattagcagtgagaaagctaaagagacaac

SEQ ID NO: 230050 - DNA, 245 bp, Homo sapiens
accactgggcggaggggtgggacacctgaaatgtgttcagttttctgtgcttctggtgaaagggcctgtgcaacccacagcctggtcccacactgtccaacacacctggtgctctgtccctcctccaggcctctgcacagggtgcacactctgcctctccccattgattgtgaatttcacattcttcaccaatcagcccaaactgatacccactgtttatacctaaactaaaaccattcttggta

SEQ ID NO: 230051 - DNA, 438 bp, Homo sapiens
tattggatttgtgtgactaagttaaagtagacttacgaatgtacagtttagagagaaaaaaatgcaaatttacattatattaaaacacaccaaaaaacagtgtttttgcttataacaaagcacttaaaaaaaaccctgtattcttgtcattagtattacacagtacttcattcatgaatactaaaatatctttatacataccatgatacagtaatagacagtagcacacacttttgcatctatttagtgacattaaaaataaattattcaaattaatgtactgtgggctacactgctgatttgaagtgatgacatattttttaatcaaactttattttactctttcactattcatgtcctaaaacagacttcactgtttcttttacactgtcttcaactataacttaaatgtgataataatatacttattgtgagtgg

SEQ ID NO: 230052 - DNA, 537 bp, Homo sapiens
ggaatcccagtgattcaagatgcattggagagaaatacagactgaagataattggttacccatctagaaaggagatatatgaagtctgggtaagacctgcagtaatttcccttaagttactgatcgtggagcctctccaggactacaggctcttcctcagcggctgccaagctcctcttagggaagccggggaacttctgaatgcccaagtataccctgctggaggcacaggaatcctcttggaagctttgtctggacatgctttaataccgtccatttctactgttgccataccaagccgctactggtcaccactgtaaatctttctgctgttttttataaccacaaagtatagcacaatttctgtctgctttcatgcacctaaaactattgtggtttttgcctttcccggtctcattagctaaaacaaagagttgataaaggcacaggccctttctcaagaaacaaaatgttgtctgtcttctttctgcagtgaaacagaatgcaaagtccagaaataaacgtgtaattaaataa

SEQ ID NO: 230053 - DNA, 499 bp, Homo sapiens
taagagcaccctggttttctctgggggaatcccatccctcccatgcatgcagtcttggtgggagcataattccaggtacctgctgccaacaagcatcaaggagcggtgccattcctctttatggcttttatcatagccaaggcatggtgaggctggccagagctgttctgggctgcttgcaactaagaaatcctaactgaagtacacaagcaacaaagccaaaactcaaaccccagcccgtctaatgcccagctcatacttttctactccaccatgctgctcccggggtttctgcactcagaatatgtgtacatggagattgttcacaaagggccaatatgagagcgtttctacaaaccattcggtgcttattccagggtaagtgaaagatctgtcaggcaattaaataaaatccagtttgttgaggtataacttgcgtacacacaatttatcctgtttagccaaccaattctatgatttttaacacgaaactgccatc

SEQ ID NO: 230054 - DNA, 447 bp, Homo sapiens
tgcgcccactaccaatgccacagtttctcactggattattggggttgcacccgactgcctgcttcagctcttccccgtcctcaggacagcactgggatgatgagtgccacgagccaggtcacttcacacccctgccctgcaccgcacagtggggagtggaggctgtggccctagatgcctgcacccgcctgccacgcttttggccccttccccctccactggcccccaacccccagccctgacgccatgcctgtagttgcgcccccaacacccacgtctcttccctgggtcctcttgttttccttggcgcgtgaccgtgtctcacactcaattatgtctcttaccacccactacagagagtgggaccgttgtctggttgggttcctgttgtttctcccacacccaggactgtgcctaatgcacaggaataaaaaatattaaatgaat

SEQ ID NO: 230055 - DNA, 238 bp, Homo sapiens
ttttacataaatatgtgcaatatcatttacttacaaaaatcatatgtaatatctgacacataaattgattctaaacatgattaaactaggtcatttctttccattagaatttattatttatttttatttttaattattttttgagacatggtcttgctctgttgcccagcctggggtgcagtggtgtgatcttggctcactgcagcttccacctcctgggttcaagctattctcccat

SEQ ID NO: 230056 - DNA, 221 bp, Homo sapiens
ccccacctgcgggcatatccccaagagaattgagagcagggtctgtaagagacatatacacgcccgtgttcacagcagcgttactcccaatagccaaaacgtagacgtcacctaagggtcggtctgtggggagtgaatacacacaatagggcccatccatacaggctaggaaggtggcaagagctgaaaaccttgcaaactgttaacaaaaaaagagttga

SEQ ID NO: 230057 - DNA, 268 bp, Homo sapiens
cctatttttattttttatttttgcgtatatgtgatggagtctttgccatgttgcccaggctgttctcgaactcctagactcaagcaatcctcctgcctcagcctcccgagtagctgggattacaggaagctcaattatttttcttctttaaaaccttttacttgacgtattcattgtttcatattttaaatttaaaatcccacaaaagaagccatgtggctccgctgcagcagccgaatcatggcacttgtttgggggcttcctgggg

SEQ ID NO: 230058 - DNA, 483 bp, Homo sapiens
aaggctctaaaggttggttctagagctgttcttagtttctagatatgatgtagagtagaaccctgaattcagcatccagtcggttttagcagtaccctcaggtagtctccgaagagagatggtttgataatgggtctcctagattttctaattgcatccatggattgtgtaacgaaaaccttaagtttgcctgtgtcatgcagagttctgagtggggtctagtgcctaagtgacaggactgtggaatttaattcacaagaatactattttgctttgctagatagcttagtgatttggccatttagagactgtcagtaataccaaatgatttaggagggcaaattacatttcagaatgagttttgtgaaattttcttgagatttgcatgttttctgcctgtcttgaaaatatctgtttattaattatatttcatacacccccacttttaaaaccagttcagttatctctcactgtggccaaaaa

SEQ ID NO: 230059 - DNA, 633 bp, Homo sapiens
ggtatatcaatgaatgctattcttcaggagtctaaaggaagtataatataactctactatatggcagaaagttttatggtctataaaaggatgtgaatgccctggccctgtggctcacacctatctataatccaagcactttgggaggccaaggtggaaggatcgcttgaggccaggagttcaggaccagcctgaccaacgtggtagtctaaaaatacaaaaaaagaattagccagctgtggtggcgcacacttgtaattttagctactcagaagactgaggtgggaggatcgcttgagtccaggaggttgaggctgcaatgagctctgatcatgccactacactccagcctgggtgacagagtaagaatctgtctctaaaaaataaacaaaaggaccggaaaagtcgaggggtgcggtggctcacgcctgtaatcccagcactttgggaggccgaggtggatggatcacctgaggtcaggagtttgagaccagcctgaccaacctggagaaaccccatctctactaaaaatacaaaattagccaagtgtggtagtgtgggcctatagtcccagctacttaggaggctgaggcaggagaatcgcttgaacccaggaggcagaggctgcagtga

SEQ ID NO: 230060 - DNA, 653 bp, Homo sapiens
tgtaagacatacttttcatctgctgctgattgtgaggcctccccagccacatggaactgcgagctcagtccacatggaactgcgattccatttttctttataaattacccagtctcaggtatatgtttatcggcagcatgaaagcagactaataccatagtcatttttattgactattttcacgttatttttaattattatttaccatttaatagtatgtctttatttttataaaggacatttctgacaaatagaacaatgtagtgatcaaattattctttctattggtatgcttttgctgcttatgtcaaataatatgtattggagattctatacagaaagattatatacaatagaatacctcacataatcgtgaaaatatatggaaatatatattactttattataactccctgaacttttatgaatattaaagggtcccataatgaaatcttgtatcttttgtgaaatcactataaaaattatattatattggtcagtaaatctttatatattggctgatgtcatagaattccttaaagaatttagtgataggaaaatagtttggctcctaatgagtcagtaagctttctttcatcagatattgatttctaataatttcattttacttcaatgcaaaaaatctcagggtt

SEQ ID NO: 230061 - DNA, 374 bp, Homo sapiens
gagtgatttgtggacacggagtctttcaggaggtatatctaagaagacatatttattttattcttaattttgttattcaaatactgcttttgagaaaattatgaagtagcaaaggaacttaggccagcatgaggtcatatgggcttggaaggaagtgtgggaggtgagaaaaaaagcacagaaaaaacaaggctatttaaaattttccttatcatctacaataaataatatgacttattttctgagggtgaaagcctaaaattcattttcataaactatttcccagaatttaaactactagaattcaccatgcagggttttgtatcttactgatcaatagtaaacatgcaaataatagcttgtgattcaatttt

SEQ ID NO: 230062 - DNA, 440 bp, Homo sapiens
cttttgatgggcatatgggttgttttcagaatttggctagtaaaattttctccaaattgatctagagattcaatgcattcgcaatcaaaatcccaacagctctttttttttttttccttcctaatttaagaaattgacaaaattatggctggtcgcagtgtctcacacccgtaatcccaacacttcaggaggccgagacgagaagattgattgagcccagcagttggagaccatctgggcaacatggtgaaacctcgtctctacaaaaaatacaaaaatcagctgggtgtgggggcaacgtgtctgtagtcccccagctactcaggaggctgaggtgggaggatcagttgagctcaggagctcaaggttgcagtgagctgtgatcatgccactgcacttcagcctgggtgacagagagaccctatctcaaaaaaaaacca

SEQ ID NO: 230063 - DNA, 455 bp, Homo sapiens
tgtttctaaggggcttgtgaagttaaccaaaattaaggtgaatggtacagctgtatcaattgattaattaattgataccaagaacaaacatccctggagcactctagatgtaattcttgtctcccttttcctattccaaatatacttagctatagggtgttgttttgttgtcttgtcttggaaatttgttgccttttaaaatctttaagcacagaaatgctgccagtaacaacaacaacagagagactgagagtgccctgtgttgtcagggcagccatttggaaacctgttccccaaactatgctgattaatgccctctcctttcccccatccttccaggaaagactgcccactctttgcactgaaactcctgacactccttttttaaaaggataatgcgacattggttgacgtgttatttcaaatgcataatgttaataaatctgttcacgcat

SEQ ID NO: 230064 - DNA, 393 bp, Homo sapiens
aactggcaagcctgaattaagttttcaaaaagttaaatctatgggagattttttggcaagcagtgcccaaatcccttggaataaaagattcatttttgaccactggatctactattatgttaatgcaatcaatacagtttgtactgaccagagcaggcgtttgagattgagtgaccttgcaatcatttccaaaacatgtacagggcactcctctcagccttcttaatggcttttcaactgaaaaagattcactgaagctggttcatgggagttcacttggtctcgacttggagtttaacacaactggtaccctcctggggatgaggaattaattctaatatgtaagaagactagataacaatagatttcctatgaataaacataaaaatccca

SEQ ID NO: 230065 - DNA, 367 bp, Homo sapiens
ggctgcccggtctaccccacacactgcctctgccccactgcccggcccaggctgctgagggccccctccttcccaccctgctgccaccttctccacctctccccacccacactagatgattctttcctctgctgtcatagagcctgcggctgagtgctctgatacagatcctggtgatttgtttatcatccgacttcttcccctcctatatcaaggagggaactttcctctctctgatgcctccgtctctaagcctggagcatccccagcacataactggcttacagatgttcgaaagagtaaatgaatcatacctatttcctaacttctttttcacattggggaggcctcgtctgttgcctgcagg

SEQ ID NO: 230066 - DNA, 785 bp, Homo sapiens
ccccagcacataactggcttacagatgttcgaaagagtaaatgaatcatacctatttcctaacttctttttcacataaaagctcagtttcctgagcaggctttaggtgccgttggctgctggggaggtggtggggaggcctcgtctgttgcctgcaggagcttccagtctcctttgcaagttttgccctcagtgactcagggctttgaaatttgcttctctctcatcccgaataagccacggcaggatgtaagaggaagagaaactaactaaagggttaactgtggaatgtctctgattggtgaaaaaaagacacttttctggagttgcagtgttagtccactcatatggggtgcaggtccctggtaacaagtggttgagccaccttcctgggccagttgagggtcagaacaggagacatcagattcaggcagaagcactccgcccatcagaggagtgggcagcctgccctcctgactcatgattcactcatgcggatggagtgtaacttcctccaggcaggcgcaggttcagggcacagcgctccttctcagaaacgaagaaactcctgttctgcctttgactccctgtgttttttaagttgcagggaaatttggtttccaaatggtcctgcctcactaatttaccagctttctatcactctgcccattttgtatttggttctccatcttactacagaacttggcagaacccaagaaggaaagggtgccagctgccctggagaacccagggacgtgcctcaatgccaggagaggggcagggggc

SEQ ID NO: 230067 - DNA, 994 bp, Homo sapiens
ggtccctggtaacaagtggttgagccaccttcctgggccagttgagggtcagaacaggagacatcagattcaggcagaagcactccgcccatcagaggagtgggcagcctgccctcctgactcatgattcactcatgcggatggagtgtaacttcctccaggcaggcgcaggttcagggcacagcgctccttctcagaaacgaagaaactcctgttctgcctttgactccctgtgttttttaagttgcagggaaatttggtttccaaatggtcctgcctcactaatttaccagctttctatcactctgcccattttgtatttggttctccatcttactacagaacttggcagaacccaagaaggaaagggtgccagctgccctggagaacccagggacgtgcctcaatgccaggagaggggcagggggcaagacccacccacagagggatgccctgtcttaggcagtctttgcctgcctggcagtccttggtccttaggacgtaagacacttggcttcactggctactggaggaattcattcctttttggcagtgtgaatcaaaggggctgggcagttacctttgggagggtcagcaagcgctcagaacgtgcccatgtgccaggctgcttgtggcttttgtccctcagctttctctgaatgctgtggatctgctgagctgtgggcttactctttggggttttctggtgatagctaagcctcctggggatgattcactacatgttcaaaacaccaaacgaggccaggtgcggtggcccacacctggaatcccagcactgcgggaggctgaagcaggcagattgcttgagcctaggagttcgagaccagcctggacaacaaagtgagaccttatctctacaaaaaaatcaaaaaattagctgggcatggtgctgtgcacctacagtcccagctactcggaaagctgaggtggaaagatcacctgagcctggagaggtcgaggctacggtgagcca

SEQ ID NO: 230068 - DNA, 175 bp, Homo sapiens
ggataatttccattggcctacatacaagtccactaatgctctctgcagccttgtccaattggctgatgagtctgacaaaaaaattttatatctctgacattgcattttttaacatttgtatttgactccattttatggtttccagctctgctgaaattccccttctgttcatgtg

SEQ ID NO: 230069 - DNA, 421 bp, Homo sapiens
gaatgcatggttatgcctcattgcatggttatgcctcagtggagtttggcattcggggtagatggttaacagagtcacttcacagaatcacttataactcaaggggggtgagcaacttgatgattgtatttgatgatttatatatttctctaaccccatatgataaccatggggtagcaaatgaacccctgccatgactgtataggctagtatgaatgcccccaggcacaagggcatacattcttgctcatgggtgttggagagccaaccagcagagggattcttctattagcactcctagggcttggaacacacacatgccagttaattcatcatctagtttccaagtgttcctgaccctccaggaaactggaaacttgtgtcattgttgggaacagtgaataaattgttttaaatatta

SEQ ID NO: 230070 - DNA, 386 bp, Homo sapiens
agccactgtttccaactgagacccaataatttaagtagaagggctgggactggggcctgaggctgctgctccctgcctaaggctctgagactgcttgatcacagggtcaagatctttgatgaagccgctttctcaagctgtgggtgggcttttcctggtaggaaatttgcctgagacctggcaaagatgggaccttttaaatagtgaagggaaatgagcaatccttccaaagtcaagttcctcaacgaagcccttctaaacactgtctctcctccctgcacacatgcctatgtgcacacaatacacatgcttgttcatgctttatccctcttggttaggggtctatccccatcaagccattaaagttgttctggtggaatctctga

SEQ ID NO: 230071 - DNA, 352 bp, Homo sapiens
agctgttcacaggtggttctcacattccctaaactcgtttatttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatctgacaaaaaa

SEQ ID NO: 230072 - DNA, 512 bp, Homo sapiens
  misc_feature (11)..(11): n is a, c, g, or t
  misc_feature (31)..(31): n is a, c, g, or t
  misc_feature (35)..(35): n is a, c, g, or t
  misc_feature (50)..(50): n is a, c, g, or t
  misc_feature (66)..(66): n is a, c, g, or t
  misc_feature (89)..(89): n is a, c, g, or t
  misc_feature (92)..(92): n is a, c, g, or t
  misc_feature (96)..(97): n is a, c, g, or t
  misc_feature (113)..(113): n is a, c, g, or t
  misc_feature (115)..(115): n is a, c, g, or t
tacaaaggganttcaaaagatgtgaacctcngganctctggatcatcatnagagactgagctgaancccattgataagtctccagaccnaancccnntcatgactgatactcnanttcctcgcaactctcaagatatcacacagttgacaacccatggacagcaatatccatcaaaggcgaaattcatacagaaggatagatagtttacaaagggagaaacctgtgtggctagttctagtttctaagacagctgcaacaagacctccagtcctccgtgctattcttgaaacatggcattgagactcctccctactgagaggtggggtctgtgtttcctctcctggaaaccgagcatgcctgtggccacagcagaagtgataccataagacctctgggctgctgggccatagaaacccagcttctgcctggtcttctcagggtgctagctctcggaacctagctccagagagggcacacctgggtgtgctagttccaacagccagatgtgagt

SEQ ID NO: 230073 - DNA, 595 bp, Homo sapiens
agctttaggctggcattctcattgtgccgttttacagatgaagaaactgaggtccagtgtcaaggacagagaccttgcccaaggcattctcctctacaccacagctgcccagacagcgaaggggaggccagatggaccccagccacctccagcactcagttctggggaaagatgtgcttggcaggttgggtgcaaaacaaagcacttcatccttcaaacccaactcgtttccaagctcggccattatgagagatattctggggcctctcagccacacctgcttaggagctgcctatccctctgaacttttcaaaggtatatgatacaggtcgggcacgaaatgccagcactttgggaggccgaagcgggcggatcatctgaggtcaggagttcaagaccagtctggccaacgtggcaaaaccctgtctctactaaaaatacaaaaattagccgggcgtggtgacacacgcctgtagtcccagctacccaggaggctgaggcaggaaaatcccttgaacccgggaagcggaggttgtagtgagccgagatcacacctctgcacttccacctgggagacagagagagaccccatctc

SEQ ID NO: 230074 - DNA, 507 bp, Homo sapiens
aatgttctatgtcttgatctaggtggtgcttacacaggtatctacatatgtaaaaattcaatctacatatttaagatttctgtacattttaagattaaaaagtaaggcaaggaattatttgttttacatgtatatatatcctcatacaattccaaaaatgatttgaacctttttacaaagatatgcacaattaccagattgtaaaataaataagggagaaaactggaggaaagaaaaataaagacaggaaataaaaataagccaaagttaatgctattactgcacccaagcaccgcccccccaacccccgccaaatacatgacattaagtgtcacttgttacttgtggtgggctacaattctggctctgagtctatgaaaagagggagatgccgggcgcggtggctcacacctgtaatcccagcactttgggaggccgaggtgggtggatcacaaggtcaggagatcgagaccatcctggctaacacagtgaaaccccgtctctact

SEQ ID NO: 230075 - DNA, 449 bp, Homo sapiens
atataggatctctgcgtatgtagtcaagttaagatgtggtcatgaaggattagggtaaattctaatccagtgactggtgtccctataagaagagggaaacttcgacaccaatatactcagaggaaaatggctatgtaaagacagaggctgagattagatttatgctgccacaacctgaagaagagcaaggattgatggtaactcccagaggctagaagaggcaagaaagaatattttgatagagcttttggaggcaatatggacttgccatactcattgattttgaacttttattctccaagaactttgagatgataaaattctgttatttttagctgcacagtttgtggtaatttgttatggcagccttagaaagtagtacatagaggatgttacccagaaaaaacataaatgaacccttgatatacaaaacatggatgtattttaaa

SEQ ID NO: 230076 - DNA, 368 bp, Homo sapiens
gatgataacatggtgcaattatatctccccttcagttcttgggaggggtgacattagtaaagagatgaaggtaagcctccagcagccgagtatgcactgttctcgccacccttcccaaaaagctccctgttatttacaggatttcaactatgcagcatgttattttgaattaagggttatggattcttgctttcagttgtctgggtattactttaaatcctctcatttggaataaacatgtcaagattactttaaaatatatcattcatcaaatcaagaacagaaatagtctttgtaaaaataataatgtttctatacttattacaatattatgattggttacttcaataaaaaaaatctcaaatgga

SEQ ID NO: 230077 - DNA, 390 bp, Homo sapiens
ttttccctcaagcatgtgataggtgccagcagggaggggaaagtggccaagctcttttgccattgtgccaggagtaagggcatggtgtccatgctcagcttcccacaaaaggggaagaacacatctaactggagaccaccaaccacaggcctggaaggaactttgagacagcaaagtgaggtgatgaagagtcagactcaagactcaggctgtctgggttgcctgctaattctgccatttcttaacaggatgccttgggcaagaccccaaagccattgttgtccctgtacaagaaggttaatattaatatctattgtgtagaattttctaaggactaaacgaagtaatgttaacactttaaaactttttttaaattcctggcacattata

SEQ ID NO: 230078 - DNA, 451 bp, Homo sapiens
caccctctccagaaagaagagccaaaattaggaataaaaatacctcaaatagaagagaacactagagtccaagggtgaattcacagcaaacaccagaggcatagaaagagaagaaaggaagcagccagcttaaccaagatcaaccaagagccccgagggactccctattacaggaaaacggtcctgaattccagcagaatggctgaagccaaccagtctcaagacctcaaccaaggaaccaaccaactctgcacaggaatgcggtttcttcatctccctgtcccaggaattcccccttgcttcttgaccaatcagcaatccccacattttagccctacctgttcagaccctttacaagctccatccccaaaccctggagggaggaggatttgaaggttcctctgtctcatttgactgccctacaattattaaactctttctctactgcaaa

SEQ ID NO: 230079 - DNA, 549 bp, Homo sapiens
ttggcagagatctaattagcaaaggcttcatcatagaacagcatactcagtcttcatggagcatactgaagcacatgtttgtaagcagtctgcttgtgacaatatcataatattggatacagtaaccagtctacttagaaaaagtgtgcccttcggttaactggaagataactggggcaaagaacaaaacttcactggcctgtgagccatctctgaaactgaaaccctttgataaatatagatcaaagaattcactagagcgtatttgatttctcttaaaagacaatccagagtagttgttgccatttggtatggcttttttaaaatcacttgtctacactattcaggtgaaagtcggcctgcattttcttaacctttggagtcttcattggcatcctttttaatttttttatgttcttcatgttttataaccttttttttaactatatatgcaacttgagactttaaagtatttttaaaaattgatcattgtgtaaaacattatagtgcttctctttttaaaaattgccttatgatttattattttcc

SEQ ID NO: 230080 - DNA, 482 bp, Homo sapiens
  misc_feature (32)..(32): n is a, c, g, or t
  misc_feature (51)..(51): n is a, c, g, or t
  misc_feature (56)..(56): n is a, c, g, or t
  misc_feature (92)..(92): n is a, c, g, or t
  misc_feature (157)..(157): n is a, c, g, or t
agaagaagatgatgatgatgaataagtggttntagcgcagttttttttttnttgtntataaagcatttaacccccccctgtacacaattcantccttttaaagaaaaaaattgaaatgtaaggctgtgtaagatttgtttttaaactgtacagtgtntttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaagttgcagctgttttgttgacattctgaatgcttctaagtaaatacaatttttttatt

SEQ ID NO: 230081 - DNA, 469 bp, Homo sapiens
aagactcagcattttgttgcaagacagctacctcagggaagaccattagagtttcctagaacaaagcaagcttaacctcctcaaatgggggctacttttgctggcaataaaagactcagcagaatttaggggcttggtgccctcagcttcatcaggatctgcccatatatcctctttccaattttcaggatccattccttcccagtaagtgccctcactttaacagcagttaacctatgaagttgagaattcaatttgcattgtaattcagtcacttgtgaaaagaaactctgcgtttggttttcagaaatctcatctctgtgattattagacatgagagtttttcgaatacagacatagaaacctctaggtcatttatgcagtgcttggactggggatttaaattcctgagctcatccttttctttcaccacattgtccagtgcaattgggaataaacagtcaatctc

SEQ ID NO: 230082 - DNA, 984 bp, Homo sapiens
ccggggcacctgtctaaaaacaccccgcctccgaacgcgcgctcttgcggaattctcccgaaccgcatagcaaccgggggcagagtgcgagcccccagcggtgtgctgggatggaaaagcaggagccgctgaggatggactacggggcgtgttcccgaaaagccgggaagagatgtggcggggctgccgcgggcgtctctaaggccggcacgggtggcgtcttgactccctgcccctccagccgcggacctcggacggggggaagggggctcctccaagcggggagacggtcgccggccgagcagcagggctcctggccggcggagggtgctatgctctgcgggaccgccgggaagtcccagacaaggatctatgaaagataaaatgtggtgtgaggacacggcccagccccaccgtcgtcttccagccccaccatcgtcttccagccccaccgtcgtcttccagtcccaccgtcgtcttctagccccaccatcgtcgtcttggactctctgggtggcaccacgctgtgggtgctgctctcctctgtgtcccaaacgagtttgtgcctcactttgtcgggttttggctgtgacttggagcctcaccaagctcccttttcctctgtctcccattctcctctccaggccagggtggcttccccagccctcctccccgggtcctgcctgtgccgagccttcctcccaggagggaggtgatactgacttgagatcttatgggtgttttgtttgtggctgggcctggccgaccctctctccacggccttagatcacactctggatggataggacagtcgtcctcaatactgagcctctttggagcatacccactgatggtggttcacaagctacccacgcccacaggctgacccagatctccgtgaaattaaaaaatactgtgaaaggaaaaaagagccaatgtcatgtggataatgaagtgtcagccactgaaaaatctcaaaataat

SEQ ID NO: 230083 - DNA, 743 bp, Homo sapiens
tgggcagcaaagcaaatcatcgggaataacccgggagcctggcagggaaaccgctgcactatggagaggacgcttccagatacagaggacaaatcaagtgaagggacggaacaggtcacacccagagcggcacagaggtgtgtgagctgttcccacggtagtcagagcctctgttccaactgtcctcccgctgggctctctccggtccccagtgcatgggctggagtgtggcccctggcagagccctggaggccggctctgcttcctgcccccttccagcctggagcagcccgagggcgcagcattcctggggcaggcctgagccctgtggtgggctgagttgagtccccagaaaggtagattgaagcccaaactctctgtatgtttgaacgtgaccttatttggaaaaagagtctttgcagatgtgttcaggttcagatgaggtcatcctggattagggtgagtcctaaatccaatgctgtgaccttataattgggggatgcacagggagaggccgcatgaagatgcaggccaagactggggcactgctgctccaagccaaggagcaccaaggactgaagacgcccgcggggcgctgggcaaggtgcagagggattcttcctgggggcttcagaggagggtggtcctgcccacacctcacttttggacttctactctccggaactttgaaagaacacatttctgtggttttcagccacctggtttgtgggaatttgttatgg

SEQ ID NO: 230084 - DNA, 785 bp, Homo sapiens
cgctgggctctctccggtccccagtgcatgggctggagtgtggcccctggcagagccctggaggccggctctgcttcctgcccccttccagcctggagcagcccgagggcgcagcattcctggggcaggcctgagccctgtggtgggctgagttgagtccccagaaaggatctatgaaagataaaatgtggtgtgaggacacggcccagccccaccgtcgtcttccagccccaccatcgtcttccagccccaccgtcgtcttccagtcccaccgtcgtcttctagccccaccatcgtcgtcttggactctctgggtggcaccacgctgtgggtgctgctctcctctgtgtcccaaacgagtttgtgcctcactttgtcgggttttggctgtgacttggagcctcaccaagctcccttttcctctgtctcccattctcctctccaggccagggtggcttccccagccctcctccccgggtcctgcctgtgccgagccttcctcccaggagggaggtgatactgacttgagatcttatgggtgttttgtttgtggctgggcctggccgaccctctctccacggccttagatcacactctggatggataggacagtcgtcctcaatactgagcctctttggagcatacccactgatggtggttcacaagctacccacgcccacaggctgacccagatctccgtgaaattaaaaaatactgtgaaaggaaaaaagagccaatgtcatgtggataatgaagtgtcagccactgaaaaatctcaaaataat

SEQ ID NO: 230085 - DNA, 815 bp, Homo sapiens
tgctttagttgggtctgggggggtctctctggagagtggctataaatgctagcctttgtgctgggcagcaaagcaaatcatcgggaataacccgggagcctggcagggaaaccgctgcactatggagaggacgcttccagatacagaggacaaatcaagtgaagggacggaacaggtcacacccagagcggcacagaggatctatgaaagataaaatgtggtgtgaggacacggcccagccccaccgtcgtcttccagccccaccatcgtcttccagccccaccgtcgtcttccagtcccaccgtcgtcttctagccccaccatcgtcgtcttggactctctgggtggcaccacgctgtgggtgctgctctcctctgtgtcccaaacgagtttgtgcctcactttgtcgggttttggctgtgacttggagcctcaccaagctcccttttcctctgtctcccattctcctctccaggccagggtggcttccccagccctcctccccgggtcctgcctgtgccgagccttcctcccaggagggaggtgatactgacttgagatcttatgggtgttttgtttgtggctgggcctggccgaccctctctccacggccttagatcacactctggatggataggacagtcgtcctcaatactgagcctctttggagcatacccactgatggtggttcacaagctacccacgcccacaggctgacccagatctccgtgaaattaaaaaatactgtgaaaggaaaaaagagccaatgtcatgtggataatgaagtgtcagccactgaaaaatctcaaaataat

SEQ ID NO: 230086 - DNA, 576 bp, Homo sapiens
agagcatccagataagaactcagtccactcaacatcttcagctttgtgatattccaggcatattgtgctgaacttctgacttacagaactactgtacgcattgggcaaactagtttctgcggttacgctgtgcccacaaaggccttgtctccactcaagctaaaaaaaaaagaatccagaaagcctggaagatacttttccaagaatttattttctgtttagattctacccctgaaagtcagtcctgaaaggattataaaagcaagaaagaaacatggactctaagaattaacaacagtgtgggaagccacggaggagatttatgactaccctaaattggtttgtgtttggatggatgactatttcctgctctttattactagaaattggcagcaacatctcagattggataatggtactggtggaataattaccagaaagaaaaaaacatccccactaaagtgatgaaaacatgtacagattgtccaaccttttgcttttgtaccacttccccttccagatgtcagggttgtgatttatttctccctaagagtttaaaaataaaactctcatcat

SEQ ID NO: 230087 - DNA, 1254 bp, Homo sapiens
ggtcactcaagagggctaactggccaagaagtcctgctgtccaatactctgccttaccagcccttataaagagtgggggattatgctctgcctttaaggaaaactgacacccacgagttctcttacccacctttctctctgtgggtaagccctactttttcaagtcaatcatgaagcagacactcagaactaaagccagtgtttctagtcccttactttacattgtacattagccaaggcttccagcaggcgctgtacattagccagcaaacaggtagcatacacacaacatgcatgctgggcaaggctcagggcatctcttacaaatgtgttggaaaaatttcaaaaaccctacactgggcctcatctctaagtgagctgcactcagcagaagcatgcctgtgtgcataggcatgaggtgccatacagatgtgtcacagtggtttgatgcatcacatattccagaagcttccaaatacaggaaacctctccaagaacacatggtgagtggctggcttcccagccaaaaagtgcaagccagttctcacaagagctccaagaagtctgaagaatcagagagttggagaacctggacatgctgaggttccgtttcccattcaacacatagaaaaggcatctctaggccctctaaggccttcagaaattaaggaaactgccaaagactccactcccctactcctgtccctgccccactagtcagaacccagagaaataacagctgaagtcagaggacctagatgggagacccacgagaagcggctacaagcagtcagatcttggcaggattgactctcaggttcagttttaccaacgacaaggataagaccacctaccctctcagggttgtgtgaggaccaaatgagccagcaagtatgaaaagaactatgtgagctgatacgatggttattactccattcctctcctgcctgagtcctagcccagatcgctgtttgctattccatactggcagtggggtggcactcagctattattaatcccaggtaaacatcccacaaagcggcaagcagatagtgtcttggagaaaggtagctattttaaaactctacattctgcttagcagattgcacaatgtgccccctcagccccaggggctcctacccacacagccttgcagaagtggtgtacgtctgggactaacgctgccatggagaagctaggccagagtcccagccactcctagcccccatctggctgggagtgcatcgatcggct

SEQ ID NO: 230088 - DNA, 465 bp, Homo sapiens
gatcgatgccacccatgatatacaaagccaaccgtggactagtggtgtttatcgatgccacctaccctctcagggttgtgtgaggaccaaatgagccagcaagtatgaaaagaactatgtgagctgatacgatggttattactccattcctctcctgcctgagtcctagcccagatcgctgtttgctattccatactggcagtggggtggcactcagctattattaatcccaggtaaacatcccacaaagcggcaagcagatagtgtcttggagaaaggtagctattttaaaactctacattctgcttagcagattgcacaatgtgccccctcagccccaggggctcctacccacacagccttgcagaagtggtgtacgtctgggactaacgctgccatggagaagctaggccagagtcccagccactcctagcccccatctggctgggagtgcatcgatcggct

SEQ ID NO: 230089 - DNA, 269 bp, Homo sapiens
caccttgggcacatgttctcaggacctcttgagactatgcctcaggccagggtcactcattttggttttttcggctccaaataaacctctttaaaaaagtttatttgtctccaaataaacttctttaaatattttatagcgtttgactctctttgtcaataactcacaagaaagtaagataattttcaaagacttaacagacaaacaggaaggtgaactcagagatgtaatgataaacaaaatataacagcagcagcacagggcagggg

SEQ ID NO: 230090 - DNA, 413 bp, Homo sapiens
acaataaagacgataaacagattaacgggaaaccaatttattaacatgcaagtgtgtaggtgtcacacaaagtttgaaactcaaacaaagaccaggtggttgaagcttaaatagcctcttcatacgagagtgagaaatgggagatgtaggaaattttagaggaagggtaaatgatgtttaggggagattaatggacccaaagaacagacaatagcctgggaccaattctgtctgggctctgggtgtggtgtcaactccagtcttccttcctacaactatgcatcagtttctcctggttgatgagatatctggggaagggattcacaacagttgaatatcttctggaggatccagcctttaggtagacaggtgaactttagagaaagctcttccctgcatttgctgctccccag

SEQ ID NO: 230091 - DNA, 452 bp, Homo sapiens
agaatccattattattgcttttttaattattaaaaaaagatttaaatcataaataatttaaaataaataaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctgga

SEQ ID NO: 230092 - DNA, 164 bp, Homo sapiens
caaatgacatctaaggatatttaggacttagtcttttcatcataaaagtttctagggttaggtaagtttggaaaatgaagtttaaacgatttatttattgcaggtcttctcacaaatctccaagaaaggtctatagtatggagtagttttccagattcatttga

SEQ ID NO: 230093 - DNA, 369 bp, Homo sapiens
ctttttattgtttcaccttatcctgtaatttaacattgtagcttttatagtactttgtaattatgtgtttatttctctgcatctaactctcctcaaggcactaaattgatatttagagtaaacataggcaccatctctgctgtgtcccccttccatagtgattgtctttactttccatcccttagttgaaaattggtaaagggaaaatgaggaaactctaagaatcgtgtcatatttaatgaaatcttcaagtggcatcagatgctagttgggaacaatgacttacaaagtgcagtaaacacatcacatatccatgggtatatggtggcagctagagtgatgtgatctagctttttctgtgatacccag

SEQ ID NO: 230094 - DNA, 236 bp, Homo sapiens
atactaagtgacaatgtttttttaaacaatagtcagtaaatccttttttctccaggtgtaacagttccatctgttactcatctttcaaattcaaagttagtaaaaggaagatacagatgccaaaataaaccctagctctaggtattagagtaggatcaatggatatttctgaagaagcttcagggttcttttattaataaactgggcagcatctcatagtttggcctaacaggaaa

SEQ ID NO: 230095 - DNA, 887 bp, Homo sapiens
agtggtccacatctgtaatctcagcacttgggggagtctgaggtgggaggatcacttgagcccaagagttcgagaccagcctgggcaacatagcaagatgcaatctgtaatttttttttttttttttttttttgagacggagtctcgctctgtcacccaggctggagtgcaagggtgctctctcggctcactgcaagctccgcctcccgggttcatgccattctcccgcccagtctgtaattaatactaaaaaaataaagtcatcttgcacactgacaagtgtcacgaagaaaataaaacaggaggatgtgttgagaaaatgactaggggagctacttcgggttttttactttttccaatttttaaaattttgatttatttaattcaggtagttttgaatgggtaataaattcacttggtttgaaatgcaaagagtgcaagatggcatacaatgaagtctttctctatccctctcacacttcagccactcaattttccgtggtgggggaggtggcttttgaaacaggggaatcaggaaaggtctctgaggaggggacagttgagcagagacctgacagagaagagtcagctccgcaaataccccaaagagtgttctaaggcagagggaacaatcagtatgaaggcttagaagcaggataaaatttcccccctttttttttttttttttgagacagagttttcactcttgttgcccaggctggagtgcaatggtgcaatctcggctcactgcaacctccgcctcctgggttcaagtgattctcctgcctcagcctcccaagtagctgggatgggaggtgtgagtcacaggcccagcgggaaaacattttctgtaaaagttcaaataggaaatattttagatatcgcag

SEQ ID NO: 230096 - DNA, 559 bp, Homo sapiens
atttcctttaggccaaagagaagagatggccttgtttgttttcctagtgataagagtcgaggattaattgttaaatctctttttgaagactgagagatgccagggcaaggtggctcatgcctataaccccagttactcgggaggctgaggcaggagaattgcttgaacccagaaggcagaggttgaagtcagccaagattgtgccactgcactcccgcctgggtgacagagcaagaatccaccaaaaaaaaaaaaaaaaaaaggaaaaggacttttagagggccaggcacggtgactcacacctataatcccaatattttgggaggccaaggaaggaggattgcttgagcccaggagttggagaccagcctgggcaacatggcaaaatgccatctctacaaaaaagtacaaaaattagcgtggtggtgcacatctgtagtcctagctactcaggagactgaggtgggaggatcacctgagcccagggaggtcgaggctgcagtgagccgtgatcgtgactctgcactccagcctgggcaacaagaatgagaccttgtct

SEQ ID NO: 230097 - DNA, 481 bp, Homo sapiens
aagttgtgtgttttcaaagagcctgtcttcaagctaattctttagcttgatcaattctattgagagattgatgcattctttagtatgtcagttgcgtttttcaactctagaatttctgcttgattcttttaaattatctcaatctgtttattaaatttatctatgaatatagaattctgaattcccggccaggtgctatggctcacacctgtgatcccagcactttgggaggctggggcgggtgatcacttgaggtcaggagtttgagaccagcctggccaacacggtgaaaccccgcctctactacaacatacaaaaaaaaaaaaaaagtagctggacatggtggtgcgcacctataatgacagctacttgggaggccgaggcaggagaatcgcttgaacccgggaggcggaggttgcagtgagccgagattgtgccaccacactctagcctgggtgacagagcaaggctccgtctgaaa

SEQ ID NO: 230098 - DNA, 507 bp, Homo sapiens
aatgtgctttattacccaggggtacagaattatagctgctgcataaacagtgtatctttctgatccttatacttccaacacaccttagccatgcctacattgtgtttctctgaaaatggatataggatttgcaggaagtgggcagatgagtcccttctgactgctaaaagccctgatggagtagcaaggcatctgaccaggactttctgataatcctttatttactcgttcaaatgccatagttccactgtcctctccccatattccacagtaggaagaaaatatgtgaatgcttattcagtaactatgggttaaaatcataagtttctagctatatttaataccaatttagatgcattccttttatgtgtatgacaatattctatcatgtgttgttagatttaccgtcacacactaatgaaataaaaacacagttttctaaattgcaaaaaagaatagctcaatcataaaaataatagaaaaataaataaatattaaaatctaaaa

SEQ ID NO: 230099 - DNA, 418 bp, Homo sapiens
tgctgtgtgtgcgatgagtctggggaagctaacacatgccttctgaagtggctagaatacacactcccacgtcacagccatgctatgatgaaggggtgagaagcagtgtcccctctgaggcaaatctctcttcaggcagccccgcagtcctcttccgaaatctcattcttttccctctcttcctccccaaaaagcccaaactcattgtcagagtggggagaggggagaagcagcatcctgactcctgtccatggtgtgaaccctgagggcacgggacagtgagtggagctctgccaccacccgtttccagagcatgggtgaggagggagggatgccgacctgttaatatttgcttcagacctttccccgatgaacgaaatctccaaaagccttaaataaacataaaatggcttagtca

SEQ ID NO: 230100 - DNA, 578 bp, Homo sapiens
aataatgaaactaaaaagagttcttggaaaagttagttaagataaagctctaattagactaatccagaataagagagaagacactaattaccagtatatttaataaaataggagacatcactgtcgatcatatggacattaaaaggccttttaagagaatatcataaacagctttaagccagtaaattagacaacttagttgaaaaaaataaattctttggaaaacacaaattattacccaggagcaatagaaaattttagtatccctatattgattagagaagctgaatttgcaattaaaaattattccaccaagacaatgtgaagcctaaatggccacactaataaattttatcaaacttcaagaaagaaatattgtgaatcttatgtaaagtcttccattaagaaaaaaaaatgagaatacttcttaactcattttattataacaaattggtaactaccattgttactgtgatactaaaattcaacaaagataacagcaaaacaaagaatcagtattcttcatggatatagatgtaaacattttaaacaaaatttgagcaaattaaattaacgat

SEQ ID NO: 230101 - DNA, 418 bp, Homo sapiens
gggtgggagatgccaactctgattgaacgatgcctgcagaggaatcaaaggtgccacacagggcaatcttctctctgttttctgcacagcggagctgcccaagccctcggtcactagcaacaactccaaccctgtagagttttctacatataagtttaagttatctgtgaacagagataattttacttctttccgatttggatgtctgtttatttgtttgtttgctgcctaatttctccagctaggacttaaaatactatgttgaagagaagtggggcaagcaggcatccttgtcttgctcctggtcttacagggaaagctttcagtctttctccattgagtatccctctattatgttgaggtggtttccttccattcacagagtgtttttatttataaaagaatgttgaattttgtc

SEQ ID NO: 230102 - DNA, 297 bp, Homo sapiens
atcaaaaccatcccagggctgggtgcggtggctaacgcctgtcatcctagcactttgggaagccgaggtggaggatcacttgaggccaagagttcaagaccagatggggcaacatagtaagaccctgtctctatgacaaaaaaaaaaaaaggtaaaaccatcccaaagttgacacagatgtgagaatgagcagaggtgggcattgaagcagtcgtttttgctgtattccctctgttcagaagttaagtagaaccacagctcgatgtcccctcaggctcattaggatggttactattc

SEQ ID NO: 230103 - DNA, 189 bp, Homo sapiens
tctgtctctttctttctttctgtctctgtctttgtccctctctctccctctctgcctgtctcactgtgtctgtcttctatcttactctctttctctccccgtctgtctctctctctctctctccctccctgtttgtttctctctctccctccctgtctgtttctctctctctctttctgtctgtttctg

SEQ ID NO: 230104 - DNA, 421 bp, Homo sapiens
agcaggccactagggagtcgggagagctcggtgatgtcacgaggggcatcagactcttccctgcaggctggcgggactgatgggctctcgttccaatggaggtacaatgggacttccggggctgtgatgggaagggcggaggagctgccgatggtcccagtgccatattagtgtcacattctgaggggcagccctgtgccggacggcagctgctacctctccctctgcccctttattacttgaatctcttcgttgtgccctgtctaggcacggtcgtccgacagcaggcagcccactgccctcccagagctcactgtctagcccagggtgacacagggtaaccgtgggcatgacttgggccgggaagtgagaggctcgattccatcacatgtaaataaaaatactcattttcaatctaaca

SEQ ID NO: 230105 - DNA, 369 bp, Homo sapiens
tataattgtgtagtcaagtggtattcagtcttctctgttgagtgattatggttgagttagaaaatggcagtgacctttgacagcagaagtgaaatggctgctgaacgtaccatagcaagttgttggagcaggaagttggactcacagagaagtgctctttccattaccccatgctgcctcccagtgggaaggtggcaatggtgttaggatgtaatctcataagttactatcttttcttcccactggacaggtggctcagaattttaggatgacttattaacttaacaatgttgggtttagcatgcaatttgagaactaaatgacttctcttcaggaaaaattaaatattttgttttatttatttcaacc

SEQ ID NO: 230106 - DNA, 193 bp, Homo sapiens
ggcttaaccaccctgagccttagattcctcaattgtaaaatggaaataacagcttcttcaaaagccaatcaaggttgggtatagtggctcacacctataatcccagcactttacaaggccaaggcaggtggattgtttgagctcaggagttcgataccagcctgggcaacatgctgaaaccccgactctacca

SEQ ID NO: 230107 - DNA, 540 bp, Homo sapiens
tactcttctgacatacactttaaagttctaaaagtaagtgtatttatataagattatagttctagacttaaactgaggctaattaagagaggcatagcctcagaactttttttccaacaaggaaaatttcatatccatgtaattccagtacctgtcttgttgaaggggctatattaatcccagggataaaaattagaccattttaaaaatggataggctgcatatccttctgacagtcacttatgaagattttttttcttaaaacttttgatgagagctgggctacaatttgagattctattttctgggaagatcagagtggcagataatcagtgttactaatctaagggcagaattgtatatgcattctctgcagtacccccagtttctaataataacatacatctgactttgactttttttttctttaaaaaaaaaaacaactcttggctgggcatgatggctcatgcctgtaatcccagcactttgggaggccaaggcaagtggaccaccacctggggtaagagttcgagaccagcc

SEQ ID NO: 230108 - DNA, 571 bp, Homo sapiens
aattatgcaagaagaatcatttctagagattcactataaaaggcagtgccaatagttaacaatgcagtattgtgcactaaaaaatttaagaggggctgtgggtggtggctcacacctgtaatccggcactttgggaggcttgggcaggaggattgcttgagccctggaatgcaagaccaagctgggcaacatagtgataccctggctctacaaaaaactttaaaaaattagctgggtgtggtggcatgctcctgtagcccaggaatttgaggttgcggtgggttgtgattcaccactgcactccagcctgggcaacagagttagatcctgtctcaaaaaaaaaaaaaaaaaaaaaaatgagagaggacatctcttggtaagtgttcctaccacaaaagtaaacaaaaaacacaaaagaatgtcagaaaacttttggagataatggatatatttatcatcttgattgtgatgatgatatcttggataaatgaagatgtccaaactcatcaaattgtatacatcaaacatacaattttttgtatacaattatacctcaataaatctgattttt

SEQ ID NO: 230109 - DNA, 343 bp, Homo sapiens
ttatccctctgaaacacaattgctttgaggcttagtgacttagaggtaacaaaagttgtttgctcactcatagcacccacctgcattcttccacaaagttaattctcatcattcagtagaaaagccaaacaagaaatggatttgggacaaacaatagatcactgtgaaattcaatagcagatgagtataaaagaaaaaggcacttaatctatttcctgtcctgcagggtgactttaaccaatagataatctttcattaattctggaacaattatttactcttctgccatgtgtccaacactggactagatactaggcagaatgaaatggaaatcaccacatgg

SEQ ID NO: 230110 - DNA, 465 bp, Homo sapiens
gattccactcttgacccttccaatctattatttcatagcaactaagaaaaatgtttaaaaatataaatcaattgatatcacttccttcattaaaacctagcttcccattgcacatagaatgaaatcccaagtccttcttgtggactaaaagacttctcccacttctgttttaactcactgtacccttcactcacggtactccaggaaccttaatgtcctctctgttcccagaatggatccagcctgtccaggcctttgtgcttgctcttccctcttcctgaatattctgacctggctctgtgtgtgtctacttcctcctcatctctcagatctcctttgcaaaagggcttccccaatgatttaatttaatatcatcttttcatgtaccccaaatgtcattctctagcactgtattctgtttatttccttcatagaatctacagtaaattctaatcgtttcaggtt

SEQ ID NO: 230111 - DNA, 377 bp, Homo sapiens
cttcagagtgtaaagagctagaaggatgaccaacaggagagaaataagtcagggagagaacaaaaagttcatctagccagggaggcttgtaggtaccagttttcttggcctagaattttcttctcctcctcatatgctgaacaaactcctactaatcctttaacattcaaattaaatatcagctctgtgaaatgttcctcaattctgcctcctaaatataacatattgtttgtttttacagattaaaatatataatagaattgtatgattttgtacataatttttaaaactctttatttcttacaagttaacaggatattcttttgcatatacctgaatgtgttaaaatgtctattaaataaaatgtttggatacat

SEQ ID NO: 230112 - DNA, 275 bp, Homo sapiens
ggattgggtcatatggtcacctatagctacagagaggatgagagagtgagtacctgaaacagtgattggaataaacctaaccatgatctactgctagagaggtggcacttagacagagtgatgatgcctaaacttctagaagtagagttatctggctcctctaagacctagactaactgtaggtcattgataagccaaacatctgattaagaatcacattggaagacttctcatcatttttgtctttgtaaataaaggacccctatctaacttta

SEQ ID NO: 230113 - DNA, 379 bp, Homo sapiens
ccgtatctataggaagagcaatttggaagcctgtggtttgggacaggcatgtggggtggggagtatctttgaagcccctaaagttgtatgaaaagcattaatttctggggagaacatctctagctttgatcagatcctcggatgggtctgtgatcccaaagggtagggaagcttcttatatgattccattcactaagtgcccatgatgagctggtggcaggcatcctagaaccttctgtgagctagcccctaccccatacctccagctagtctcagccttccccccaccttcaacctgcaccccacccagacagaagcacctgcaactctctcagctacactctgctgctccaagccttattaaagagaatgtgtgtca

SEQ ID NO: 230114 - DNA, 816 bp, Homo sapiens
tactggttggcctggtgaaaacagcttagccatactgacctcatcttagccggtcaatgatggatgaataatgctgtcatataggccatttcctctctcctgtgtgcacaccactgagtccaattggtcagaaaccttccgactttgtggaagtggtttgtggtcaaacccagcagttcaaacagtaaattttattgaaatgtcttgccttgacagtccagttttaatagttaacccaaactcaaatgaagttgtctcttcttccttgaacccatatggctctcattaaacctttaagattatgttcttattacaaagggaatgtaaatcatgctggatctctagatcttatgttttatcaatatcttgaaacttaattcaaaccaccctttataaaagagaagggaaaacacaatttcagacttaatagccttgtagttacatgttaatttttaatccccaaatttgagttgcctttgataacacttatccctactatgaatggtcatataactaattattattaaaaaggtttcagaaccagtgttctaaggaagttgtaaggataagataatttcagatgataaaaaaaaactgatgaaaaggattaaactttctaataaagttactagagataaaacaggtatagcaatatctcaccaaagcatagctctcacccccaagcccacccccccaaataaaagatgataatggccaatcactttcaataaaacttttaaaaaataaaaaaacctctttagtgcagttagctttttaggccttatggtaagcaacacattgtaaggaaacacatta

SEQ ID NO: 230115 - DNA, 183 bp, Homo sapiens
atttaaatacaaaatgtgttgaggcatttctatggtttgaatgtgtcccccaaagttcacatgtcagaaacttgatcctcaatgcagccgttttgagaggtgtttaggccatgacggctttgcatgaatgtatgctgatattgtgggagtgggttcattattgtaggagtggattccttatta

SEQ ID NO: 230116 - DNA, 329 bp, Homo sapiens
caggctagagtgcagtggcacaggcttggctcactgcaacccctgcctcctgggttcaagtgggtcccagcctatctaggattataggcgtgtggcaccatgccctggtgattttttgtacttttagtggctaacatggtgaaaccctgtctctactaaaaatacaaaaatgagccgggcatggtgggggggcaccgtagtcccagctactcgggaggctgaggcaggataatggtgtgaacccgggaggcagagcttgcagtgagccgagatcacgccgctgcactccagcctgggcaacagagcgagactctgtctcaaaaaaaaaa

SEQ ID NO: 230117 - DNA, 489 bp, Homo sapiens
ggcaatatcacaaggagacatgtatgaggttgtttactgcagcgatacctgtaatagtgaaaaccccaccagttgggagtaagatgtagaatatcatatacatcttacatgtcatacctacactcgataaaagttaagatggattagaactacacgttttaacacgaatagatctcaaaaatatagtggtcgatcaaacaattgccagacttttctgtgtatggtatgagtcaatttgtataatttttttaaaaagcccatctaataattcatacgtatgcagtaaatacataaaatcatggaaaccacacactggcatcatggggataccagtggcttggggataggaacgcagggaacttcacctctgttgtattgcatttcttaaaaagtgatgttggccaggaagagtggctcacgcctgtaatcccagcactttgggaggctgaggcgggaggattgcttgagctcagaagttcgagaccagcc

SEQ ID NO: 230118 - DNA, 289 bp, Homo sapiens
ataaatgaagatgctgttaaatgtcttttccaaattttagtttctgtgattcattctaggtctcatgaagaatgagatactttgcctcaaggaagatataatttggtggatttatgcacccaaacgctatctgaatcccactagcatgctgctcgatgagcattttaaagatctcataggctgggtgcggtggctcatgcctataatcccagcactccaggaggccaaggcaggcagatcccttgagctccagactagcctaggcagcatagcaaaatcctgtctctac

SEQ ID NO: 230119 - DNA, 629 bp, Homo sapiens
caagttctgatggaacaggttttgatcagagttctgtgccagctgaactgtcttcaaggatgaaggcaaacagaagcttctcaagatgaggagaaaggcagctggtttaccccccatgcccttccacatataagccccagcccaggctgcacgcacaccgcatttaggatgcatgcacagagtttgagagctgcttgtaattaagcaggggccaaggagaaggcagcatagatcgggggacaggggcttccaaggcaacgcagagcagctgcgagacaagaagcaggtgaaaacgcctgtgcggcagtcgctgctgggtggattctcctaagcacaggttttcaggagctggaaccacatttcctagtctgtgggttcaatcacactctgaggttcctcagggaatgacccccacgcaatgctaacatcggcttctttgttaatttccaacgtgtagaatgagtccattgacaaagggccgtcaagcgatttttggttgttccacctggattgcagaggccctcaaccttgaccgtggagctcccaaccctgatcgtggagctgtgagcctgggcagcagcctgagtggggaagggtggagggggggtcatttcttcaccctctgtgct

SEQ ID NO: 230120 - DNA, 299 bp, Homo sapiens
gtgggaggatcatttaagcccaggtgttcgaaaccagcctgggcattatagtgagaccccatctctacaaaaaactgcagaatttgctgggcatggtggtgcacgactgtagtcaccacagcaggaggctgcatgattgtgtcattgttataagtaaataaataaatgggtaacctgtaggggatatgaattatatctcaataaagctgttaatacaataccaaacaaacataattagcaactacccaggtacccatgttgaaggaaaaaaaaactgtaaaatatccaagaatattcta

SEQ ID NO: 230121 - DNA, 399 bp, Homo sapiens
cttattaacatagagagtagaagaatggttaccagaggctgggatgagtggtgcaagcctgggaaaggaggtggggatgaataatgggtataaaaattgtagttagaatgaataagacctgctatttgatagcacaacagtgtgactatagtcagtactaacttaattgtgcattttaaaataaaaacagtgtaactgcatcatttgtaactcaaaggataaatgcttcagggaatggataacctattctccatgatgtgctaatttcacgtttcatgcctgtatcaaaacatcttctgtgctccataaatatgtacacctactatgtacccacaacttttttaaaaaattaaaatatatatgtgtatgtactaataacagagcttcaaattcaatgaa

SEQ ID NO: 230122 - DNA, 276 bp, Homo sapiens
ttttagatgggttagtggcagtgtttggtgatgtgggtggtgggcaaatggtaattttagatgggttagtggcagtgtttggtgatgtgggtggtgggcaaatggtaattttagatgggttagtggcagtgtttggcgatgtgggccgtttcgtttatgtccttatactcgacatgtttccaaaaaaagtacaaactttttttttcttttaccttaactttggtcagtgatggccatttattaatttccactcagtctgaaggagggaagatggca

SEQ ID NO: 230123 - DNA, 422 bp, Homo sapiens
aggtgcagtggctcacacctgtcatcccaacaccttgggaggccaaggtgggtggattgcttgagctcaggaggtcaaggcaacatggcaaaaccccatctctacaaaaaaaaaaaaatagctggacatggtggcatgcacctgtagtcccagctagtcaggagtctgaggtgggggtttgattgagcatgaggttgagactgcaattactccagcctgagccacagagtaaaaccgtgtcacaaacacaaaaaaattgcagctttcggaaggctcagatgactgttggcacttgttaacaataaagtatttgtaaattaaagtgtgcacactttgtagacatatgctattgcacactttatacagcacagtataaacatacttttacatgcactggaaaaccaaaataaattgtataactc

SEQ ID NO: 230124 - DNA, 115 bp, Homo sapiens
ccaccccccaaccccactccccacctctcctcttagagggagacgggttctcaaatgaccccctttcctgcgtagccagccagtgttcagtttgtggagttacgctgagtttgca

SEQ ID NO: 230125 - DNA, 914 bp, Homo sapiens
cccccccccaccagccagcggcagcaacctgcgtgggtccctcaccttgtgggatctttgttcttttgctcttcacaataaatctccttgctgctcactgtttgtgtcagtgtcatctttaagagctgtaacactcaccaggaagatggagtctcgctctggcatccaggctggagtgcggtgtcgcgatctcggctcactgcaacctccgcctctcgcgttaaagcagttctccagcctcagtctcccaagcagctgggattataggcgcctgccaccacgctgtggcttcctttttgaagtcagcgagaccacgaacccaccggcaggaaccaactccagacacactttgaccgtgaagttggacggactagcgaagatccggactgctcgggaagctccatccgaatgtgtctgccccccagggacccctggacggcgcggcaagcctgggagaagaggcgacctggtcctccaggaaccctgggtcggatggcaagcccggacttccaggcccgaacaggggaaaagggtgcaccaaggagactttggaccacgggggagaccaaggacacgatggagctgcatgggcctcacggggccccatggaacctcctggggcccggggacctcctggcgacactgggaaaagatggccccaggggaaaccacaagggccagagggccccaaaggagagccggaaaagacggcgagatgggccaacgggaccccagggcccaagagtgagcatggagtacctggacagacggtgcaaccatggggacacgaggccagcccgtgccaacagtggacacaggcgcgccatggagcaggaggcacggggagacgaacggtgtggccggtgtccaggccgcaggggcacggacccggaggcccgctcgcctgatgggcg

SEQ ID NO: 230126 - DNA, 767 bp, Homo sapiens
cccccccccaccagccagcggcagcaacctgcgtgggtccctcaccttgtgggatctttgttcttttgctcttcacaataaatctccttgctgctcactgtttgtgtcagtgtcatctttaagagctgtaacactcaccaggaagatggagtctcgctctggcatccaggctggagtgcggtgtcgcgatctcggctcactgcaacctccgcctctcgcgttaaagcagttctccagcctcagtctcccaagcagctgggattataggcgcctgccaccacgctgtggcttcctttttgaagtcagcgagaccacgaacccaccggcaggaaccaactccagacacactttgaccgtgaagttggacggactagcgaagatccggactgctcgggaagctccatccgaatgtgtctgccccccaggtaagtgaaggttgagctcccttctggctcctgcgttcggccgccgtttgcttgggattgctgagaacagcatggtccggaaggtggactggggtgtcaggctgtcgtcttcgtgcactggcctggggcctttctttcccacattgaccctggcaggctctctggtcggtttccagcaaagtaaacggactcggtttgctgggtggtattggtggaggagctaagacattgtcggagatgacttagctgcctgaagatttagatggtagggaagtagcagctggcccatttcaaagatggagaaaggggtgtgaactgatgggaggtgacagcctggaaccc

SEQ ID NO: 230127 - DNA, 1801 bp, Homo sapiens
  misc_feature (491)..(491): n is a, c, g, or t
  misc_feature (545)..(545): n is a, c, g, or t
  misc_feature (921)..(921): n is a, c, g, or t
  misc_feature (1255)..(1255): n is a, c, g, or t
  misc_feature (1672)..(1672): n is a, c, g, or t
  misc_feature (1674)..(1674): n is a, c, g, or t
  misc_feature (1677)..(1677): n is a, c, g, or t
  misc_feature (1679)..(1679): n is a, c, g, or t
  misc_feature (1688)..(1688): n is a, c, g, or t
  misc_feature (1692)..(1692): n is a, c, g, or t
  misc_feature (1694)..(1694): n is a, c, g, or t
  misc_feature (1713)..(1713): n is a, c, g, or t
  misc_feature (1716)..(1716): n is a, c, g, or t
  misc_feature (1719)..(1720): n is a, c, g, or t
  misc_feature (1723)..(1723): n is a, c, g, or t
  misc_feature (1727)..(1727): n is a, c, g, or t
  misc_feature (1732)..(1735): n is a, c, g, or t
  misc_feature (1746)..(1746): n is a, c, g, or t
  misc_feature (1748)..(1749): n is a, c, g, or t
  misc_feature (1751)..(1751): n is a, c, g, or t
  misc_feature (1754)..(1754): n is a, c, g, or t
  misc_feature (1759)..(1760): n is a, c, g, or t
  misc_feature (1780)..(1780): n is a, c, g, or t
  misc_feature (1784)..(1784): n is a, c, g, or t
  misc_feature (1793)..(1794): n is a, c, g, or t
  misc_feature (1796)..(1796): n is a, c, g, or t
  misc_feature (1801)..(1801): n is a, c, g, or t
tggcggcacataaaataacatgccttataattgatgtgtcttaggttcagtcaaatatgggatgaaaaggaacactgtattcttaagaccgcatctttcagcgacgcctccttccatgtgagttgagtcctggggtgctcctcagctcccccacccatgtggaaacaggcacagaggccacagggagcaggaggccccagggagcagagaccccaagggcatgagggataagcacaaagtcctgggccaagggtgcccaggttggctgagccctaggcggacaggtcaggagcacggtgggcagtgggtgggacaggcccctaacagagcccctcgggctcacatagtaattccattgctgggtcagccacgttcccaaatcgtacatcagacaatcttcccaccaaccctcgagtgtgaggatgttttgtttgtttaaaacccacatttggccgggcgcagtggctcacacctgtaatcccagcactttnggaagacagcgatggaatgggagggttctctggagacctggggacaggcctgangttgtctgagccccaggggctggtcttcgatgtggaccccagagggtttcctgatttatccatgagcttggacctgctgtgctgaggacagaggggcagtgttcggtctccttgggtagcgtcttcaccctgtgaccccttctccatcttggcctgcgcagggggcccaatcaacagaacccaacactagccgggggggtgtaaaatccaaaaagaacctttgcaatatcggacaactggtgaacactgccagcatgagcatcttgtatattttgaaccaactctaccagcccattttctagttgctaggatggtcacctccaaactcatgggggttgttgaaaggattcgatgtgttaatacatgtgaggcgctnagaacacagactgggaaggggataggctttatataaatggtggttattaccatatttcctctaaatgcacattgttttcattttcatatctctggagtcagaatgtattttgtggattaaatggcagcattttttttttctttcttggcggcacataaaataacatgccttataattgatgtgtcttaggttcagtcaaatatgggatgaaaaggaacactgtattcttaagaccgcatctttcagcgacgcctccttccatgtgagttgagtcctggggtgctcctcagctcccccacccatgtggaaacaggcacagaggccacagggagcnggaggccccagggagcagagaccccaagggcatgagggataagcacaaagtcctgggccaagggtgcccaggttggctgagccctaggcggacaggtcaggagcacggtgggcagtgggtgggacaggcccctaacagagcccctcgggctcacatagtaattccattgctgggtcagccacgttcccaaatcgtacatcagacaatcttcccaccaaccctcgagtgtgaggatgttttgtttgtttaaaacccacatttggccgggcgcagtggctcacacctgtaatcccagcactttgggaggccgagattgggcggatcacgagatcaggagttcgagaccatcctggctaacacggtgaaaccccgtctccactacaaatacaaaaaaaaattagccaggcgtggtggtgngngcntntagtcccanctantngggaggctgaggcaggagnatngcnngancccnggagnnnnagctgcagtgngnngngancgtgnnactgcactccagcctgggcnacanagcgagacnncntctcn

SEQ ID NO: 230128 - DNA, 625 bp, Homo sapiens
gaatcacaagcattgaacattcctggactccagtagattatttgcttgtctgcaaccagtcggaagtcatcagtaaatatcagagaacagaaccagcggtggtcttccatttactttttttactcttggctgcattcaggaagaaatttgataagtactctcatattacaagggttgagttgtctttgtagttttaatttgaggccaatatctgaggcctagaattgcacgagcagaggctagagggcatgtggcagaatttattgtggtgtgcagtttgcagttattgctttggtctttttcccagttggaagtcctaagcaataggatggcacatttgtggggaaagaacactgtcctggcattctcagggatcttcggggttttaaaatttggttcatatccactgctgttacttacgcaaaaggcaaatatttgtgctttgtaacaagttgatctggtagcatggcaattctctggcttacctctccaaagatgactttggacttcttgagaatgatgattaaattacagtcatttttctacttgccagtccccaaacttgccatgtgctaggtagtcccatgccttcgctcatgctttgccttccacttgcctagccttg

SEQ ID NO: 230129 - DNA, 437 bp, Homo sapiens
acaggggaatataaaatcaattatatgtctacataataataccaaacaatttctaagtaaaaatttaaattatattacttcaaatactattaaaaacttgaagatttagggataaatttacaaaaatatatccaagacctttacattgaaaaacataaaatatcagccgggtgaggtggctcatggctataatcctagtactttgggaggctaaagtgggaggatcacttgaggccaggacttgcagtccaacctgggcaacatagtgacaccttgtctctacaaaaagtaagcactttagccaggtgtggtggtgtgcacctgtagtctttccagcctactcaagagcctgagatgggagaatcacttgagcccagaagtttgaggttatagtgagctgcaatcattccacagctctccagcctgcgtgacacagc

SEQ ID NO: 230130 - DNA, 1146 bp, Homo sapiens
ctgtgtatgttttatattttaaaaaatctatatatatttaaaatctaaatatatttttaaaaatctcagttttgttttaggaaagtgttttttctcaaaatttaagcccaaatgataaaatctgccaaatagaaaactattttaaattgataataacagtatagtttcatcaaaactaaaaataccagatcttttgatgtatttgtttcctagcagagaattaagttttcacgttcttactgttggcctcctagatatcatgtgagcatgtcttaaggaaaaatgctcttaatgccactgtggtttctaccttcatgtgcaaatagaagagagtggtggtttgtaataggccattctttccagagaaaagttcatgtgtatttctgtatatgcagcatcctccttattatgtttggatgtaaagatttattattctctctgatgttttcatattttttaaatttacaatataataaagaggtacagagttctaaatcaataaaagatgggctataaaatggaggagtaaagttgatatatgaaccatcattgtcaacattttagatttgattttaactgtaaaaagcacaaatgatatgcatcataaaacagccttaaactgaatgtccacttggtgtgttgcactttaccaggcacttaaaatatcagtcctgtcacatagcaacagaaacccacagtggcacgtttaaaaatgggtaatcaacgtattgattttgatggagctttttcagaaataactgctattttaatttaacttataaatagaatacaatatcaagttcaaattaagggaggaaatcatgctgtaaatatactggattgaaaaacatggttctggccaggcatggtggctcatgcttgtaattccagcactttgggaggctgaggtggttggatcacttaaggtcaggagttcgagaccagactggccaacatggtgaaaccccatctctactgaaaatacaaaaattagcccgcatggtggcatgtgcctgtaatcccagctactagctactcaggaggctgaggcaggagaatcacttgaacctgggaggcggaggttgcagtgagccgagatggcgctactgcactccagcctgggtgacagagtaagactccatctca

SEQ ID NO: 230131 - DNA, 139 bp, Homo sapiens
tgcctcatagggaccatgtgtgttaatgctatgtgtgtgtgtgtgtgtgtgtgtgtgtgtgtgtgtgtgtgtgtgtgtgtttctgataatgcttggcaccaagtaagcaatcagtaaaaatgaagggggaagcaagagg

SEQ ID NO: 230132 - DNA, 286 bp, Homo sapiens
atttgatatatattggacaaatgatatcaaatgatatatttgacttaggaattataaccacagtatgtaaagaacatccaaaactccattagaaaacaagcaatccaatttaatgtccaatttaaaaaaattggcaaaatatcaggacaagaaagtcaaggaagagataagaatggcaattaagaaaatgaaaaaatactcaatgttgttagaaactgggaaaatgcaaattaaaagcaaaataatatatcattacacaataattagaatagttcagaaacttctt

SEQ ID NO: 230133 - DNA, 1242 bp, Homo sapiens
atggcatgaacccgggaggtggaggttgcagtgagtcaagatcgtgccactgcactccagcctgggtgacagagcgagactccgtctaaaaaaaaaaaaaagaaagtcacctgttaaagattacacagcaaactgccagcatccaaagcctgtcctcttccctcttccatttgaataggctccttccagccaacattcatgtatattctatccaggctccaccttccccttggaaactgcagctgtgtttgctgaaaaggcaagtggggacagcttgtttcctcccaacctcaggtaccttcctctccaactgctgctcctaaatctcagaatatatggtgttgcttgcttctcctccgaaccgccccctcccctcagggtggggatagggcatggaaatggcctttggaagttaatgggattcttggggtcagattggattctccagaaccttggggaaaggaaagtcaggtttctagtaaataaataacatcctggaatggccctagcataggctatttgtaggaggaaaggagagaagtagagaagcaaatcttgactatttcccccaagaagtgccaagtggttttggaacttttttttttcggttttgaacatttttaagggaaagtttatcctactctaccatatttaaatagcatacgctacaaagaacgacttgatttcctttaggccaaagagaagagatggccttgtttgttttcctagtgataagagtcgaggattaattgttaaatctctttttgaagactgagagatgccagggcaaggtggctcatgcctataaccccagttactcgggaggctgaggcaggagaattgcttgaacccagaaggcagaggttgaagtcagccaagattgtgccactgcactcccgcctgggtgacagagcaagaatcccccaaaaaaaaaaaaaaaaaaaaggaaaaggacttttagagggccaggcacggtgactcacacctataatcccaatattttgggaggccaaggaaggaggattgcttgagcccaggagttggagaccagcctgggcaacatggcaaaatgccatctctacaaaaaagtacaaaaattagcgtggtggtgcacatctgtagtcctagctactcaggagactgaggtgggaggatcacctgagcccagggaggtcgaggctgcagtgagccgtgatcgtgactctgcactccagcctgggcaacaagaatgagaccttgtct

SEQ ID NO: 230134 - DNA, 392 bp, Homo sapiens
ccctaatgatggatatttagattcttttaagttttgtttatttcttttaagttttgtttgtggtataaacaataccacatagaatgtttcttgtgcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttatatttttggtca

SEQ ID NO: 230135 - DNA, 482 bp, Homo sapiens
aggctgactgtcccttatctgaagtttcagattttgaactttcacattagggatgctcaacttttttttttttataacatcatactgtatttccatatgtacttattattgtaaataagtataaaacagtgtggtaagagttatctaggaagtaaaattttaccttaatggagcctgggattttggtaggtgaagtggaagaagagctagttcgaattgactcaatgacagtgatacagtaagttagtaactgacaattgaactctactgtaatactaatatattacttagacctttttaataagtgcattggttattttgtgatcctccccttcaaaaaaccaacaagaggttagtaataaagccttaacttttacttggtttagtagtcacgtaacattgattaacttctattaagtttttaagaagcttaactttttattgccagggcttaacaggactatctaatgaaatctgtgaaa

SEQ ID NO: 230136 - DNA, 150 bp, Homo sapiens
aaggtgtgacttttgtggtcagaatgaaagaggattgaatctaaaagcttagatgtagaacactttgagtataccagataatcagtgggccccatgtgattttaaaggcaatacggttttgagatgagaggtagaagatgacatagttgc

SEQ ID NO: 230137 - DNA, 481 bp, Homo sapiens
tagttcatgtgaaataaggctctgaatattttagctgagtgtgtattccatagcacatagtagtattttgtggcttctaaaaaagtacacatatccattgggtatgagtcggagcattattctttcttgaactgcgctctcacgatgcctcctcagtttaagaacttactctgaaatagtaaaagcatagtgtccagatcaggaggtcatggttcagctctgtgctgcactggtaagaacatgtgttaagcctttttccattttgagcctcactttttaaagaggtttttgatgaactggagtcatccagtgatggggaggcaggatagcctagtgttgaagcacacgcactctagagtctacttgggtttgaatcctgcctcttccatctactagctgtgaatttttttttttttttttttttgagagggagtctcgctctgtcgcccaggctggagtgcagtggcgcgatcttggctca

SEQ ID NO: 230138 - DNA, 460 bp, Homo sapiens
cagatcgattcagcactggacaggtcagcctgttacctcagtgtaacttgatccatctcgattgttctctgtgactcctccattaaaaaagaaggtgaccctctgaccctggagacagtgtcgccggggcttctggtgccttgtaataagctctacatccctattcctcttctgattttaacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggttagcaaagcttcagcagacagaagcagcgtgtccccacagcttctgcctttggagactttacaaggttgtccttgataggcaatttgatgtatgtggccacacggcctatctgattcctgaaactgggagagagagaagaga

SEQ ID NO: 230139 - DNA, 444 bp, Homo sapiens
gaatcattggaaaattgcagaaatttcagactttcctaaaaactcaagtttgtttttaagtggtttgtttttgtctctcacaaaagctgggatttgaatgccacattttttttctagttataacccatgaataagttgcattattttataaaaccttacatgaggaagacaaagaacagcacaagcaaaccacacttgtggaaaagtgggtccctgattaaataaaacaaatttgtaaaagaggatgtagaaggctgggattttgtgaaaagatcaatgagactattatgaagtgtttaaacatgggacacagataaagccgcaagtaagttgctgtgataatttgtcaagagttctggctacagatcttcacagccaggtgaaacttctccagtcatttgctaacatttgacccaccaggagactttcctgagttgaaccagt

SEQ ID NO: 230140 - DNA, 555 bp, Homo sapiens
tgcccttccacactgtgggaggagtgttcttttgctctttgcaataaagcttgctgctgctcactctttgggtccagactgtctttatgagctataacactcaccgggaaggtctgcagcttcactcctgaagccaaggagaccacgaacccaccgggaggaaggaacaactacagacacgccggcttaagagctgtagcactcactgcgaaggtccgcagcttcactcttgagccagagagaccacgaacccaccagaaggaagaaactccaaacacattcgaacatcagaaggaatcattcttgaagtcagtgagaccaagaacccaccaattccagacacactaccaaaggcagaggggagctcctagacaaagatattttgcttacaaatggaacatatcaaatcaagcttttgtgaacttgagggaagaaacaaagaatatgaagcctaaatggaagtgtcaggaaatggtcgccttgcggacaaggaaacagcagcctggaaggccaggagagggcagactacccacctaaccctctgcagaattttgt

SEQ ID NO: 230141 - DNA, 733 bp, Homo sapiens
tggctttgttgtagtttatttctaagttcaaattaatgttggtgcctgagagcaaatggagaaaacgaacatttcctcctttttcttggcagatggtttactaggtgagtgtgtcctcgattattcaaatcaggggtccccaatccccaggccacagattgttaccagtccatggcctgttaggagccaggccgcacagtaggaggtgagcagtgggccggtgagctactgtgtgaactccaccccctgccagagcattactctgtgagctctgccccctgcagagcattactgtgtgagctccgccctgtcagagcattactgtgtgtgctccgccccctgccagagcattactgtgtgagctccgcctcccgccagagcattactgtgtgagctccgcctcccgtcagagcattactgtgtgagctccgcccatgccagagcattaccttgtgagctccaacccctgccagagcattactgggtgagctccaccccctgccagagcattactgtgtgaattccaacccctgccagagcattactctctgagctccgcccctgccagagcattactctgagctccgccccctgcaagagcattactctgtgggctccgcctcctgccggagcattactctgtgagctccgcctccagtcacagcattactgtgagctccgccccctgccagagcattactctgtgagctccgcctccagtcacagcattact

SEQ ID NO: 230142 - DNA, 467 bp, Homo sapiens
atatatgcacccaatactacagcacctggatttataaaacaaattcttttagtcttacaaagagacataggtaaccacacaataatagtagatttcaacaccccactgatgatattggagagatcatcaagacagattactaacaaagacatctgggacctacatttgacaattgacaaaatagaactaacatgcatctacagaaaagtccactcaacaaaagcagaatataaatccttctcatccatgcatgacacatactctaaaattgactacatgctcagccagaaattctcaataatttcaaaaaagccaaaatcataccagccacattctccgaccacagcacaataagagtagaaatcaataccaagaagatttttaaaaaccctacaactaagtggatattaaataatctgctcctgaatgacttttgtgtaaacaatgaaattaaagcagaaattatg

SEQ ID NO: 230143 - DNA, 445 bp, Homo sapiens
cagtgttccttccataaccccagtctaatcataagcaaaataatcagacaaacccagattaggagacatcctacaggatacctggacagcattcctaaagcctgtcaaggtcacaaaaaacaaggaaagactgaagactgtcataggccagaagcaaatggagagacatggcaactaaatgcaatgtagtgtcctggatcagatactagaatagtaacaggtcatcaataggaacactggtgaagtctgaagaatgtctggaatttagataacagttacgtaccaataatgggctcttagttttgacaaatgtaccatggtaatgtaagacattaacaatgggagaaactgggtgaggggtatacaggaattctctttgcttatatgtgtgacttttctgtaaatctaaaattattccaacataaaaaatttaaaaatccttctt

SEQ ID NO: 230144 - DNA, 414 bp, Homo sapiens
acaagtttgtcttctgtctccatgactgatggggaaattaatcaccctccatccttattaatagttacacttttgatgaagagattgctagtggggtatttcagatgagtaaacatgggattaatggcagtctagttgtgaagtccttataaataacacatctattgtttctgcaaaaccatttacagtattttactggtgagaactgggccttcatggctccatgtgctgctatgtactgctcgacgtctttttgtttctctgtcatggccgtttattgagccacatttcctttcaacagaacattttaaatgcgtaaattccacagaagcatttattttaaaatcccttgattgaagttgaacatactttatttctatagttccctattattggattcccgcccccccaatc

SEQ ID NO: 230145 - DNA, 366 bp, Homo sapiens
ggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcattttagcaagtgtttattaaatgctttccccaagcaccacaccaggcccagacaattctgcctgtacacatcctgtggtatttgttggttggaggaaagaggctcttgtagtttatgaattaaaga

SEQ ID NO: 230146 - DNA, 656 bp, Homo sapiens
tctgagacggagtctcgctctgtcgcccaggctggagtgcagtcgcgggatctcggctcactgcaagcaccgcctcccgggttcacgccattctcctgccttagcctcccgagtagctgggactacaggtgcccgccaccattcccggctaattttttgtatttttttagtagagacggggtttcaccgtgttagccaggatggtcttgatctcagttgatcctataactcagaacgctactaagtgactactgagcaggtagcaggtaaggcgtggatacgctggacaaagggaggatccacatgccaggtgcgatggcaggagattacatcatgctgcttagaatggcatgcagtttaaaacttacgaatagtttgtttctagaatttttcttttaatatttttcaactatggtggactgtgggtaattgaagctatggaaagtgaaaccatggataagtggggggctactgtatgactattcttggtccttgctttttccatacactgctgcacacacacacaccccctgccatcacctcatggaaatatatatacatatatgtttcacttttttcttttctttttttttgagacagggtctcgctctgttgcccaggctggagtgcagtggcacgatctcggctcactgcaa

SEQ ID NO: 230147 - DNA, 991 bp, Homo sapiens
ttccctgggtggttgggcttgtgaaatgatctgtgttggccattttgtgtagaatcctcattgtctttagcccttttccccttgagctagtctcatttcccagaaaagattctttttttctcctgcttgtaaggtgaagacctggctgctgcagcatttggggagcccagtggaaataataggctgagagtcttaggatccataattcatttacttatttgctgtattttacatatattactcctgattatatagctgtgccacatttacccttgtccagagatcttctttataccctttctagagaaattaacctctggccttctgttaggaaatggaacaggaattagctggaaagaacatatatggaactaactgcttcttgaacagactctcagccagtcctcctgttttcattcccatcttaaactcttatttccttaagtgtttgtgctgccatttgtttatccttttatgagttttacattgcaaatttagttgttgcttttttcaccatcagcttaggattcagcttcttaagtctgatcacagccgggcgcagtggctcacgcctgtaatcccagcactttgggaggccgaggagggcggatcacgaggtcaagagatcgagaccatcctggctaacacggtgaaaccccgtctctactaaaaatacaaaaaaaattagccgggcgtggtggcgggcgcctgttgtagtcccagctactcgggaggctgaggcaggagaatggcgtgaacccagaaggcagagcttgcagtgagccgagatcgggccactgcactccagtctgggtgacagtgcgagactctgtctcggaaaaaaaaaaaaaaaaaaagtctcatcacttgtccatttgttttccagctttcaaaatttggttgtatttgtctcttctccctctctgttttgtttgacatctctgttgatgactaggattatcctgtagttttcatttcctgtaatgttctt

SEQ ID NO: 230148 - DNA, 652 bp, Homo sapiens
  misc_feature (529)..(529): n is a, c, g, or t
  misc_feature (606)..(606): n is a, c, g, or t
  misc_feature (645)..(645): n is a, c, g, or t
  misc_feature (647)..(647): n is a, c, g, or t
tgagacagagtctcgctctgtcgcccaggctggagtgcaatggtgcgatctccgctcacacagcctccctagtagctgggactacaggcgcatgccccaacacccagttaagttttgtaattttagtagagacgggtttcactatgttggccaggatggtcttggtctgctgacctcgtgatccacccgcctcgacctcccaaagttcaattttcttaaaagtgaccaccaacaccatcaacatatgtttatagactagatgtatcacttgtttacccaaattgtagcataaatatctgtttttagaaagcttttccataagtctttctatatgattggattattaagcaaggctatgattaggaaataaaccactttcccctttagctagttctaatgaaagctttccaaattaaacactgtgtttgaacacttcttccattcatagcatgtgctcatcaaaaagtgctttccgtttctggtatgtcaactgtactatttataacctagttaacaaagcccacatggngaaaccttatctctactaaaagtgcaaaaattagccaggcatcatggcacatgcctgtaatcccagctacccaggangctgaggcaagagaattgcttgaacctgggaaggtggangntgcgg

SEQ ID NO: 230149 - DNA, 379 bp, Homo sapiens
gcagttctattgagatattcagcggggaaagaaaatatatagcaataatatgtaataattaaagctctatattttagaaaatatatggttgtattagaatttatactcagaaatcctaggacctaaaagtataggaaatcacaaaagataaaattgtatgattccatttatatgatatgtctagaataggcaaatctgcaggcagaaggttagtggttgcttggggttagggaagggtaggagggaataaggaggggcgagtgtgagaaatgattgttcaagtctaaatcactcttaaagtaataggacatgaccagacttgaaagaatggaggatggaggaaggtaaagagtagtagggaattaatgagtaaagcaag

SEQ ID NO: 230150 - DNA, 398 bp, Homo sapiens
gtttaactgtaatttatatttcaaaatagaaaaaaatggagtatacagagaaatgataaatatttgaggttatggatcctgatttgatcattacatatggtatgcatatatcaaaataccacatctactccataaataatgtacaattattatgtatcaacaaataagaaaataatccccccaaaactaatacaaaatagtaggcatctacaaaggggagatatttatatataaatggagaataataaagaattatcttttttaatacattaaaatgaatattcatattaagaaaggaaaaactaaagtgaaaagagaaatagcaaactgatagaaagtactgctggtactatgacagtcaatgtgcttattattcaggaaaaatactccaaaacttg

SEQ ID NO: 230151 - DNA, 640 bp, Homo sapiens
ttggaaaggaatttagagattatctgatccaagccttattttagagataagaaagatgctacagttgcttaatagatactcagactctgcccaaggcaaatacatgttaacacttctttcaggtttggtgggatctgcagatactcctatatcctacctcccaatcttatctccagggtggaaatgctgggcagtattagtcagggttctcttagagggacagaactaatatatatatgtatatataattatatatattatatagaactaatatatatatgtaatatatattatatataaatatatatatatgtaaaggggagtttattaagtattaacttacatgaccacaaggccccacaataggctgcctataagctgaggagcaaggagagccagtccgagtgccaaaactgaagaacctggagtttgatgtttgaggggaggaagcatccagcatcggagaaagatgcaggctggaaggctaggcctgtctcgctcatttcacatttttctgcctgctttatattcactggcagctgattagattgtgcccaccagattaaaggtggatctgccttccctagcccactgactcaaatgttaatctcttttggcaacaccctcacagaaacaacgc

SEQ ID NO: 230152 - DNA, 408 bp, Homo sapiens
atggcgaatggggacaagaccaatgaggctttggaaatgaatggccttgagaagacaacatgctggagtatacaagggaaaaataaggagagcaaacgtagtgtaaatagcaacccagccgtccacagaagggtaagaggatgggcgtcctgagtagtgggttggatgctgtgtccccgccaaatcgtcatgatgaaatgtaaagtggtaattcccaatgttgggagttgggcccagtagaagtcaaattaataaagacaagaaatggaatggtggttggtaggggcaaggggagggaggaatggggagtgagtgtttaaaggggctggagtctttgctggtcttctgtctgtcagggctggggaatgttctcagcgtgacttggggtagacatacggaatctcccta

SEQ ID NO: 230153 - DNA, 477 bp, Homo sapiens
caggttcaagcgattctcctgcctcagcctcctgagtatctgggattacaggcatgtgccaccacgcctggctgattttttatttttagtagagacggggtttctccatgttggtcaggctggtctcaaactcccgacctcaggtgatccacctgcctcagcctaccaaagtgctgggattacaggcgtgagccaccgtacccggcccaaaaaaatacattttacagtcagcaaaatgctgtatatattttttatccagatacaaaagttcaaattctgtatgatttcatttaaatgaggtccctagagaagtcaaattaataaagacaagaaatggaatggtggttggtaggggcaaggggagggaggaatggggagtgagtgtttaaaggggctggagtctttgctggtcttctgtctgtcagggctggggaatgttctcagcgtgacttggggtagacatacggaatctcccta

SEQ ID NO: 230154 - DNA, 474 bp, Homo sapiens
gagtgggcacctctcgcctccctccaccagcgctgctgaacctggggcctggtatgggagtttgttgcagtgaaaatactacacagatagagagatggatggacagccctgcagcaggggcctgaggaccctacccataaccagatacttcagttagtgaacttatctggggacttcccttttaggcatgggatattcatgccctctggttcaattcaacaaacactgatgagtgtgggctctgggccaggccctgtgctgggcactgggggtctgggagtgaagtgggtgtggtctccaccctcagggagctgaagccaaggtaaacaagcctggcctagagctttgcctctagtacccacggcctgggctgggttcagaggaggccacgagcagtgtttgttgaaggaatgaaaggatgcaggcaggtagagtgagggagtctgctgtgtgaggaggtaatagcaacctcgt

SEQ ID NO: 230155 - DNA, 386 bp, Homo sapiens
cgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaactcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcac

SEQ ID NO: 230156 - DNA, 338 bp, Homo sapiens
gactggcaggaagagaagcccacaaacacactgactgtcaagttcgatcaggtttccactgtaattaacctggagaacaagtcttacctgaaaaatggtgatcactgagggcaggtgctaagtaccacttctgaaagtagcttcttttggctactgggccactaacaaggccctggctgtcagcagacactctctgaggaaggaagtgcttgtagctttagaaagctcagccttgccttaaaatccctcctggatactatcatggttttcattcctgtcttccctccagataagatgaagggatttgaggctgtccaaataaagatatgcactttaaa

SEQ ID NO: 230157 - DNA, 976 bp, Homo sapiens
gctgagcgtggcgctgcgcctgctggccgagctgaccttcctgggcggccaggcgctgctctacggcttccgcgtggccccgcacttcgcgtgcgccggtccgccctgcccgcacacggtcgactgcttcgtgagccggcccaccgagaagaccgtcttcgtgctcttctatttcgcggtggggctgctgtcggcgctgctcagcgtagccgagctgggccacctgctctggaagggccgcccgcgcgccggggagcgtgacaaccgctgcaaccgtgcacacgaagaggcgcagaagctgctcccgccgccgccgccgccacctccgccaccggccctgccctcccggcgccccggccccgagccctgcgccccgccggcctatgcgcacccggcgccggccagcctccgcgagtgcggcagcggccgcggcaaggcgtcaccggccaccggccgccgagatctggccatctaggggcgggcaccgcctcgcgcggactggacggcgagggccggaccccgccacctccgcccgcaccgcagaagccggaagctgcttccaccagagctgtcgcgggacctgccccggcaggagacgcgttgtggggacggcccgcgggcggcatcgcacttgcctcgtactgcctcccagtggctgccggcaggcacctggggcaggccagggctgggggcaggagaatgaactcaggcaggtcctggatgccaccacccaggtggaaaggaaggagaccaggaccctgagagagagtggacccgagggggagaacagagcggaaggtggagagtggttgttttactggggacaaaaacaactgtgatgccagcattctcaggcactctctgtgttcagagagagagtggtccccctgtgggctctctgcgagtgtgcatacacggacacataagcactgtgagctgtgtgcacgcgcacctgtacaccctgtgtgagcgctgt

SEQ ID NO: 230158 - DNA, 209 bp, Homo sapiens
caggcagctcgtgcaatgacatcgctcgcctatcttggctccacttgctggagcataaatcattcatgtgtcccatcttccttgcatcaccagagactcctgtgctcactgcaccccctgccaagtccctgtccagtctctgggtgcatcatgctgctgccaccttttcctggccagcgtctccaccctgggggtcacttcattccaga

SEQ ID NO: 230159 - DNA, 408 bp, Homo sapiens
tcttatagctagaatatctccaaaatgctcatatatagtataattattgtgaagacctaactaaaaaatagggttggtgaaatattttttttcccctgcatctcagattttttaaaataaccagaagtcacctgtaatcccagcactttgggaggctgaggcaggtggatcacctgaggtcaggagttggagaccaggtggctaatatggtgaaacctgtctctaccaaaaatataaaattgttatattttatataatacagctgggcgtggtagtgcatacctgtaatctcagctatttgggaggtggaaacaggagaatcacctgagcccgggagttggaggttgcagtgagcctagaattgcgccactgcactttagcctgggcaacagagcaagactccatctc

SEQ ID NO: 230160 - DNA, 310 bp, Homo sapiens
aggcatggcgtagtcttcagaattgctggatccccatacgtaccttgttctgtacctcccaggaagtcaggtaaagctgatagggtcctggatcagtggaagaagaaaatttaatgtctcaattaagacattaattaattactttagaaaattatcactctccttatagaatcttcaagaagagagaaaaatgacattcaaccaagcaaatctaatgcaagtgggttatgaatacagcatcaaaatcaacacaggtaactgtggggaaatttagaaatgtgtatgaagaaaccagggaagatgaagacaa

SEQ ID NO: 230161 - DNA, 493 bp, Homo sapiens
gatagaggtggagattaaagaaatataaacaaacacatgccttgttaggcagatgataggagtaagtttaagaaatcattagcagttaagagagcaggcacagtggctcacacctgtaatcccagcactttgggaggacgaggtgactggatcacttgaggtcaggggtttgagaccagcctggctaacatgataaaaccctgtctctactaaaaatataaaattagctgggcatggtggtgcacacctgtaatcccagctacttgggaggctgaggcaggagaatctctggaacctgggaggcagaggttgcagtgagccaagatcatgccattgcactgcagcctgggcaacaagagtgaaactccatctcaaaaaccaaaaaaaagaaagaaagaaagaaatcattagcagtaagcagcaaacatgagttcaggaacttaagggtgaacaatgtaagaacaaagaattaaaacctttaaaccagcagaag

SEQ ID NO: 230162 - DNA, 299 bp, Homo sapiens
agaaaaaatacctttctgctttttctcatttggagcctgtttctgggaattttttttttttctgttgactgaaacccctttttacatatgtttagtccctttgtttgcttcttttcttgttagtatgatgtaaagttttattggccttctgaaaaacttaaaatctccccaaattggcttagagctctcccattttcttctactttttcttcctttagctatctttgataccacataaagaaatctagaggagtcttctaatatctctgagaccctttgaggaacacagtaaagtgtca

SEQ ID NO: 230163 - DNA, 401 bp, Homo sapiens
caaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgta

SEQ ID NO: 230164 - DNA, 454 bp, Homo sapiens
ctgggcagagaacccagacactcggtaaattaccaaggattacgaaatatctccccaagagagtgttttggcgggtgagaggatatggtttaaagaaaagttttgagtgtgaatgttttcagagagtccaaggactctccattagctagtctcattattacctgtcgttttaaacgccctatcactcttacttaaagtagctgtccccgggaagcttttgtattttgtaccccttctcggggaacgggactgagtaaggaacgtaataaagcggcctaaaaggcatctccctgtatctttgatattttgcctagggaacgccctatcatgtcgcatataagcgatcgagttatgcatttgttgctagctgaagagattattccttgataaccgcttggtctggtcagaatacaaacggtactcctgttcaaagaactacaaatcccagaaggcc

SEQ ID NO: 230165 - DNA, 379 bp, Homo sapiens
tgtgtgctggactgttttgaaatatttgggttaaatgtgttttaattttttatcccttttacttgagcgagtaaataactttaatacacaaatatttcaagttttgaaatgttaagaaaggctttaaaatgctgcttttggaaatcacgttggattaaaatgcttttttgttgttcactgctatttagatttgattggggtggtggtggtggggaaatagtaaactggaatccagcattcaaacttatatgagaagattattctagttaagcagctagattgttgtataattaattcctctgtgaaactttattcttcaaaacattgagcagcactactgaaacatacagctgtagtgctgttgaaactgcaggttttt

SEQ ID NO: 230166 - DNA, 220 bp, Homo sapiens
gtcttttcacatttgtctggctgctttatattccctgggagttgattagattgtgcccaccagattaagggtggatctgccttccccagcccagggactcaaatgttaatctcttttggcaatacctacacagacacaccctggattaatactttgtatccctcaatccaatcaagttgacactcagtactaaccatcacagacatgtaggcagaactac

SEQ ID NO: 230167 - DNA, 351 bp, Homo sapiens
gtattaaaacctgtctcttctttccccctcgatcttccacattccatttcctttcagcagaatcccaagccttcaccatttttcatttttggtgctgtttcagagttgctgtgaactttacctgggtcctctatcaccttacccagccatttgtcattctgcctggtaaagggttgagcagatttatctatatgaatgatcttatttaagctattctgtacaccttctgctacttaaacaggctctatgcttccacatctgctctctatctgcctatgtgactcaaacttcaattgtccatctcagacatcacatcctccatgaagccctcttgggttatttgaagtaatc

SEQ ID NO: 230168 - DNA, 620 bp, Homo sapiens
gaaactttggagggttgccctgggccacaggtgaatgattagttcttctgtgaactaaaattaattttgagccgtttgaagccctttctggtcatttccccctcagatgatgccctgtctcctggaaggtttgggagggcacctctgctaaaaagttcctctcagctaggcttaaatgctcagagccagccattcacacatcattgctcaatcgcgatggcaaagaaagttccagtgctttttcccttgcccattttccctgatgataagccattcctactcatgccttgacccatactttaccgaggaccaggatttgaagcttcccttggctattcattgcaaggtttatttcttctctctcaggaagctcttttttattttttttagagactggttctcctgtactccacccaggctggagtacagtgacaccatcataactaactgcagtctcaacctcctgggctcaagtgctcctcttgcctcaacctcccaactactcgggaggctgaggcaggagaatggcgtgaacccaggaggcagagcttgcagtgagcggagatcgcgccactgcactccagcctgggcgacagagcaagactccgtctcaaaaacaa

SEQ ID NO: 230169 - DNA, 555 bp, Homo sapiens
tgtttttataaggactgcaaacacaaataacatgaagtgctaacagcagagttagaataagtctcctaaaatgtgtcttaatgaaattattttgaattataaaactttgtcattttcctagacttccttgggaaggcagtctgttcatggcttataactgcttcagtaccaagaggcttactatacaacattcctaccttagaaattcaaatgcatggaggctataaaaggaaacaaggaaggcatttttctctaagaacagaaagaactgaagtgtacagtgtttttctaaacttcatacctaaccctctaataatgaatggtagggctgtaattgggggaagtagctgtattttacctctaggtgagctaccaacaagaccttgtgtcttaatgcagtcactgaaagtatgccccccaaaaaatacaatgagcatttcaatatgaaaataagagctcctacaaagatcatactgttaaatggggaattggccaaagtattgcagcacaaattgctgactctggtgctctgaatgctcttttgacttaaaatct

SEQ ID NO: 230170 - DNA, 365 bp, Homo sapiens
gagaaaactgggattaaaatcaaggactgtgtcttcctgtcctataacactcatgtgtgtgctcttctctttatttctctctctccttgtgtttctctctctctctctctgccccattctcgcttacatatattatttactcaagagtctataccaaccctttgggggctgttagaatctattttatagtttgttggtcactgacctgataagtcataatcgctcagaaagaatcatcacaattttatcaggtgagagcagctgctgcagaggcacagtaaattcttagcgttatgcatcacaagactatctattcttgtttagaatttagcaatggtgtttgggaagaaataattagcaagtgt

SEQ ID NO: 230171 - DNA, 481 bp, Homo sapiens
actaaggtgggcttatggatccaacaataatctatcatgaacttttctaaatccttaatagttattccttcttaagattaaatgctgtggaaagtgagttatgtagatgaagttacccgtgggcattgctgcatttcctgatcttgtatattccgtggagaaaaagatggggatgcatttagcattgaaaggtaattgttggccaggcgcggtggctcacgcctgtaattccagcactttgggaggctgaggcaggcggatcatgaggtcaggagtttgagaccagcatggccaacaaggtgaagccccgtctctactaaaagctacaaaaattagccaggtgcagtggcaggcacctgtaatcccagctgctcaggaggctgaggcaggagaatcacttcaacccgggaggcaggttgcagtgagccgagatcgcgccactgcactccagcctgggtgacagagtgagactccgtctcaa

SEQ ID NO: 230172 - DNA, 274 bp, Homo sapiens
tggcccatcacttgtgtgtcctatgttctctatgcccctcctcagatttctgatcccccccattacctgtttcaccgacttatggcactgccacactgccaagaatagccatcatcactgaggtctgcttcctagtctggagctctcacttgccccacaaccgagattgttcgaggtaggagcctctaccgtccattcacataccccataccctacatctttccagaatcaacacagccaatctccccttagcaagtaaaaaatattcatgtcc

SEQ ID NO: 230173 - DNA, 481 bp, Homo sapiens
ttaccacccagctattgggtgagccagctggctgccatgcgactgccagtttctccaatggacatttgcacctcggtgtttcggtgagtcgtcccaccgcctttgctcatttttcctccttctatttttagggttttttttttaatgttcccggaaaggcggcacctcccaaaggtggggacatctcactggcctaggggcttacttttcagagtgactcaggcgggtagaagttactagggctggcagggccagagcctgttgtttttcaaagataatctgcaactctgaagagtggggtgaaaagatttctacacagtgtacattctacagaattctagtttctccgcgggcgcagacttttccgccctctagtctagcgtgaaaacagttcgaccactggatgtgggcggcgaagcccgcaccctagagcgcggtgtctccctgcaggagggagctccagcccgcgccgccgcggccg

SEQ ID NO: 230174 - DNA, 505 bp, Homo sapiens
acaggggaggacactttatattcatctgccgacatgtgccaggcagagaagcaggtacacttaacagcagatgtgtagcatagttattaagagcatggattttggacaatgattgcatgcgttaggttcctatgtctgacatgctaattgggtagtgttgggaaagttattagactcatctgtgccttggcttcttcaactttaaaaggggaataataaaagtatctatctcttggtttgaagtgatgattaaatgagttaacaaatgttctacatataaaacagtgccttccataaagttatgctatattttagttattattggtgttattattaaaaataaatatagtctcaatcaactattcatctaaatttctccctatccactctttctcacagttattttttgttaagtttaaagtcagttttcacaagtgcttcaagaagtacagcactttgcagtctgagactcttttatagatgaaaaccagccctggaaaggtta

SEQ ID NO: 230175 - DNA, 490 bp, Homo sapiens
ttcatgctcagctcaatgatcattcaatattgattgattgccagttccctgggaagcaggtttaatatatgccccagaatctcctcacttttccagcagacttgggctgagagaagaaccactgggcacactctttacctattacttttgtttacatccttagtcctggaagggaacagcatactctcatcaaaatagcatattctgtttctggattattaattgctggaaagtgcttccataaaaaatgggtgagaatagagaagaataaataaaatgtgagagaggtggattttgtttcttatggacatattttgactgcacagtactggattatttcttaggaaataaatattttgtgttatctatgatactttatttgtgctcctccccagcacaccttccctgtgatgcaggctgtgcacttatttgcgtttatcttttgtttgggcggaactcctatgggagaataaaactgtcatagagaatg

SEQ ID NO: 230176 - DNA, 365 bp, Homo sapiens
gtgagttgatggataaataaatgaatttattgtaggcctgagttgaaattttcagtgcctcaaatagaatgtgttttgttcttctaaatggttctcaactagatggaccatttaaacaactaagcactggcacttggttaggcagtgggataacaaagacaatcacttataatcactgcaaacaatatagcattcaatattcagaacaagtcagaaatttaaaaattttatataatgtcataggtcacatacatggtatgataaattagttatcgctacttaacatgtaatgagagcctaataaatacttgaaacaagaaggaaagaaagtaaaaaagcaagcaagaaagagaaggaaagagaca

SEQ ID NO: 230177 - DNA, 639 bp, Homo sapiens
atgaggtacttttttataactttgaaaagtttcataaactgctcacatttcttaaatttggatattcaaagctcacggtatcaaatcccatattagtgctattttaaatttacaaaaatttaaatttcttatgtaaacactttttttttttttatctactccatcactaagctggagtgcagtggcccaatctcggctcactgcaacctccaccttcgggttcaaatgattctcctgcctcagcctcccgagtagctgggaccacaggcatgagccaccatgcccagcaattttttttgtatttttagtagagacgaggtctcatcgtgttggccaggctggtctcaaaatcctgacctcacgttgatccacctgcgttggcctcccaaagtgctgggattacagccgtgagccactgcacctggcctctttcttaatttctaattgataaccttttaaatagatacaaccacctcaagtctttatatattagtcacagatgttccagtcttacttgatatcctggctttttcttcattgcttagaccttgtgcatgttgggtacagggtatatatttcctgatgcttattcaatgttttgtgtgtatgtatgtatgtatgtatgtgtgtgtgtgtgtg

SEQ ID NO: 230178 - DNA, 473 bp, Homo sapiens
cagccagccatcagggagccagcaatagatgcaaggattggaggactctgagagacgagcatgtacaggaagcacccgggctgtgcacacacaggaaagaccacgtgaggacccagcgagaaggcggccatccccaagccaaggagaaaggcctcaagaacaaacaaatctgccaacaccttgattttgaacttccagcctcctgaactgtggaaaaataagtttctgctgttgaagcctctgaggcagtggtattttcttatggaagccccagcagacccctatgtgacttggtagccccatctgtgactggagaaggtgaagtccaccggccctggtgctgggagaatcacactggatgctgagactgggcctcactaagctcacaggtgggagattctgggtaaagaggtggaatttgtgtcacagtcaatcaacgtgttcagtgacaataataacagaaactaccgttc

SEQ ID NO: 230179 - DNA, 731 bp, Homo sapiens
taagaattcatccagttaccaactcccctacgaccaacggagtccaagctagagccactcatggtgtggtccatgggtggcagcttcagcatgttggaaaagcaggatcccagggaccaccatgcacctgctccatcagaatctccagtggccaactcggggaacatagccagacctaatctctataaagaatgtttttaaaaattagacaggggtgtggtggcacacacctgtagtctcatcatctcctcaggcagctgaggtgggaggacgttttgagcccaggagtttgaggctgcagtgagcagagattgtgccactatactccaccttgggtaacagcaagaccctgttttaaaaaaaaaatctccagtggggacagcaagctgggcaggaactatgttacaggcactccaggggatgcttcaaaaccacttccaccctttttgggtctccccacaacctctccagcttccatttcagccttatctcttccacatgttataaccagaatgatcttttcaaaatgcactcctaaatcacgcaaatgcctcccattcctggccttataactgcttaaagggttgtcctcacgctaacttcagtgggacccatgaatgacatccactcccttccctaccctcctccctttttataagatccctctggcccctgccccagggccttcgttcagctccaccctatctagaaggctcccagctgcctccaga

SEQ ID NO: 230180 - DNA, 545 bp, Homo sapiens
aaagtatacttgctgtctgtacatttccactgtgaaaactccttgaaatcatgtagacaaatgaaagctaaacatcaaataaataacctaaactggtaatactcccatttggctctccttgtgtcttttcatgtgggttagctcttcaaccagattcagcatataaattgagtatgtatggttatatggtgactttcaaaagtaaatactttttctgtggaacaaaagagatggatttgtggttttccaggattccttttccctgacttggtagaaagatagccaggcatagctcagcagacctgaaaataggtgagctgtcaaggtgttggcagggagaggctcctctgggtgggacttggggcatcctaccagcgaaaaagagactaagtttaagtgatttcacatttgggctttacttactataattgctgaagtgctaaattgagtgtgacaaatctaacaggtaattgccaagtaggtttcattaccagtcattgcatagataaatgatgttccttatgttaaaaaataaaaccaaacta

SEQ ID NO: 230181 - DNA, 526 bp, Homo sapiens
gaggaatatagcacgtaaaggaagttacgtggacacatagaggagaacaacggacactgggacctctcagagggtggagggtgggaggaaggagaggatcaggaaaaataactaatgggtactgggcttaagacctgggtgatgaaataatctgcacaacaaacccatatgacatgtttacttatgcaacaaacctgcaattgtacccctgaacttaaaaaaagatgcttttaaaagtattttttctactaccaagatgtatttttttagaggcagggtctcaatctgtcatccaagctgcagtgcagtggtgtcattatagctcactgcagcctccaacatctgggcttaagcaatcctcctgcctcagcctcctgagtaactaggattacacatgttcagccaccacacatggctaatttttttttttttaagtagcaatgggttctgttacgttgcccaggctggtcttaaacaacctgcctcaaggaatccttctgccctgagtgagacatgagtctcactc

SEQ ID NO: 230182 - DNA, 1561 bp, Homo sapiens
tcttgaactcctgacctcaagtgatccacccaccttggcctcccaaagtgctggaattacaggtgtgagccaccgtgcccagccaaaattcttaaagaataaaccaaatcttaaacaatcttccaattagaattattttcagccaaattatcatttaagtgtgagagtaaaataaagacattttcttttttcctttctctttttttttttttttttgagatggagtctcgctctgtcgcccaggctagagtgcagtggtgcaatctcggctcactgcaagctctgcctcaggggttcatgccattctccagcctcagcctcccaagtagccgggactacaggcgcccaccaccatgcctgactaattttttttctatttttagtagagacagggtttcaccgtgttagccaggatggtctcaatctcctgacctcgtgatctgcctgcctcggcctcccaaagtgttaggattacaggtgtgagccaccgcgcccggccgataatgtgttgttttaaggcattaattttgtggtacatacaaaagtaatttgtgtgtacatacatgcatatatacatatatatgtacacacacatatatttgttaaacctacacacagtgtttattttattatttcgataaaactattattcacagctgagccttgtggtgcactgtaatagtttcttttcgtttttttttccctgaagttaataattaccttgtttctcatctgccttatttttttgtacctgttgctaattcctaccacaacttctaatataattttatttttctttaacaatactgttaccttaggacttctttttctttttttctttttaactgacacataataattgtgcatctctatggggtacaatgtgatgtttcaatacatgcatacattgtgtaatgatcaaaacaggatagttggtatatccatcacctccagcatttatcacttctttgtggtgggcctaccacactttccaatagccatcagtattgctttccacacgggcagtcacagcaggtaaaagatgtttcagttccattttttaagttatctatcctctttcactctgggctagttgctttctaggcacattgtagctgatgctctgtgacttccttttgtggtcatctttggaattcccattactttccggttggaatctctgttttctggctttcgtgtcctcctcatgcttggctcactcccctcattagagcacatcttccaggacacacatctgtccatatcaaaatccattcatggctgggcacagtggctcacgcctctaatcccaggactttgggaggccgaggcgggtggatcacctgaggttaggagtttgagaccagcctggccaacatggcaaaatcccatctctactaaaaatgcaaaaattagccgggcatggcggcgggtgcctgtaatcccagctactcgtgaggctgaggcaggagaattgcttgaacccacaaggcagaggttgtggtgagccgagaatgcgccactgcactccagcctgggctagagagcaagggtccatctc

SEQ ID NO: 230183 - DNA, 423 bp, Homo sapiens
caatgagaacaattaaaactacatctgtgggggagtgaataaactggcttccaactttttgtttttccagtccatctctaagaacctttaaagacacagtacaccatgagaggcttctacccccgaaaccagaaacccccgaaaccagaaacccccaaaacagatcgttgccaaattaaaacagattctgttaactaatttggttttctaaccataaaaatcattatgattattttaaagcatttgggaagaaagggtttacttccagagacatagaggataaacataacaaaattaggttaatattgtatatgcagtttatattctacttttgtcacttaatattacagaataagcctgttgccacttcatacaattgttttggaaaacattatattaaatatttttaaatatcacatttaa

SEQ ID NO: 230184 - DNA, 355 bp, Homo sapiens
cgggagggcggccagagcacggtaaatgccccagaagtttggcagattaggccaaccttgtccgctcgcctgggggccccggacctgcactggcgggagaccgcgaaggcgcggggacgcagagggcgaagcttggtaccctgcagctactgctcgcgaggagtcccagcttaccctcccggatccgctggggctcacctggcacccccggggacagacgaaatacctcgcgcgccagagagggctcggagctccctctgttatacaaagtcggagagggagaggagtccgggaggttcggagcaaagaattcaccctgcctgccttagagaaataaagtttaattgcgatctgt

SEQ ID NO: 230185 - DNA, 277 bp, Homo sapiens
ccgcgtcgacgattttaggaagtagaatcagaagtacttggtgaccaagtgaatgtggtaaaggaggaatgagtggaaggtagggagagagaaaggagggtggaagccatcagtcatttacaagaaaggggtttcatagataagctaagtctgcaggactggccttaagagtaacttattctcttttgttattgacacatctccctaacataatgttgaagaaactacatatgtttctggtaggggtgggcaggattgtatgccttaaattcttagc

SEQ ID NO: 230186 - DNA, 923 bp, Homo sapiens
ggctcaccgctgctgcaaccggaaccgcatcgaggagcgctcccagacggtgaaatgctcctgtttttctggccaggtggccggcaccacgcgggcaaagccctcctgcgtggacgacctgctcttggctgcccactgtgctcgtagagaccctagagctgcactccgcctcctgctcccacagcctccatcgtcctgcagagatggtggtgtcagatggagccctgcctgccgggggaggagtgtaaggtgctcccggacctgtcgggatggagctgcagcagtggacacaaagtcaaaaccaccaaggtcacacgatagctcttgggggtcacggcctggacaagaaaggcttgactgagccgtgaactgaagaatggtatccagtcatcagccaggaaagatggggattcacttacatgcctcatgtcaaatgcagcatcagtctttccggggcatttcagttaagctgctcagcagatatggatggatctgcaatcacatacctaatgtggagctgggcttttctggagacacgaaggtcaacacacaattcctgcccttaaggaatgtccagttgaattggagagttgatgacagacaatttagataatttaggttaaagtacttgataccagactgcggcttctgggccacatgctatggcatgatgggggtttgggaatgagattcccacagttcttcagataccctgtggccacagggcatagaaacaagaggtcacattcagcacccaccacctccctctttcgcatcagttctgaatccccagcaagctgttaacatgttgcaggaaaacactctccccttatgccagaccagcagtatctcatttggatgggattggattgacttgcggaaggaaagtaaaaataaagccaaataacttcccaaatctttgg

SEQ ID NO: 230187 - DNA, 440 bp, Homo sapiens
cttgaggacattacgctaagtgaaataagccagtcacaaaaggacaaatcccttctggttccactcatacgaggtccctacagaagtcaaattaaaagagacaaaggagaacagaggctgccaggggctggtggatggggaatagggagttggtgcttaatgggtacagagcttcagttttacaagatgacaaaagttcatcttgtaaagttgaacttgtggatacgtggtagagaaggttgcacagtatgaatgtatttaatgccactaaattgcacacttaaaataggtaagatggtaaatttcacgtgtattttaacatgtcaaattcttttaaatgacattagaattgactacataggttagataataaaaaccaacttgccttcatctgtgcaagtttctcaaatgattatcaaataaaaatgaaatttccatgc

SEQ ID NO: 230188 - DNA, 586 bp, Homo sapiens
agccaccacgctgggccactactcagtcatttttaatagttgaatgtttttcctcccatcttgttttccatgaataaaatagacattttaagtcaaaactggaagcccactgcatatataaacttttaactcctttttttctcccacataacccctgtgatatttcttttcaaagaatattttagtagctgcctgcagtatgaaatttacatgctataatttagacattccctttattttgaacatttgggctatttccagtttttctctattttaaaacatgagccttcttatatatctgattatttcacttatgctgaattgttttttaatattcacaagttggtgttgaagttcagtatttagaagacaaagagcattgacgggtgtgaacatagtaacgactctgtccaagtgacccaaatggattctataactcttctgggttttgatttttgtaaaaaacaaaatgaagctcttattgaatccagttctatgtgtgtgacaaagtattcttgacaggttcctaaaaagacatgtgaatgtagtcagtggttttctttttaaagtctaatatttctccttc

SEQ ID NO: 230189 - DNA, 521 bp, Homo sapiens
gctcggacctctctccacactggacacagccaggctcttgacaagcttgtggggagtcctggaagtgacttgcatcaatcctacattccctgtgatatttcttttcaaagaatattttagtagctgcctgcagtatgaaatttacatgctataatttagacattccctttattttgaacatttgggctatttccagtttttctctattttaaaacatgagccttcttatatatctgattatttcacttatgctgaattgttttttaatattcacaagttggtgttgaagttcagtatttagaagacaaagagcattgacgggtgtgaacatagtaacgactctgtccaagtgacccaaatggattctataactcttctgggttttgatttttgtaaaaaacaaaatgaagctcttattgaatccagttctatgtgtgtgacaaagtattcttgacaggttcctaaaaagacatgtgaatgtagtcagtggttttctttttaaagtctaatatttctccttc

SEQ ID NO: 230190 - DNA, 765 bp, Homo sapiens
cccgacctctgccagggcgcacggggactccagagcggatcctctacgagttctaataggaggccagggagccgggacatcagagacaaattcctccgaagtccccctccggttccactgactggagcctttgggctgaaaccccacgagctccccacccccatgtccatgaggggagcaaaacggagcccccgggggcacgcaggcttcgtttctgggtgttggttttgcttttggttttttcagccggtgcagtgacccggaacagcgcggccgcttctccgacgcccgcggctccccactgcgccgaggcgagcgccacggctaaagcccaagcctcggcgcccgctgcgcctgccggagttctgcttgtccgagcaggcagcggggctcaggcacggcggcgacgtcgaagggccagtcggcagacagggctgggtctctgcggccagagcgccgcaggaaagccctgcaaacggtgggacgagggtggcggcggcggcggcggaggtggcgagaaaggcgccacgggcctggcggagaagagggtttccgtgggggtggaacaaaggaattcaccctcggaagaaaggggccgagcatgcagccgggaatggccaaccctggagacctgcaggagtgcgagcgctgcgacattagtcccagggatccaacgaaatctgccccgccgagggccccagcctggcatctccattcggcctctctcttctggtcaatcccgctttaatgggggtggtgggtgtg

SEQ ID NO: 230191 - DNA, 871 bp, Homo sapiens
ttaagggaactggacaggaaggattttgcgcagggtgtgctccttatctttatggtaatctgatattgaaaagagtgtccgcatgtttgcggtggattgagtgttcacctggctgcgctgcccacctgaaatgcagcctgtggagtgaagagtcggcaatttggaagcccacctttcctcctttctggtgggcatttttttagatgccagggggagagctttcccgcctgactccccgagcctaggggctttcccatgtcttaaccccacatcacaaaattaaatttgggccaggtgcgcggtggctcacgccggtaatcccagcgctttgggaggccgaggctggcggatcgcttgagctcagcagttcgagaccagcttgagcgacgtattaagatctcgtttctacaaaaaataaaattaaccggccgtggtggcgcgcacctgcggtcccagctcctcgggaagatgaggtgggagaatcgcttgaacccgggaggcggaggttgcagtgagccgagatcgttccactgcactccagcctgggcgacagagcgagaccctgtctcaaacaacaacaaaaactttatcattatttacttaaaaggcctccgcgttgtggttagatagtgacgtgtgtgccatcctccactttttcccccggcgggttgttaaatgttttgttttacctcggaggtattttgactttttcaaagtcactgattatttaacctcctagtttctcttctcgtcgactgcagcaagcttccggttgctctgcctgccctcagtgtcccccatctaccagctgaccttccagtcctcccacccacgcccttgtcctgcttgcggctcccgcaggactaagctc

SEQ ID NO: 230192 - DNA, 548 bp, Homo sapiens
agtgtggcgaggtggttaatagtgcacactcaagcgtcgctgcctggatttgaatcccacctgggccgctgtgcaggcacgtgctcacgtggcaggcccgagcccttccaccccacacaggctgctggcaatgctggcccggagctggcgtctgggagcctggattcgggaggcctcccattgctccctaactgacaaggatggctcactgtgcctgagcaatctgtacaagtaatgtggtttatactgaccaccagcttgccttctaagggtctggaatttcagtacctgccaggcagagggtggccacatgaccagcccctagtaaaaaccctgggcactcagtctctctagcgggcttccctgccagatgacatgtcacgtgggttgtcacaactccttgcagcaagaattgggtgactcccctgggagagggctctggaaactggcacctgctttcctctggacttggccccgtgtggcttttccctttgctgatttgctttgaatccttttaccgtaataaatcatagccacgtgtacaacca

SEQ ID NO: 230193 - DNA, 466 bp, Homo sapiens
ctaaatattatacttttaaaaatacatgttgatctgatcttcattgttttattagtaacataaataaactatcatggtatgcttaaacagttaaatgtttttgtcagcctgaaagttaatagttttctttctttctttcaagacagcattattaataacatattatttcaagttgactagccctaaaaggtatcttattctccagtcaagtttgcatgaactttatggatagtgctaacttgactggagaaataggagatctttcaggcttatgttagttaactgatcaacatactttgatcactaatggtctttgaactgtttgaatgacagtgctcagtggagtggtttcactcataggtataatttttactaattacaaagtagaccttggccttcagtgaaaacaatgtctatattgatttaatttatattgtaggaactgtaacaataaaataagagtaac

SEQ ID NO: 230194 - DNA, 314 bp, Homo sapiens
cttaaaaaaaaaaaattacatctgcaaagagccatttaaaaaaaaagtaaggtcctagtcacaggttctgggacatggatgtcatcttttcaggggctgtgacccaactgactacatccttcatggttctgatggctttcaccgccccctgccagcatgttgtatattaatttgttattcgtatatgttctccttgcctggacctggctgcaaggatccagagggatagggacccctttcattgtgtttgttgctgtatttgtattgctcagaacgtagtaggtactcagtaaatattcgttgcatgaaaaaat

SEQ ID NO: 230195 - DNA, 867 bp, Homo sapiens
cttgtgcaactggaaatgcataatgtttgtttttactgtgggactggacgttggcaaagggtgagattcaggaaggttcagaaagaaggaagatttctatttgctactgttctttacagacagtttttattttggttttgatttgtgtgactgtgctgggtgtcttaccttatttgagagtattctcatggggctgtgtgtcagcccggtaactccaggtccttctttaatgctaatttcccatcacgggcagccactggcagctggcccataaatgacagtgacgtggcccctgagtaccactcatttacaattgtattgctacttttgacagttccacgaagaaagcctaacaaaatcttcaaagttttctttgagaaagcatccggtaatgtctgtcccttatctgaacagccctctctataccttgtcactcactgctcccctgacttgcttgatgtgacttggttctctgtgtcaatgataggctcttgtatgtgactggcaacacccacattcatatgaaaatcactccctctgctatttgaactttcatcctgtgatgaatccattgaataacagtgcgtttaatattcttatgcaactatttctgaagtgctttttatgcatttcattttttagggttccccccaacttacatggaaaagggatggttgcatttctgtgtcatatgcatattctttgtggaggcaccggtaattctgagcttgggaagtaaatgaaatttcctgtctttgaacttaaagtcttttgatttttaagatttgactgctttgaatgataaacttctaatatacaagcatctacttacacatgtatccaaataaagactacgctaaacactgg

SEQ ID NO: 230196 - DNA, 498 bp, Homo sapiens
gagacggagtctcgctctgtcgcccaggctggagtgcagtggcgggatctcggctcactgcaagctccgcctcccgggttcacgccattcttctgcctcagcctcccaagtagctgggactacaggcgcccgccactacgcccggctaatttttttttgtatttttagtagagacggggtttcaccgtttttagccgggatggtctcgatctcctgacctcgtgatccgcccgcctcggcctcccaaagtgctgggattacaggcgtgagccaccgcgcccagccaagcactttcttttcatttgtgccatatatattgttgaaaattggcatttatatacccttctggctttaaacaattggttccattttccatgtaactagacacaaatgcattatgcaaaattgtgtttgtaaggagagatcatccttcattccgtttcataaaggttttctcttttttactgtttacgtgagggttgaatatgtctgccttct

SEQ ID NO: 230197 - DNA, 328 bp, Homo sapiens
tgattaagtcatgagatcttagctcattgaaaccatcttctccgggatccaacaattctcccgcctcggcctcccaaagtgctgggattacaggcgtgagccaccgcgcccagccaagcactttcttttcatttgtgccatatatattgttgaaaattggcatttatatacccttctggctttaaacaattggttccattttccatgtaactagacacaaatgcattatgcaaaattgtgtttgtaaggagagatcatccttcattccgtttcataaaggttttctcttttttactgtttacgtgagggttgaatatgtctgccttct

SEQ ID NO: 230198 - DNA, 842 bp, Homo sapiens
aatctacttaaaaggattagcttccaaaagacttgggctttgctttctttttgctcactctgataaaagtgagctgccatgttgtaagttatcttatggacaggcccatgtacaaactgagtcctgccagcaaccacttgagtaagtgtggaagtggatccttcatgtgttctgttaagccttgagatgattccggtctgtgatagactctccagaggacctagctaagccatgtccaggtttctgacttccacaaattaagttacaaaatatttgttttttccagctgctaaattttggagtaattagttatccaggcatggataaacaatacagctgcctgctcacaatggtgaataaatattgaagaaatgaatataaaaataacttattaggctgggtgtagtggcacacacctgtagtcccagtgctttggtaggttgaggtaggaggattattcgagcccatgagaggaggttactgtgagctgtgattacatcactgcagtccagcccgggtgacagagcgagaccctgtctcttaaaagaaaaaagtcttattaatgtcagagtaagattatgtaagtgcaagtacttttttgttgtaaattactatgggtaagactttcttatatgatcatgttatctttatctgatagcttaccatagtgtgtacataccacatatgtactttgattttccttttccttttttttttctttgaaacagtgtcttgctgtcacccagtctggagtgcagtggcacaatttcagctcactgcagccttgacctcctgagctcaagcagtcttcccacttcagcctcctgaatagctgggaatac

SEQ ID NO: 230199 - DNA, 452 bp, Homo sapiens
ccccaaccctcagctccagcctgcatgtagaactgccctggcttccccattcctgctcccttggacctttcactggtaaaacaggagactggagaaagacctggggaggggaatggggaaaaaagcctcactccaagtcagtatgacttccttaagatgacgatgatcgcattgtaaaccagctcatcaacatctaacagggatgggatggtggaaggagatttgggggaggaagattcagctgagatgagaataaatctggaaacatcaagaatagggagctgggatcaggtaattacgtggtctgctaggaaccttaaacataattttgaaaagttcagttggagttctagtctaagccttttaaaataagtttactatttttgaaaatcactcaagcaaaaggtgttccttgttttaaaataaaataaaaatttaagtgattaaacatt

SEQ ID NO: 230200 - DNA, 423 bp, Homo sapiens
ggggaaagggtagcagggtggggatggagcgctgcccttccgaggaacgtgggtgggggcaccctcactagagcggctgtggacatacgctaaatccctgcctacacacccaaaattgctagggctgtggactttctcatccgccgcctccagggcttcggttcttgagatttgcagaagtgcacctccacctcctgcccattccgctgtcgcgtcctaaacccagtgggaggcacgggatgacccagccctcgggacccttttccccagattataggttactgaggattgcgggggttggcgggaggaatgactccctacccccacccccgcccgtaaagttggtggagcgggtggtgacagacagtttgccccttttgcagatggccctataaataaaaaacgcactttctcccctgctta

SEQ ID NO: 230201 - DNA, 642 bp, Homo sapiens
tgcagctctcacggatgccaggtgaatttggacaaggttggggaattttgacctgttcacataccctgagtctactcacccccacctgaggccacacttggcccctttcttggctctgggtttagacggattacagggggagatgctgtttactgccctctcctttcatttgcaccactgcttcctccatgaagggccctggttgttacttggccccggtccctccctctctcgaggaccccgacatgccaacagccaaggcacagttgtgccttgagagcatccagctgttgtcccctcaggaggaagtatttttgaaggactgttaaataaagaggaaagaatagaaaaaagacacacatctgcctgagagccgtgcttatcattaaaaaactaataatcagacctcattgactgaggcttatttagaagaaattataggccgggtgcagtggctcacgaggtcaagagatcgagaccatctggccaacatggtgaaaccctgtctccactaaaaatacaaaaattagccgggtatggtggcgcgcacctgtaggcccagctacttgggaggctgaggcaggagaatcacttgaacccgggaggcggaggttgcagtgagctgagattgcaccattgcac

SEQ ID NO: 230202 - DNA, 252 bp, Homo sapiens
aaaacagatcaaagcatttcattcttctaagtcagagactgggtcagactgtattttccaaagatagccacatttttgtggatccattcttaccatgtgaaaaacattgtctacacatagtattaccgcagattcctcctaagaacctactaaaattttgtgtgtgtaagtttggcatcaagaaatggggtctatgttccctccctttggacgtgactcctctaccaataaagtatggctatgtgatctctg

SEQ ID NO: 230203 - DNA, 317 bp, Homo sapiens
gcctcccaaagttctgggattacatgcatgagccactgtgcccggcctgctttttaacagtttattttttcttagtgtactaatgtggtgaatttcattgatttattattattttttaaaattttattttaatataaagttacagaaagattataagaagagtacaaagaactcgtatatcctttacccagttcatatttgcaccatttttcatttgtttatcatttccccgattgtcttaccatttccccttccatatatagtctttctatagatgtaaacgcacacacacacgtccttttttttttttaaaaaaa

SEQ ID NO: 230204 - DNA, 384 bp, Homo sapiens
gcgtccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctctttctctctcattctttgcatcattattttttgccatcagtgtgggtttttggttttgaggttatgaagtgaatttctggggacaatctctgttgggtcgtgttaacaaggatccagtccctgtttggtgatacatgacagctaatctggtctgtgagtcttctttattgtctatttattgtcctgagaataatggcatttcctgatatttgagac

SEQ ID NO: 230205 - DNA, 412 bp, Homo sapiens
gagcttctagacagtccctgacttacagtagctactataaaaaattatcgaattgaacctaggggacctgacatgttttgctccataattcagtggttcattgctgttgtccgccaggtcagtctgacttgctgtagcatatagattccagctagtggaaggtatagcttttcctaaagccctgggctggaaatggtacaagtcctttgccttcaaattttattgtcaagaactgaatcacataaccacacttaactgcaagtgaggatagaaaatgcaaaaaccaccaggtgtggtggctcacgtctgtaatcccagctcttagggaggcagaggcgggagaatagcttgagtccaggagtttgagacttgcctgggcaatatagcatgaccctattctccacacaaagga

SEQ ID NO: 230206 - DNA, 528 bp, Homo sapiens
gaaacactgagtaggagaatgccaagtaaatttgttgatattagttagtcagacactatctatagtcaaagaaatagtactctgcattggtctgagtagatggcagacccctcttttctctcctgcagtgctcactctacataattaccagcagtggcctcaagttcagactgacatacagagcacccaccaatccataacctggcttcagattcccttagctttttgcgggaggatataaggcaggaaacggcattctagcagggtagtatcagtggagtctttatacaaatccagggaatatttgttttactcatcaagttacagcttagttgtaagggaatgagacaatggaggtagtatagaaacacctgagcttaggtaagacatatggtccatagaaaccggtagcttgaaacaccccatgaacttagcttctgcgttcctccaagggccatactcagttaggagagttgcactacacacaggaaagccaaatcatctgcttctgaacaagtatttgtagtc

SEQ ID NO: 230207 - DNA, 654 bp, Homo sapiens
agtgtagtgagtggctcgatctcggctcactgcaacgtccgcctcccgggttcaagccattctcctggctcagcctcccgagtagctgagattacaggcacccgccaccacgcccggctaatttttgtattttttagtagagatggggtttcaccgtgttgactgggctgttctcaaactcctgacgtgagatgatccgcccaccgcggactcccaaagtgctgggattacaagcgtgagccaacgcacccggccacataaatcaattttaatccagctgtaacttaaggtggttacacgttgtgtacattagaccccaataaaaacgtcaaaaacaaaacgaggttccttggtgcctgctgaacctgccaactgcaaggtcgagtttccttgtgtgggctgcacccaccccaagcccctggggtccccaggtgtgttccaagttgagcagcagctccactgcctgaaatgcacacatctatgcaatattcacaaagtgagtgccagcacagagacaattcatccccatgctcacccagaaggcaggtgttctgttccaggctgacaggtaaggaaacaggctcagtgaggcaaagggtcctgcccaaggtcacagagccaatttgcaggacggctgagacccaaagccccggg

SEQ ID NO: 230208 - DNA, 430 bp, Homo sapiens
cagagtgaatgtttcctaatgccattccctttccacaactccactccacgagagagaagtgacttaagcctgctaaggagcggagggaaaagttcaggaaggtttcagcatgctatcattagcgctatcattagctcttgaggactgaataggaatttactaggggtgggtgggggagaatattccaggcaaatggaagagaggtagatacaaaggcacagaggtatgtagggaacaataagggaaattgtgtatttgctgggggagggctaaagatgaggattcaaggccaggagcagtaatcccaggactttgggaggtcgaggtgggaggattgcttgagcccaggagttggaggctgtattgatctatgatggcgccactgtactccagcctgtacgacagagcaagactctgtctctaaaagaga

SEQ ID NO: 230209 - DNA, 495 bp, Homo sapiens
ctagcattacttcatctagcattactaaaatagcattacttcaggatggtggaggatcggcaatctaatagcaaatctttattgaactcttcttactgccttaacatgtgccggatgctgagagatgaattcaaagcctcttagggagtttatattctagaaatctttgatcagaaattcctagaagagagggaccttgtgttcagcactctgtagcagttcttaaacagtagcacgcataataacagggcttttaaaaacatttttgagcctcaaaaccgggtatcaggattcagtgagtaaggggtggaggataattcgaatttctggtaagcacacacgatgctgatggggtggtcgccatcccagcagcacagctctaaacgcggttcataactgtgtgtattttctcaatagtgttagaaaagcaattgctgaaaagtcacacctggttctacaatatttactcttaggttttggttcgatagtctaaat

SEQ ID NO: 230210 - DNA, 365 bp, Homo sapiens
aagaaactgtgttctaaaaacgctaatgggctggatatgcctggtaggtaacagtttgccaacccctggtctaatcccatttcaaaatcaatgcaaaaaggacataatcagtgctgcaatacttttattcattaaagtcaacattacttctctgtaaccactctgaaaaattcctgttaccactgaaaccgaggagtgaatgaaatccaccaatttcaagttctatgctaaaacatgctttgtcgttatacctataactataataaaacaacctcatattctgcacacttcctaagtccgtagatattccccaactacaactgtataggtaaggaatttgagtcatgtgtatttgacataaaggc

SEQ ID NO: 230211 - DNA, 481 bp, Homo sapiens
cattaaacaagtaaactaatttgcataagtatatattaaggattttagggttttgatataatgttgcccaataactctctatatgccgggcgtaagaacttatcaagtatatagagggtcaggaacagaggaatgtgttcatggccatgaattatagatgaaagggtttccagattggaatgcagttgattatagaggagttcttagagaggggtaaaaacatactaccaatgaaagatgtagacaattgaatataagatgtaaagttttccaaaatgattttcagttgtactgtttatagacatttgcaaatgccattgttatttatattgattctttttggaattattgtattcttctttttctattgatggttgttttccattgtatagctgtaccacagtttatccattcatctactgaagggcatcttggttaattccaagttttggcaattatgaataaagatgctattaacatc

SEQ ID NO: 230212 - DNA, 953 bp, Homo sapiens
tctataccaggttgtatagatggctgcatggaaatggagggaaagcggagggtgacttcagcttaattcagccatattggtaagcatctcagtgtcctttgcattctgtcatagaataccttggggttcagaacatgagatcttccagataaaacagtcaaagaagctgcagcagtaggaaggacagctttgaaaacaccagccctccaccgaggataaccaaaggcgccattttgcccatccatgcagtctgtagtatccctctgcacttgaaagcccagggacttagtcactgtgtgctgtttgtagatcctccgggtgaagaggcagataactgaaagttataccatgataatcactttatgttgttagtaatttcagtggggaaaggaatgcctgagcagctagagctttcctatagatgattctgaaaaagaatacctcgaatagccatatgttttagcgatacatttctgaatatttatcaaacactatggtattctcatcaaatacaaaatatgtcatgagcaagccattcatagccagtgaaagaaaataagacaccacaggtaaccagccaccatcatagcagcacactggaaagaaagaggcgtacatccaccagcaccctgatattgtcacccaatctgttagggctggaataagagatgcacctaacagaaggatcatgacaaaatctgagtcaacatgttttgtgaaaggttatttgcaaatccatcctaattgtttcaaactttattttgatacccaaataacgcaaaactgttttcagaactataatactgtcagctctattttacaagttatgaaaaatcaagtttagaatcattaaccacattctcaataggcctgaaaaagtgcttattatcaagcagttatcacacccctccagaagaaagagggcatcatgttgaattatgtccataggtgct

SEQ ID NO: 230213 - DNA, 471 bp, Homo sapiens
acacttggagtcatatgcaaccatttctgcactatgttattgactacgccgtaagcagtagtgggggcttgagctctaggaggcagggctcacagaggggttgggggtcgtcttggagggtggatacctaaacattcttcgctgaatcctgaaagcaaaagaaaactctaaaaagatgttggggggagcacagtgcagtgcctcatgcctgtaatcccagcactttgggaggccatggcgggcagatcacttgaggtcaggagttcgagaccagcctggcccacatggtgaaacccccatctctactaaaaatacaaaaagtagccaggtgtggtggtgcatgcctataatcccagctactcaggaggctaaggtgggagaatcgcttgaacccaggaggcagaggttgcagtgagctgagatcacgtcactgcactccagcctgggccacaatgagactcttatctcaga

SEQ ID NO: 230214 - DNA, 292 bp, Homo sapiens
ttggtatttcgggggtcttttgaagaggagtctgctctctgtaatcattgccatgttttatttgagctctcggagatgggcatttcctttgcctgggttttgtggaggagacatgcactaactagatttggggtttcaaagactcaggtcctcagataatcacttggtacctgttctttggccagtggccaaacatctccgcatctcagcatctttcttctagggactgttggtcaacagcttatgctaccaacttctaccctgaaaaatattcacttttttagggtttttt

SEQ ID NO: 230215 - DNA, 230 bp, Homo sapiens
tggtgcagaggctggtctggtggccagagcagaggggacggtggaaggagctttacctgccaggctcagagtctcagtctccccaggcagcaagagttgacattctgccaccagagaataaggatccagaactcaccctggtgtcactaatcacaatggggtttcctattcgactccaatatttaaatgtaattaatgttaaataaaagcaccttcatttactgaaatta

SEQ ID NO: 230216 - DNA, 365 bp, Homo sapiens
aaaaatttccgaacaggcagcttgggtactgatgttcacatatagttaagtgatttctattttgggtttcttttatttctttcagcattttaaaatgctttccttcaattggcactacaaaaataatgaaaataataatagctgaaagggcattgcatgagaagcgcaggcatgagaagataaagagaacattaaagaaatacaacttttacaggcctgcagtggttgtcaaaattataagaagttcaataaatacaaagatttagttgttttcataactgactgatggacaacatgaaggggtgaaagaagtgaaaaattgctaaagtgaagcatcctgcctgtcctagctgggtgatatgcta

SEQ ID NO: 230217 - DNA, 531 bp, Homo sapiens
aggtttgaaaactttactttcatttttgtaaattatctttattcttctcacagatttgtagtgtttttcttctccttggtgttatgcagcccgttttaagtaatttatttttttattttaaggaattaattttgttatttttctctttttggaacactgcacatttgaattcaagcacttatatctggttttcacttgattttagccaaaaggctgagaagtaattatgtctgcttttcaattttagaaacttatgagtcaccaactctgaatactgactttgattttgaaaatatattctataaaaataatcagacttgttttactccatctcatgctccctgtcatacatgtatattttagattttgttaatataacttttttttttttttttttacagtaattaattactgcttagtgttctagttcactaatcttctcatcatttcagactaatttaatgtttcacacatatgttgtatattaagtagactgattatattttcaattgtttacttcaaaaaaaaaaa

SEQ ID NO: 230218 - DNA, 402 bp, Homo sapiens
ctcaaaatatgtaaagcaaaagctgacagtactacaaggagaaatggataaatctatgattctagtgggaagtgctaacacacatctcccaaacatatgaggaatagaaaacatcaaatcttagccgggcggagtggctcatgcctgtaatcccagcacttggggaggccaaggcaagtgaattgcaaggtcaggagttcgagaccagcctgaccaacacagtgaaaccctgtctctactaaaaatacaaaaaattagctgggtgtggtggcaggcgcctgtaatcccagctacttgggaaactgaggcaggagaattgcttgaacccaggaggtggaggttgcagtgagccaagatggcgccaccacactctagcccaggaaacagagtgagactccatct

SEQ ID NO: 230219 - DNA, 470 bp, Homo sapiens
tcggcctcccaaagtgctgggattacaggtgtgagccacccgcccagcctaaagtggcaattttgataaaacagtattctagttggaagtatgaaaatcctcaacgcttaaatagattttcacctttgaatttttaaactttgttttaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatac

SEQ ID NO: 230220 - DNA, 424 bp, Homo sapiens
ctctggtagtacacttgtataactattttctctgaagctttagtgtttagacaagaagcaatacaagtttttgaaatggtgatggacatctatatacctgatagaccaacttaggaaaagtcagcaatgcgtgcttgagaataacacagcatttttttaagtataggaagtgtttctgatgcaggaaaaaattaacacgttattcttattgtggatgataaagcaaaatcaagactagtaatacagaaaattttagccaacttagataaacatggaagcaagccgtatcatacagcccaagatgcagttgtagagtctttactatttagagtgttttttggttttcgtaaagctaggcacagtgtaaccaagactggtttaaacaaacaaaaactaaaatctctgtgcaaataggtcttgtaag

SEQ ID NO: 230221 - DNA, 405 bp, Homo sapiens
ggctggggcgagggcaagaggtctgtacaagatagacaatcgctggactgctgagaaacggggcttacgtcacacagcttactgtctacattaacgtgacttcactcttcctctgtctgcaccaatctaactttacagctcctgcactctgttggagtgggcacagaggatgacctagggcccagcacctgcctcactggggacatctggccccagcctcaacctggctgtttctggccttcaaccccaacgcacacagagacagagagagagagagtaccaggaccagagcacaaccagaacactcaagagagcaaaatactggtctcagatgccccgcagtaggggatgagctgggaggaagatgaccactggccactcccccacctcctccaaataacacac

SEQ ID NO: 230222 - DNA, 162 bp, Homo sapiens
gcacaaaaccttgtcagtctcaccagttgagtaacccctccttccaatcatttaagaagtgctgcggggaaaagatgaaatttagctacatggctaccttgcattcatgtcatgttaaaaacacaagccttaattaatggcaaataatggaatacctccacc

SEQ ID NO: 230223 - DNA, 532 bp, Homo sapiens
agagaaaaatacatatttgcaacatgtcatgaacaagagccaatttccttaatatgtaaagagcttctgtaagaaaagactgtcataaaccatagaaaaatgggcaaaggatatgaatcgcaattttgcagaaatgaaatggaaatggctcataagcatatgaaggatggtcagctccacttttactgaggaacatgcaaattcaacttaatgagatttttttcttccatcaaattggcaaagataagtttcataactttcattcattgatgcaacttccatggatggtccttaagcaatatttatcaaatttacaaaatacacaccatcaatttcagaattcacacacttctaagaatatatcccttaaactgtactctcacatgaaatgctgtgtgtggaaagctattcattgtagcatcatttttagtatgaatgtgtgggaataaaaactatcagcaggggctgtgtcactaaatgatggacggcctctccatcactgactttgcagccaataaaaaataacaaagca

SEQ ID NO: 230224 - DNA, 465 bp, Homo sapiens
attttttttttcctctgtgctcttagtgctattattgtaagttcttagctggttccctctcaaccattatccttaaattgaatgtgttattgtcactatgttgtgtcctggtagggcatttttgacagtgaatgttgagaaagcatatgcatgtgacagggcggatttgttagaagcagtggaaaggtgagtactaaactgggtgtttaaaatgcaagcttcagctgggcacagtggctcacacctgtaatcccagcactttgggaggcagaggcgggtagatcacctgaggtcaggagttcaagaccagcctggccaacatggtgaaaccccctctctactaaaatacaaaaaaagtagctgggcatggtggtgcatgcctataatcccagctacttgagaggctgaggcaggagaatcgcttgaacccaggaggctgaagttgcagtgagccaagatcgtgcc

SEQ ID NO: 230225 - DNA, 258 bp, Homo sapiens
gcagaataaccaattcttcaaagtaaagctgtactttctgctttacaagttagctctacagtggatataattatcatctgaagtgaagcctggaagtcctgtggcctacttcagagttaggattaaatcagattacacagaccccagagtggttttcttcccctgtattaaggccactggtctgacttgctggtagagcagttgaaatattatactgttgctcctttgggatctgaagacctgtattagattcttccc

SEQ ID NO: 230226 - DNA, 450 bp, Homo sapiens
aaaatactttgggaaataaactatagattcttttatcttaactcacattttatagtatttccattttgtttaggtttattatgaatttgggtaaatctttggaggaaattaatttcaactgaagaaattttaaaaactatttttgggaagaaatatttatgggaagaaatattttgcaggggctcacacctgtaatctcagcaatttgggaggctggggcaggtggatcacctgagatcaggagttcaagaccagctggccaacatgcagaaaccccatctctactaaaaatacaaaaattagctggacatggtggcacgtgcctgtaatcccacctacttgagaaactgaggcaggagaatcgcttgaacctgggaggcagaggttatactgagtcgagatggcaccactgcactgcagcctgggcaacagagtcagactctgtctcaa

SEQ ID NO: 230227 - DNA, 424 bp, Homo sapiens
gtttaaatagctttgtttcatgctcactgaagttttttttttgatacagggtctcactttgtagcccaggctggagtgcagtgtcatgatcacagctcactgctgcctcaacctcctgggctcaggtgatcctccaacttcagcctccccagtagctgggaccacaggctagcaccaccacacctagctaatttttgttgtttttttttttttgtagtgatggggttttgccatgttgcccaggctggtctcaaactcctgggctcaagcaatccagctgcctcggcttcccaaagtcctgggattacaggcgtgagccaccatacttggccttgaagtatttgtaattgctaaagcatttatgatttatttaacacaactggagctgggcatagtagctcatacctgtaatcccagtgctttg

SEQ ID NO: 230228 - DNA, 377 bp, Homo sapiens
acatcaagtgaacaccccttgggacaaaggaatctgaacaacagtcttcagacctagacattccttctgacagagcctactcaaatgagaaggaaccagaaaaccaaccctggtaatatgacaaaacagggctctttaacaccctcccaaaaatcacaccagctcaccagcaatggatccaaactaaaaagaaatcctgattttcctgaaaaagaattcaggaggttagttattaagctaaccagagagggaccggagaatgatgaagcccaatgcaaggaaatccaaaaaaatgatacaagaagtgaagagaaaaacattcatggaaatagatagcttaaagaaaaaaacaataaaaaattcaggaaactttgaaa

SEQ ID NO: 230229 - DNA, 321 bp, Homo sapiens
atataattatatttaggtttgtcttctctcattcacaaaattgctagctcttcagggcagggtccattttttttatacagagtctatattcttcataaattctgagaacaaagtatatattcaataaatacctgtctcattcaattaatgcttaatgggttgaaatatattttgttgaaattacacaaatgtcagaacaaaaagaaaccaagctcctctctgaaaacaggcttgtcctcataatattcttctctatgttttaattaccatttctttatgttttaatcagcattaaaaataaaagtctgtctcattcaaaac

SEQ ID NO: 230230 - DNA, 408 bp, Homo sapiens
atttcatggatatgaatacaatgtgaatgataggacgtgtttagtcatttttgtttataattcattccattttatgctgcttttaagaaattactttgaagagtgatgccaatctgattcggcttttgtaatcttcattttgagcagggccatcaatatttaataatatttccaggagattttgtatttgatgggattgcataaagcaaagattaatctgtatgaaaacacattcaaagggaccaatgatatctattttaatctggggttcccaaagtgtgctctgggaacaacactggtggtctgggagccttctcaagggaccactgatgccactagcgctttttaaaattcaggcaagaatagttggttgacaatatttaataaaaatcatacattactggtaat

SEQ ID NO: 230231 - DNA, 366 bp, Homo sapiens
gcacgagagcaaacacttttacaattaattacttcccttaccctggaaaatctaaacaaatgcttcattatatatttttaataaatcgtttgtgtttatgggggttgtggttggagatggagagctttggggagttaaattcattttgtaatattgtctcagtttggattcttgcattctgaaattttatcctggtttgaaagacaaactcttatctttataacaggtgaataacaataaggcaatgtagaagaaagcaagtcccatcaaagggagctccagtctctatagactgataggagcctcagaacttaaacctctggatcaggagaatcaacactttctatcttccggcagagtctgctt

SEQ ID NO: 230232 - DNA, 489 bp, Homo sapiens
agtcaggctgtcctagtagccagctgtgtggtcctaggcaaattacttaacctctctgatcctgtttccttatcagaaactgggaatagtactctgcagggtggttgggcagatgaaatagaatcacctatgtagtgtgaccctcccatagtagggcctccattaatattcagttttttcctctcatttctattgtttagaaggacagaaacatgcaatgtcctgcgaacatttccaagtggcttcctctcctccaaaagcttcagctgcctggcaaccctccccgcagtatcaagcaggcgcattttaaagtctctttagcgggagggcagggttagagccttcggtcacttgttttctaacttgacataaaacaacgtaacgcagtcactcagcgagccgttggccagcctcgctcgcccggggaggagggaggaggtggcgcgggggcggcgggtacaggccttatacggaggctgcgctgctcgg

SEQ ID NO: 230233 - DNA, 439 bp, Homo sapiens
caggctcctgccttctccctgtagctcacccttttttcttttcctcatttctttgacccatccttcccaaaggcaaaaaaataaaagccagaaccactctttccattttattactcagaatagttcagctatctccaagctgaacccttcaacacagctgtggtcttcctctgaatattagcagaagtttcttattcaaaggcctcctcccagaagaagtcagtgggaagagatggccaggggaggaagtgggtttattttctgttgctattgatagtcattgtattactagaaatgaactgttgatgaatagaatatattcaggacaatttggtcaattccaatgcaagtacggaaactgagttgtcccaaattgatgtgacagtcaggctgtttcatcttttttgtttattttcaatgcctaataaacagagatcct

SEQ ID NO: 230234 - DNA, 478 bp, Homo sapiens
cattaaaaaaaaattaaggcattttatatagcagccgtctgaatccatgcttcctgaattagtctcattgggcttttacaggctccctgattattattatgggacttttgcagtttgcttccctgtgtagctgcaagcctgcttccttgtggcagaaaattacttcccagcactgttgcaagtgcatatgagaatacctacagtagactcaagacaacattacaaagaaaggagttccttctttaaccaacccgaggcctgcctttccatcctcattttctgttccagaaaactggcagtgggaaaaatttatctccttcaggggcaagtacacttggcacccatggaagtcagtcctgtgaccccaacaatcatagcagacaatctcatcacagctgcatcagcttcatctcaagcaatattcacagaaaaggaaaattttttttctttacatctcacttccatgcacagtaaaaaa

SEQ ID NO: 230235 - DNA, 458 bp, Homo sapiens
ttcctcaagcaagttgtgacaacacatgtaaaatgtttaccagggaagctcattagagactcagtgcccagggtttatattaggggttgttaatatacacactctctgtatagcatgcaccaaaattatagatcctagaaggaaaacaggtattcagcacaaaccacattttttgtaaagtgtaggcacaatgagctgttcttactaggaaatagtgggaactgtcctgaaatctaaatttgccagatagccagcgaggggccaacctgcaagcagaccttctagggatagcaatctcaggcctgctgtgttaactcttttctgtaccatggtatgttatgaaatgtattttacttaagaaacgaatgtcaacaaatctagacatttaaaaaaagctttattgagatacaattctcacattataaaattcaaccaattaaagtgtacaatgcagtgat

SEQ ID NO: 230236 - DNA, 521 bp, Homo sapiens
atagtttgccaactatttaaacctgtctatttagctattctagttatggattatacttctgaagattaaggtttggaaaattctagtcataaatctagttgccataagcaggaagccataagaaaattcatataaaaagtacgtgtctttggaatttgaccatctgatccacatactcctaattgtgggctaagaaggaaagttttttagtgctgatttaagtaaccctatgaagccctgttagcctcactttaaacagaatttataaactcattcccacttaaaattcactagaattttcttattacagttagtgctttattgttaacagaaatattgagatgtgatacagaattttctttaagaaagaatgagactgaaatttataagagagatgaatctttacaattccaagcctttctcatttcaagtttcgtgaaacactggtggatagttttaatgaaactaatataaaagaaaaagataactgcattaaattaatagaaaccttatatacaaca

SEQ ID NO: 230237 - DNA, 276 bp, Homo sapiens
attatcttttatttaaggaagaaagttgtaccagaatattataaaatattcttaggagcaaaggcgcaataacttctcagtagctattggtttaatatttctcaagaaatacaaaatatgtctatgaaatatacatgggttggagctgcctgtgcccaatcagtattcatatcgaagagatcttgggaatgggaagaagagaaaaagtttcatttaaagtggtaagggaggtttctagtcctggggaaatattaaagtaccttatttctaccgtaa

SEQ ID NO: 230238 - DNA, 797 bp, Homo sapiens
atataccccccttcccccatgttcctttatctcaatgaatggcctcagtaatcctgaaaccaaggtcggctgcatcttcttcctccctgcaccctccaggagcaatccatcagtaagtcctatcagcgtgacaccgtgaatgcctctcctcctcgcttccttccagttgcccctgcctggtcacaggcctcatcctccctctctggcccaattggatgccctctgcttgcttgcctcgtctctgactgtatcctgtgggtgacatgcatgcatacccggtaccacttaaaccccccatgggctccagggccccacttgtggtgtaccaagccactctatccccttggccctgtgtcccttccttttcctctcttgctccagccttacttgtaattcctcagttcacacctccatcatgtctgtgagtctcaagatctcctagcccttctccagacctgttcaagacacccctagcccttctccagacctgttcaagacacccctagcccttctccagacctgttcaagtgcccctttcatcactccccatgtgcagttccatagttgtccatttcacattgacttccatgtatctggagggcaggagccagctctgacccaacttgccattcccaaagtaccctctcagtgaatgtggatgggtccccctgccttgttaataagtcatgtgattgagcagattgtgtgacttgcccctcttgtcttggaaggtcatcctgcccagagcttgtgaaggtgcagtggcctgagccaggcttccaagaggacaaccgtga

SEQ ID NO: 230239 - DNA, 954 bp, Homo sapiens
aaagcggtgtagggagaggcttgggcttcggttatcatagaaacagaggccggctacacctaaaaggcggggcgtggacctaagtcgtcgccaaagaaacggcgttctggacggggacgtagggtcccgcccattccttctcgtgaaagcgggtgactggtcatgattatgattgatagcctcctctcccaatctgatttctaagaggtcccaacccggaaccgacttgcggttcgcaggctcccctcgggtgggagagttgggctgggaagcacctggggagctctgaagtgtcttggtgagcgcgttgcgagtcagaccgataacatcagaatctgggactgggcccgagcatatgcgcgtcaaaactcctcagttaagtctatttttttgtattttttttggtttgcttttttgagacggggtctcgctctgtcgcccaggctaatgcagtgacaccatcacggttcactgcagcctcgacctcctgagctcaagcgatcctcctacttcagcctccagagtagctgttaacaggggcgcgcgccaccacgcccggctaattttctttcttctctccctccccctccttctccccctcccttcctcctcccactatgtcgcccaggctggtctcgaactcctgtactgaagcgaccctcccacctcaccctcccgaatagctgggactataggtgggagccaccatgcctggatagtttttttatttttatttatttatttattttagagatagggtctccatatgttgcccagactggtctggaactcctgggctcaagcgatcctcgtgtctcagccttccagagtgctgggagtacaggcttgagccactgcgccaggcccctagtccggctcctagttgattctaacacgtgcggccccattggggaaccacagcctccccagcccctttgggtgttgctgactcta

SEQ ID NO: 230240 - DNA, 550 bp, Homo sapiens
cattgattgattgacttagcatgaccattgtgacggcagtaaatgtataagagaaggaccaatcgacattttaagttccagaatcatccatctgctgggtcacgttctccatatgtgtgggtggttctgtttcagcaaatggtcttttcactagcccacatcaagacaaagacatgttctgaactggagatgatgccaagcctgggctgtgaagaccacccacaaaggcttcagtggaaaagagagaagacactggagaggcatgaaacggtttgaggatgaagagactggacagatggatggaggaccatgaggtgacccaaccaggggcaagaaggaagagaatcggctgctgtaggtcttgggcagcaagaagtttacatcgatcagtttatactgttggattaatactgtttggctggaaaaatagtgtaaataagatgaatataagccatctggttggtatattggtgcaaaatgatgacccataagtaattgagagaaatgctagaaaaaataagaaatgtgttttcgctttttgaaaaagaat

SEQ ID NO: 230241 - DNA, 520 bp, Homo sapiens
aacgtgaaaatgaggaggaatagatggatttggactatattttggaagtctactaaagcctggagatgaaatacctgatccttattgctgtttccagatatttcaccctctcacattcctaaaaacctatagcttttactctcaggtcactagaatataccacctactatctcttgttgcattgtcaatttatcagctcccccaaagtcactcctgctttctcaaaaatactggtttctggctcactgtctgtccaactccattcctgtcttaattcttggctttttcagtgtatatgtaaatggtccttccaacaccctcacctctctgttccttcaactcatatccagtgatcgtgtcctatactcctcagctattcacttccatgatcatataactttgtcattgtgaaaccctccttaatctcattctttgacctctacctcttatctttccactccctctaatactgtactccagcctgggtgacagagcgagaccgtgtctcaaaaaaaaaaaa

SEQ ID NO: 230242 - DNA, 382 bp, Homo sapiens
caactcccagataattttgcctcatttgggaataggctgtatgagtttagttatactattccccttgggttgggtggagaagggagtaagagtatcactagtctactctgctcctttctttcctgactaacttaagttctgccttgaattcaacaagctgtttgctggggttaacgctttccagcacaagtcagggatgttttccgcttcagtccctcatccttcaattttgcagatcctaatgcattggttttcccttggccctctcatttgcaacagctcattcctaaggcccaatcccagttcctgatggtggatgttgttccagcctggaaagctgaatcacttcctctccagtaacgaataaatagactagatttca

SEQ ID NO: 230243 - DNA, 460 bp, Homo sapiens
ccaccctgtcttgattactattgctttgtggtaagttttgaagttagaaagtgtaagaactccatttgttattgtttttcaagattgttttgtctgttttgggtcattataatttaggatcactttgttattatctgcaaagaagccaggggagattttgatagtgattgccttaagtctgtaaatcaattagggaatattgccatctgaacaatgttaagtctttcaatcaatgaacattgaatttatttccatttatttaggttgtctttagtttcttttgacaacattttgtacttttccatatacaagtctggcatttgttttgttaaatttattcccaagattgtttttctttttgataccattgtaaatggaatcattttcttaagttcatttcagattgttaatttctactataaagaaatacaattgattttgtatattgatattacatctt

SEQ ID NO: 230244 - DNA, 427 bp, Homo sapiens
gcctttctcaatcactaggttcataagtgtttctcccaagctccagacttttcctaatgaccttggttgaagatttgggacttcttccgcagagctcacctgtccatgtgagatggtctcaaaactctctaacattcttttgaagtggagcacagcattaaaattatcttcattccttacccatgcttttaaggaagttatccagtgtgtatagcacattaagcacaggtaccattacagaatttttatgttgattctattctcacagctcagcgtttactttcaatagcaggaaacaagctgagggagaggtgtggtgttccccttgtgacaaaggcaggatcgaagcccatttcctctgacctccatcagtgctgtggcttccagtttggcctgactctggaattttatctcggcacgcatgtag

SEQ ID NO: 230245 - DNA, 425 bp, Homo sapiens
cactaccaacaaccacaaaactgactaaatgccaactatgccaccaaatccaataaatgcacaaatgattgttcactcacctgggcatctgggggacaactctctctctctccagcctctttgaaccactctctcttagcttcctttgtgagtcactctactgcccaaaattaaacaccaaatttcctcttaggtctatccaattcactctcctcaaatcactaaactcaacagacagtaagagagagagagaaaatcttatgtaccccatatcatcaaatatcctttataccacaataatttctaattttgttccaccattcaggaacccagatctcacactgcctacttgagacctccatttggatgtcttacatatatctcaaaattgacccaattactttatcttctcaaacctttttctc

SEQ ID NO: 230246 - DNA, 459 bp, Homo sapiens
atcatgagtgaataatatgtgtcagctctgggctaggcctaaagaagtaggactgttccctccagggtctccttccacttctaccagctcaaggcaaatgatgtggaggccccagggcattgcagaaccacaggatagaagcatcctgtgtgcatgagtcagacatcgagataagctgttcactttggactattgcatggaagaaaacaaacccaaaggagttatcacttatctgttaggatggctagagtaaaaaaaacaataacaagtgttgacaaggatgtggagagattggaatcctcatatattgctggtgggattgcaaaatgttgccgtcactttgaaaatgtttggaagttcttcaaaatgcttaacagagttaccatatgattcagtaattccactcctaagtatgtgtccaacagaattaaaaataaagacatacaagttggaagggta

SEQ ID NO: 230247 - DNA, 517 bp, Homo sapiens
cccttttcacacattggattccacttgcctaatctctgtgatgcataccaaaaactccaggaagcttaatcagccaaaagaactgaggggacaagtccactctatggccaaatgcattaactgaaagagagcaatcttcactgaaaaccaaagttatttcaaagattgaggataaacttccaaggattattaacctaatggcataattattctgcatgattctaaagatcctctctaagttcatcaagtcatcatgtttgaacattctagtggtccctgcattactagctgactggagagttgaaagaaaatgaaggaggttttgactggtcggtcacacacagtcttcactgagaagctagtattcctcttcttcaacaaaaaagaaaattcataaaatgaaatctacataattgcatctcctaaggattattggaagactacaataaagcattttgtcaaatgaatgtgctgaggtaaaagaaaataaataaacaaataattaaatggatttaca

SEQ ID NO: 230248 - DNA, 468 bp, Homo sapiens
atgcgtagaaaacagatggaagtgttggtcattagagccttgctttttaaattttattctttccaaaaattggcggtatgctatctataattttatgtttgatgttgaagaggcaacaccagagactagagagggagattactctgatatttagtgcctaaaactttcatcttggccgggcacggtggctcacacctgtaatcccagcacttcgggaggccgaggcaggctgattacctgaggtcaggagttcgagaccagcctggacaacatggcaaaacccgtctctactaaaaatacaaaaattagccaggcatggtggtgggcgcctgtaatcccagctactcgggaggctgaggcgagagaatcgtttgaacccggtaggcggaggttgcagtgagccgagatcatgccactgcactccagcctgggcgacaagagtgaaactccgtctcaaaaaataataat

SEQ ID NO: 230249 - DNA, 385 bp, Homo sapiens
gaggtttatggggctggggtccaggtgggctgcgactgcagggcgtcctcattctaggagctgaggggctataacactgcaaggcgcagtcagacagctcagagccgtgcccagggtctgcggggagaagcacactggctaggctcctgagggacacacacagccacaccccaggatgcaggacaaagagaaggtgcccctggggacgcggcatctcctggtctcccagtgtgatcctggatgagggaggccccagtgtgctcatgtacgggttgcctggtagaatccaacagacccaagtcctctctggggagggaccaccctcctgggtcccacaccaaccaaaagctctgcaatccaggcccagcacaggctacacgtctgg

SEQ ID NO: 230250 - DNA, 611 bp, Homo sapiens
tacttataccttttggctattataggcattattcaagcatgaataatggtgacaggaacattggtgtacaaatatctgttcaagtcactgcattcgattcttttgtgtatatacccagaagtggaattgctccacaaatatttgagtacctagtatatggcaggcactgtgctaagcactggggatgcagcagtgaaaaagaggggcctggttcttgcccttatggaatttacagtctagtagggaaaaaagatgttaaataagcagttgcagttaagtgggttaaatgttacaaaaacgttaagcacagagtgccgtgtgtatgtttcatataattgtaataatatatatatgttaagccaaaagagactataaaacatcaaatactttttccccttccaatataatcccctgcagcacctcactacccctggccacctaccacatggaaatgtcttctgctgcttttcttcacatttaaaaatgcaatgccgctgggtgaggtggctcacgcctgtaatcccagcactttgggaggctaaggtgggtggattgcttgaggctaggagttccagaagagactgggtaacagcaagaccctgtctctacta

SEQ ID NO: 230251 - DNA, 471 bp, Homo sapiens
gaactggttttgagaggaccctatcacctctaatttggaaatcatagcattttagaaaaattattattttttccctaggataataaaatttgcttaaaaaaattcaacttcagatgacaccaaaatttggctaccaaatgattaaggctaatcaatctgcaaggtttttgggttgatctttatatgatcattcagtaagagtgtatccatgctgttctatccataaacataccagagtgctgacctttacagatagcaacgaataatggatgatgtattcatgcgtgtgtgtgtgtgtgtgtgtgtgtgtgtgtgtgtgtgtattgcttccagggagtttaaaaataataagagaagacttagtatcctaggagacatttgctttccctttctggttttctctactttgtaaaatagttcaggatgagaaagccatctgaggccatgtacttagatttacttgaaagtatg

SEQ ID NO: 230252 - DNA, 461 bp, Homo sapiens
gaactggttttgagaggaccctatcacctctaatttggaaatcatagcattttagaaaaattattattttttccctaggataataaaatttgcttaaaaaaattcaacttcagatgacaccaaaatttggctaccaaatgattaaggctaatcaatctgcaaggtttttgggttgatctttatatgatcattcagtaagagtgtatccatgctgttctatccataaacataccagagtgctgacctttacagatagcaacgaataatggatgatgtattcatgcgtgtgtgtgtgtgtgtgtgtgtttaggtaatccttacagttccatttcccatgggaaaatatgctggagttggagttagaaaatttgggtcccaggcacaactctgcccctaatttcctgtgtgtgtgtgtgtgtgtttttaggtaatccttacagttccatttcccggtgggaagt

SEQ ID NO: 230253 - DNA, 719 bp, Homo sapiens
gattttgtgaagcacaagactcaggtggtttggtgccttactgagctccaaaaggacagaaattccaggagcctatcatcttaagaacccctggagacacccaggtttcataatcaaggctcagcctgctgtgccaggaacggctgatgcagcagttgactggactacagtggggaggcagggctggctgcagcgaggctgggctccgtggctgcaggaagaggggagaatagcaggtgctgggcatgagttcctcactctccttgaaatgaaggtggtggggtgtgctttctagagggtaatggaagttgccccctatggaaagtagagagcagcagaagcccgttgagcagagaagagaaaggcaaataattctgattgatttgtaatggctgcctggagcatttactgaaaaggactttgaggctgtattagggatccatgggagagagttctgtgattggttggtgatgtctgcctagtagagtttttgtttgtttgtttgtttggcctagtctctgggtccagtctgttagaatcctgaagaaatctgaggcctgccagagataggctatctcaatctgcaactgaatgtatgggttcttttccatcctctccagctaaactctctgagtgatcaaccatctcattagccccttcccttagagatgatgtcctacatgagaataaagaattactcagtctagaaacagaaacaa

SEQ ID NO: 230254 - DNA, 457 bp, Homo sapiens
tctccagcagacctgcatcacaagacatgttctgatgtctgatggaaatctggatctactcagggggatgaagaacaggaaatgttgactacttggatatgtatacaagatatttttctttatgtaagtctctaaaaaggatattgactttatacaaaaataacatcaaatgtattgtggggtttataacatatattgaaaatacatgacaatcacagcctgaaaaggctatgaaaaagaagtaaagtatatactattggaagattcatatatatactgttactgaaaagtacactgattaaagcttttataaacattgatgatcacagaaaatataaatggtatataacaccccatttaaaggcagagatttctggataagataaataaaaataagatccaatcatgctgcctataaaggaaacatgttagattcaaagacaaatagataaacaaa

SEQ ID NO: 230255 - DNA, 438 bp, Homo sapiens
ttacatgaccaatattttatgggtcttacaaatgtgtaattctatctaattttctttttgaaaaattacctattttaaaaaatccacagatcttactcatttctcttttctttaaaatatttacttgattctaatttttcctgattaataaggaggacatttttttctagtatctcatcttccagcttctcccacactacttgtcagtggcaagatccgtcatcaaagtcagtttagaccacataatagcatttcttaggattttgaagggctttccaattctttcttgagattaaagttcttggctgtagtcttcagtgagctcacaaataatctaacttccatttcttttattgttctaattatccaagtttaaaaaattattgtctagtttgttttccttatttaatcggtgctatgatgtataaatattgtttg

SEQ ID NO: 230256 - DNA, 403 bp, Homo sapiens
actggagccacaaaagcaatgcaggaggaagaatgaatcagctttgtaaccagcttcatctgacggcttagatggccactagaagggaaggtgctgtgatttgaacgatgttgtcccctacaacattcatattgaaactgaatccccaatgccacagtatagtaaaaacctgtggcttttgggaggcaattgagacataagggctccattttcaaaaatgggattagccttttagaaaatggctcaagggtgaagagaacattcccttggtcttctgacttccaccactagtaaggacacagcaacaaggtgccatcttggaagcagatgtcaatgccagcagcttggtcttggacttcccaacctccagaactataagaaataaatttatgttccttataaa

SEQ ID NO: 230257 - DNA, 393 bp, Homo sapiens
cctgaagtacatctttgtaatgtcccgaggcagggtttttattctggagttagagggtccataaacttgggtgagaaaaaaaaccctctttttaaaaaaaaaaaaaatacaaaaaccaaaaaaaacccaaactaaactttggctgaaagtttgcatttcctttgataggaaagtgggcaagcagccacactagagtcagcaggatttgtcaccaatagaaatcagatctgtgatataacattacatttgttgcagatatcttgaaatatttccacttgtcagtacttcaaaattatagtagttatttatttgacttgctgctagatcttgtttatttaatatgttaaaggactttttttactctataataaatttgttttttcaacattataa

SEQ ID NO: 230258 - DNA, 426 bp, Homo sapiens
aaagataagccaagtgtttaaaatgagcaaaggatctgaatagacatttctccaagtggccaataagcacatagaaatgtactcaacaccattagtcatcagagaaatgcaaattgataaagaagtcagactgtaataagtgttgatgaagacatggagaactgaaaacttcatgcattactggtaggaatgtaaaatggtgcagctgctttgaagaatggtggtaattccttgaaaagttaaacatgggttactatttgacagcgattcttgtcctaggtatatatacccaagataaatgaaaacgtgtccacacaaaaacttgggcacaaatattcatagtagtgttattcataatagccaaaaggtagaaacaaaccaaatgtctgtcagtaacaaatgaataaataaaatgtgttatatcta

SEQ ID NO: 230259 - DNA, 441 bp, Homo sapiens
ggtagactaagcacagatacttaacttaaactccctaatataatagtgaaaggactttactattttctaatctgattttttgattgggtaacacatactcatggttgaataaatttttttacttatataaaaaaggtcagctggacacggtgcctcacgcctgtaatcccagcacttcgagaggccaaggtgggcggatcacgagctcaggagatcgagaccatcccggttaacatggtgaaaccccgtctctactgaaaatatgaaaaattagccgggtgtggtgacaggcgcctgtagtctcacctactcgggaggctaaggcaaaagaatggggtgaacctgggaggcggagcttgcagtgagctgagatggcacccctgcactccagcctaggcaacagaacgagactctgtctcaaaaaataaataaacaaaaaac

SEQ ID NO: 230260 - DNA, 604 bp, Homo sapiens
gatcacttgagcccaggaattcaaggctgcggtgaaacatgatcgtgccactgcactctagcccggacaacagagcaagaccctgcctctagaaaaatgcaaaaactaaaataaacgacacagtgcagtgtatgcaggaaaaacacaaaaactaagataaatgacacagtacatttccacagaatgggtccacatggcagacttgccataggaagataacagcctccttctctcaccctcctcagaagccgtgccccggtggtaaccccagcctttccctggctcatgaggaaggcacaaacacataactgaagaacgctgacaatcctgtgggtcttattgatgaatcacagctccgaatcacagccccacagccctatgtatttttttcagatgacaaaccacaaactggggaacagataagagcagcaagacttccgagaagaaagcagttttataagggtgggtccatgaatctctatctatcacaagtttagagggatgactaagttcccttcagaacatttgctgagatagaggttagaagggtacaaagatggttggttgtcaactggctggtaatccaagtcatcactgagtgaga

SEQ ID NO: 230261 - DNA, 342 bp, Homo sapiens
tactgttgaatctggaagtttattaaaaatctaaatccctggcaatagcagtaagacatgtttataaaaattaaaagccacaccacaaagcataaaactgtaccaggtaatttttcatgttcccattacagagaagagctgtgagaagcaccacattgcaaactattaagctattcacaactacacagtgaggccaggcatggtggctcacacctgtaatcccagcactttcggaggccgagggaggaggatcccttgaggccaagagtttgagaccagcctgggcaatatagcaagaccctgtctctacaaaaaaaaaaattttaattagccaggcatggt

SEQ ID NO: 230262 - DNA, 557 bp, Homo sapiens
tactgttgaatctggaagtttattaaaaatctaaatccctggcaatagcagtaagacatgtttataaaaattaaaagccacaccacaaagcataaaactgtaccaggtaatttttcatgttcccattacagagaagagctgtgagaagcaccacattgcaaactattaagctattcacaactacacagtgaggccaggcatggtggctcacacctgtaatcccacctttccctggctcatgaggaaggcacaaacacataactgaagaacgctgacaatcctgtgggtcttattgatgaatcacagctccgaatcacagccccacagccctatgtatttttttcagatgacaaaccacaaactggggaacagataagagcagcaagacttccgagaagaaagcagttttataagggtgggtccatgaatctctatctatcacaagtttagagggatgactaagttcccttcagaacatttgctgagatagaggttagaagggtacaaagatggttggttgtcaactggctggtaatccaagtcatcactgagtgaga

SEQ ID NO: 230263 - DNA, 330 bp, Homo sapiens
gcatcatttggcggttatctattgtttgtatagtatatcgttagttaccattttatggatctcgccttacagatccatcagaccctttaaggctgtgactggcttctctgggatttccccggttgccagagtgtttcttgcacataccaggagtaaaaagttaatggaactttttttttctgttcattgatccacttacgggatcttctgcagattacctaattctaaggattggttcacctcttcttgcatgatttgcttggtttctaggctatccgaattttttgaaaaaataataaaagtccccttttttatatgagcctgtacaga

SEQ ID NO: 230264 - DNA, 357 bp, Homo sapiens
atctgatctctcttgcttttccccacatgtacctgtctcataatccccttaaacatatgcaaaagactacagatttaatagcttctcttctcataaagggatgccaacgttgcgtccagctgtcaggatatgaccctgctattcttttcctacctttaagcgaggaacaatctcatactctcttagtttgtgatcttgattggcaagtagcaatgactgactttattggtaatatcagctttcatttaccagcttctaagctcctgaactttttacaaactgtgcctgttaaatttgtatctattgttgtctctgagccttttacttcatgccaccactgtctttacagatggctca

SEQ ID NO: 230265 - DNA, 490 bp, Homo sapiens
gtatttttagtagagacggggtttccccatgttggccaggatggtctcaatctcttgacctcgtgatctgcctgcctcggcctcccaaaatgctgggattacaagcatgagcctggccaagtgctattctttatttcagattgagagttgggaaaaactggagcaaataatggatttctttcttgcttaaaatgtatttatatgtatgtcttattatatacaaggcagatttccctggaataaaagtctagaatgtgctgcttaattttacacatgtgtgcaggcaatattatctgtgagtgaaaagtggaataatacgtggattgggtcaactgattatcagcttgttaggagtcctctgtgtgagacatggtggtataattgtgaagttctcactgtatgtggatgttcatgtgaaagatagtactttcttcccgtaaatatcttttgatttccatttgtatggaatcccaatgaatgtatctttgga

SEQ ID NO: 230266 - DNA, 518 bp, Homo sapiens
gagggagaggttgctaatacatcagaggtaggtgatacagagatgatggaatgggtgaagatgtcttgtggtgaaaggtgatttttgttttttgcatgaaactgtagggaagggtgtcaactagggaaagtggagggaggactccagaattagtcatagattttaggaatgggaattctcaccttggttttctcagtgaagtaggaggcaagtttcatttgctgaaagagggggttgatgatgggaatggaataaggaaattgatgaagaggtggactggctactttgggaatggggagaggcacctagaaggtataaacacagttgaaaattcgaagggctccatggagtcccctgtacctactcacttccttgagggaaaacatgtttctgactgtcagaaaataaaaaagaaatttacacaatacatgaaatcagctaactagattgtgaaacagaaatcatattctattttaaggaagtatgagaatccacagagtttttatatcaagattaaa

SEQ ID NO: 230267 - DNA, 498 bp, Homo sapiens
atgcatttaatagtatttgacatagttgaaaattttagtcttttaatatactagggatgactaaaagttgaaagacatctataactgttatagaaacctgacatcaacatgtttcaaatttgtaggtaaggaagttttattataccttatctagctaatgcctaatttttgttgtacttctaagtaattaagatatctagttacctaaatggaaatctttttattaattaatattgctgatacaagaaaagaaaatacaaagtattttccatgcagcaacatggaaaatacattgagttctctttttgcaacataggataaattatcttttcatctttctttgcccctggcagatagggacaaaaccagtactgaaagaaatgtctaatgttgaatcaactaattaagaattgtcgactgaaaacaaattatgtcaaattattacattgactttaatataattaaatgtgagatatgcattattaacgttattggatt

SEQ ID NO: 230268 - DNA, 350 bp, Homo sapiens
gtaacagggtcttgctatgctgcccaggctggtctcaaacacctcgtctcaagcaatcctcctgcctcggtctctttattatttttacaatatttgtcttcctcaataaagtagctatgttcagtcaggattccagcacataacctaataccaggaatccacaatcatttggctgacagagacacatctagaccaattaaagaaacagacctaagggtgacagctttaaggctcttgatataattaatttgagcagaataacatcaactgacatttaaattaaaaaattaggctgaacttttcctttaatagtcactatttcaataatcatatcataactttctgggtcc

SEQ ID NO: 230269 - DNA, 304 bp, Homo sapiens
actaactcttagacaggtactgcgcccagggctgaaaagggagctgtctgcgttcttccctgctttttcaggagctcacggaagaggccatgctacccaccaggggcaaacaccaaagaagagaaaggggtctttgaagatgacaggaaggtagtccattccaaccctaaatgatgaactctgtgaggctcagtttcctcttctgtaaactgcagacaatcctcatagcatccctgtgaaaatggaaaagctaagatgtccagtgtgcttggcacagttgctaacatgtcataaacaccccaaa

SEQ ID NO: 230270 - DNA, 564 bp, Homo sapiens
aaaaggaattacttttttctttgattttctttttcttccttctcttgaggatcatgaaagtataaaagaatactttctaaatgagggtgcctttttctttttttttttttttttttttacaatttttacatttggaattaaaattttaactagaaaagagtttttattaagcaagtttttttaaaaaaaatcttaagttgttaatcctgctctcaagatgtaagtaaggtgtgtttcagacattattaaaatactgaaatagtggtatttgtaccaaaacactagtatctcattacttaccatgatatataacactgtataactgaatagtggaataccaaaattgaaattgcacactgcatctaatcctgtatgcatccaagtatattcttctgtgcctgtactgtctgcctttttcatgttttggacaaaactgtcatcctttgtgtacctcctctctgtgtccacgttcctattctcctccctcagtgcctttattctctcccttcccattgcttcctttgtatctgcttacacatgttcatatgtttctcttattttgga

SEQ ID NO: 230271 - DNA, 714 bp, Homo sapiens
taatgtagttcattttctctttttacttttcttgcctgtgcttttggtatcatattgaagatcattgccaaatccaatgtcctgaagcattttcacttgttttcttataaatgttctctagttttaggtctcctttaaatttattaagaactcttcctactgttgagctggaaaaaaaaaaaaaaaaaaaaaaaaaaaaaaaaaaaaaaaaaaaaaaaaaaaaaaaaaaaaaaaaaaaaaaaaaataaaaaaaaaaaataacaaaaaacatttaaggccttctgtccctattctttttaaactccgatcatgttaataccggcggccataattcacctctcttgctacaattccccttttaggaggtgctttaaccaatagccgggccgtttttaccaagtattctgtcgtaaaacctggtatctccccacttatattcttgggaaccattcccccttttgcccgagcttgtcaaaatcactactaagccgcccacattgtgccctctcaaaaattaccggtctcttttttggtaatcttcaatttttatcccttaatttttcttaaaattctcgggaaaattttgttaatacaatcattttcttttacccaatcgggtccaaatacttatcaacttccctttatatccataaaaatattccctccaaattggccttggttgtttttccagatttgtaacagatactcctcttt

SEQ ID NO: 230272 - DNA, 254 bp, Homo sapiens
gagtctcccacagaccagaacagtcatttaaaagttttcaggaaaaaccaacttaaaaaaaaataaggtggctaattaaaaaaaaatgaagcatttaacagtgttcaggtttcagagtatggaagaggggttttttaaactgttatctgattatttcttttaccaacatgatatagaaaagtgtatttccagtattaaaatttatcagactgagcttactgttcctgttaatgactggaataaaaattggcata

SEQ ID NO: 230273 - DNA, 236 bp, Homo sapiens
attctatcattggtaagtcaaagatgagcaggctaaaagtaatttaagcctcaccattcttgatatgaaggcaagaggagcatcgctcaccaaagagaagtcaaggacccaccccaggccacagctgtttttattgatccacaaaggataagaatttcagagtaaagtctggaaacttttgtagtcatttaactatttctgttaaatcacataataaaatattgagccttgtattt

SEQ ID NO: 230274 - DNA, 421 bp, Homo sapiens
agctactcaagaggctgagacaggagaatcgcttgaacccaggaggcagaggttgctgtgacccaagaccatgccattgcactccagcctgggtgacagatcaagactctgtctcaaagagaaatatctgctgaggacacatttgccattgatcttgcaacctgccaccacccaccctgactctaatctcatcctccataaacagtgacagaaatgatttataaaccacactctccattgctcttgctgtagattcctatagttaagccataactgtacctgcaggcagtcccatggggacaggggcacagataagcatctcattgctgtccagccctttcctggagatatgcgccctcaatcttgctatttggtggtgttatttgaataaaatgaattccctttcaagtggaaattattc

SEQ ID NO: 230275 - DNA, 772 bp, Homo sapiens
ctccatttttgtaacaacagtgacaacaaaaagatgagttacagtccacacgtgtgatggggagagactgaggaagcaagagttggaaggaaatcttcctggtttgtatggatacccccttttccatcatcagagataaactatcttcatgccatatgacttctaccatgtaatcagtatttggaagtacctacctctgtgaaaagacattttcaaagatgaaacacgtaaaatctcacaaaagaatgtcatggttaaaccaagtgtgggttttagagcccaacagctgacttctagttctaaggctgaaggctaggtttatcaccatggaaatagatttttcagtggaaagtccagtggaagcaaggtgggtcctcactttctgagcacacacaggaacccagttctctagagcatctgaaatggccatgtctgccctcacaggtgtgaaatcctacccaatagaggatcctctgacttgtgaaggttacagattaatgccttgaaatattagttttaaaaaacaacaacaaactaggccaggtgtggcggctcacacctacaatcccagcactttgggaggccgaggtgggtggatcacttgtagccaggagtttgagaccaccctggccaacatggtgaaacctcgcctctacaaaatatacaaagattagccgggcatggtggtacatgcctgtaatcccagctattcaggaggctaaggcatgagaatcatttgagcttgggaggtggagggtgcagtgagccaagc

SEQ ID NO: 230276 - DNA, 390 bp, Homo sapiens
ccgccatccactcagttcctgaaccccagaacctaggaatactgccaggttggctgcagatcaccccgtgactctgctgcaagcctctggaaaaagccaaccatgacctccacattgccacagatgagcaaagagtctcccgtgaaggctttgtattggcagagactctctacaggcatccgagtggaggcccagaccctggcttgggtggcccccacagggaaggccaaagagcagacccgggccctgtaatgtatctcagagaccgaaatgctcatctcctccgagaactcagcagataacctccaaatccctaaatcgggacatagcagtaggagcccatcatttagagacacagaggttaatattcagaagaaatagctgaagaaa

SEQ ID NO: 230277 - DNA, 484 bp, Homo sapiens
aagtgtagagcttagggtaaagttagagccaaatgcgctgattggtggtttatctgaggatgttagagtgaatggatccctagccttggactcctctgtgggagaagggctcatctcagagtgagtggggtacctagcagtaagtgctcccaggctccaaagtggtagcatgccattagctgcaagaaaaaggaacctctagccgggcgtggtggctcacgcctataattctagcactttaggaggccgaggcgggcggatcacctgaggtcaggagttggagaccagcctggccaacatggtgaaaccccatctctactaaaaatataaaaattagtcaggcgtggtggtgggcatctgtaattccagctactcagaaggctgaggcaggagaatcacttgaacccggggggtggaggttgcagtgagctgagtttgcgccacttcactccagcctgggcaaaagagcaagactttgtcccaa

SEQ ID NO: 230278 - DNA, 434 bp, Homo sapiens
taaggaactgccatgtgtactgttaaaatatatccagctagaatgcccattttgtttattgatgtttcccaagtgcctggaagaaagtctggcacatggtaggcattcttgaaatatttattgaacaaatggtttaaatttcttccaattagtcgaagccactcttcagcacaccagatcttatttctagaaagtactagattcctctgttctttagagaatttgcagaaactaatatatggagagagaccactgttgagaattctatgcagattttttattttactataaactttcatcaagacttaaggattcagaacatttatatatcatgagaaatttgttaactatacagaaaaccgttttgtggattgaggtgattagattctaaacagattgcccaggagacactggactctttctcttaaagttaa

SEQ ID NO: 230279 - DNA, 476 bp, Homo sapiens
aagaattcatcttctcacagcactgcctcagctggtgtttcaaatgtttcttttggatatgttgtgcacacctgacctgctgccaaggcagaagcctgctatgccttcacgtaattctgctctactgccctgttcctttctttctccctgccttactgtctctccctaagaagaatgatctctcccatcatgctgtaccttcatttgacttcctatcaccaatatctgctgcagtcgatcctccgtgcttttcctaaaatagtcttttttggcccaaaactgtggccatgctaattcttttctatgtccttccagtggcttatatttacatcatggaccaatatagtcattctttattctgaagcctctcaccagcataacttactttctgtgcaagctctggatccttctgctttgagatatgttttcaaattattttctcctcattaagactctgctttttgaaacttctcaga

SEQ ID NO: 230280 - DNA, 677 bp, Homo sapiens
aaccccacagccttctccgccctccgctgtgggctggatttccatgtgaatcttaagtcagttctcaagtcccgtctccctcctagagtttactttgggggaaatttcacatctttgcaacaggaaagcttccaacccagaaacgtggtgcgtttccgcatttactcagatcttccttcaacgcctctcaactttctgcattaacgtcttccacgtctttcaccagattaattcctagaaagttggtatttttgttgcctttgtaagtggtaggtatttttaaaaagtcattttctgttcattgcttatatgtagaaaaacaagtgacttttgtctatgttcagtaaactcactaaacgttcccatgtcgctaactgatccgtggttcctgtgggtctcggcattcccagcagcgtgtctgtgagtcacgctggtcttgactgtcattctccaagcatcgtgccttttcttttttatctttctgcactgggtttggccgccagggcaaagtgggctgcaggtggtgagagcaggaacggggacgcttctgtgagctgcgtttgtatgttcttgttttcagattaaggaagttcccttctagttctagtttgcaaacactttattatcagaaatggatactgaattctatattaaaaattttacatctttgaaaatga

SEQ ID NO: 230281 - DNA, 622 bp, Homo sapiens
acctgccagaataggtgtcaggtggctcctcaccactctacatcattagtgtgtacaatggacacagcattatctgaacttccatggctctatgtaaagcattccattgtattttaataattacgcaagacaaggcctctttcacataaggcaaataagtgtgattgattcagacttctggcattactgggccatgctgccgcaagaaacaggtgcatgtggaatcaagcctgacggagttattggtgtgcagaaaaaaaaaaaggattactacttatctggtttttaaagatgagagtgttttatctgatgccctgaccaaatgaaacaacaacctagactgaagcagggaacattcgctggacatttcaggcactgtgctaggctctacagtgaagcattcacagtctagtggtgtctataaataaaaccaaaatgctaacttttaaattcctatgaggaatataattgtaatgccactatagctgcatcactaccatggggtcattctctccctacagacagatcaataaacaaaatcaaattacaatccaaaggaagcaaggtgggcagaaataacgtagggattcatgatgaataaagtcattaatccttccattta

SEQ ID NO: 230282 - DNA, 382 bp, Homo sapiens
ttggttgtttttgtgcctcattatgctatagcccagcgggtacctgggaggctggccaggtccctctctaattgcaggatgctggcaagtgagcccaggcaggcacctgtgccagtccctgaacggcactgggttccaggcagagagagcttgccctccctgactctcctaccaatgctccagctctagcttccatctgactgcaaagcaacctggtctcacaccagccacttctgctgctcaatgccatctccttccggctgttcctgctgcttcaaagagtggggagtagagagaagagaagcgaggtgcgaacaatagccaacttgcctaaaactctgatgctggagttaataaaaagaaatgaacccattcaggctag

SEQ ID NO: 230283 - DNA, 509 bp, Homo sapiens
tgtatgtagttggttgttgatatttatcaatttgatgtcagaagaggactgtcagtaaaacgatgcgtgtatgtgtgtatgtgtgattgttgtaagtgctatagagcgtttaggaaggtccagtgtggtcagcagggcttcatggagcatctgaaaaggggtttggtttatagaatggctatgatttccagatatggagaggtgtgcacatggtacctgccttgtagggcactaacatgcaggaggtaactattcaaagcatgttcaggaaggaatcaatggatccatctggcaggaattcaagaccatcctagctaacacagtgaaaccccgtctctactaaaaatacaaaaaattagccgggcgtggtcgtgggcgcctgtagtcccagctactcaggaggctgaggcaggagaatggcatgaacccaggaggaagagcttgcagtgagccgagatggcgccactgcactccagcctgggtgacagagcgagactctgtctcaaaaa

SEQ ID NO: 230284 - DNA, 576 bp, Homo sapiens
cagccctgtcaataggatgttccgggtatcacctggtttgagtatttggttttagacgggcgcccagcttcttactgttatatttccattctttttggcctaagttttccatgagtagcaagctttgaagaaaaacacatggtaagcctgcctaggaagcttcaataataatgcctgcaagatacctttcttagcttttcctaaatggcaagccactgtgtacacacacttttctaggaagggctccccagactgtcattcttcctgggactgatggaagatattgatgatgatgatgatagtaataataatagcatttagcatttttaagatcatcttttataatgcttagagttgcccaaatagtagatgccgtagtcctcccttatccaccgtttggctgtctcagtttgttacctgcctcagctgttgtaggaaaatattaagatattttgacagatcacagtaatataacttttattacagtatattgttataattgctgtatttgttattattgttcatctcttactatgcctagtttataaattaaacttgatcattgatatgtataca

SEQ ID NO: 230285 - DNA, 642 bp, Homo sapiens
gtcatgtccattagaccggtgacgaggccagaggaggtctgtgtcgtgtgtgcctcggtgtctgtccactgaaactcataagctcagccacggaggagctgtctcattttaggctttggtgctggtacttactgacagttacttgagaaagatgtgatttcggtcccagagccacaggatatcagctcatggaatgtgtcgctgcatcatgttactcagggtgtgcccaagtctcgtagcccagaaatcaatcctgagggccctgaaacagcccaggggccgcagtatacgcccaagagcagcgggggcaaagggcaaggcatgccgtctttccaaagcacggagtcaccagacaagtccacgcctgaagacgaatgttgtaatgttcagcttttgaagaacctgaggaagtgtctttcccttaactcacacagacgttcaccattcacgaaggtggcgcttagctcagcaggagcgcgcagcactggtggcacctgtgctatgtgccgtgttatcccgctcttccctggcgctggtggcacctgtgctgtgtgccgtgttatcccactcttccctggcgctggcggcacctgtgctgtgtgccatgttatcccactcttccctgacactggcggcacctgt

SEQ ID NO: 230286 - DNA, 265 bp, Homo sapiens
ggtcatagacacaactgtaaaaccttgaattataaagcttctaggagaaaacataggagagaaatctttgtgaccatgggttaggcaacatttttagcatgatccttaaaaaaaacagacaaatttggcttcatcaaaattgaaaacttctgttctttggaacacactgttaaggaaatgaaaaaataagcccctgactgaatcaaaacaagtatttgcaaaacacagatcaaaggtctgtattcagaatacataaaaactcaat

SEQ ID NO: 230287 - DNA, 466 bp, Homo sapiens
ttgaatgaagggctaaatgtgagctgatttcttactagattactcagtgatcaaatagaatatctaattaacctgaaaaaaaccatataaaaatccatttgagcaataggaacattgattgggagtgtcaagatctaggcttgagtgttatatctgctgcttatttgctatctgaccttgtataattcatttatagtctttgattcttagtttacctgatctgtaaactagaaataatgataacaattaaaattttaccacaaataatacctcctgcctggaagagccttgttgacattgagaacttctggatcagacctctgctgaaacccaaacactacaactggaattttccattataggaaccaataaatctttactggttcagttccagttgctggtgttacttacaaacaaaggcatctttatgctaagcattaacactaacctataaaagaatagcaaa

SEQ ID NO: 230288 - DNA, 450 bp, Homo sapiens
tctctgcctgggtctggttacactgggtggagcattggggtgtacatggtgggatggccaggagagcctcctgaagaagttggtggggttatttttaggctttgggtttgcatctaatgttgcccttttggccacacttccccccacctgctacagtgtcactgtcaccagtgaggtccaacaggcaccaagaggagagaggaagagaaagaaggagagagaagagagttctgactgttggacaagctgaggaagggagggggcagaatttctctagtccttgtaattaagactgggtgctccatggcaaccccatcctcccaaattttagttggggctggacacagctcatgcctgttatctcagcactttgggaggctgaggcagatggatcacttgagcccaggagtttgagaccagcctgggcacatggcaaaccctgtctctagg

SEQ ID NO: 230289 - DNA, 412 bp, Homo sapiens
tttctcttttaatttgtataaaaacacccatacccatacccacaaacacacacacagtgtttgatgtatacgtaagtttgtatcactcactttgttttataaatattttgggatttctactgtattttgagctttttgatgcaaagtttaccttttagccaccgggagctcccaaaggggtgagcatagttcccagcaccctgataattgaccgttgcctttatgattttgcaatactttgtatatcaaagtaaaatcctaaaatttgctgatattatttatagcctattctttgtaacatatgattaatctttacttcttcaaatattttgtttaacaagggccaaatacatttgaagatgcaggaaactacatcaagaaccagtttctagacctgaatttaaaaaaagaa

SEQ ID NO: 230290 - DNA, 528 bp, Homo sapiens
caaagcccatgacatcagagacaagcaggaaggactacccaagtaaagaaagaatcgtagaaaccaatccctgcacctccccagtgaagtgattcagtttggactttagaaggaggtatcctttaaatcctgcatgactggaagtcagatggtcaagtccccttgccttgggaaccacagcagtgggctctgagtcattgcttcagagtcaagctactcaagccgcaggagacagccaagttctccctgagagagaagggatagagaccaaacaaccggccgcctttatctacaaggtggagtgtggaggttgcctttccattgtattttccctaagaccagaggaactggttcaattgaaaagggaggcagtcagtcccctgcagtgcacaccctccacttgagagacagcctcaagactctcccctcagcccttttgggtgttgcaattgggcaagcctcttcccaaagagtccacggactctgggccatgcactcaggctcaatacagaccttatcttttcaatc

SEQ ID NO: 230291 - DNA, 463 bp, Homo sapiens
  misc_feature (14)..(15): n is a, c, g, or t
  misc_feature (20)..(20): n is a, c, g, or t
  misc_feature (425)..(425): n is a, c, g, or t
ccccgcaagtatgnntactnaaaaaaaaaaaaaaagaaagaattagctatcagctccattttatagatgaggaaactgaggcacagaggaaggagggatgggtttcaaggccggtcttggttttgccaagaacttgacttccagcaaatcgtaagccttctgggctttcatttccttgtctctgaacgaaacagctggcaggagtcgaatgcttatcatgtgccaggccctggccgaacactctgaacatgtgcgcacagagtgtgtgttaaccagtgggggagggggcaccaagcaggcccatctgggtgggaatatgaagccaccttcccaacagggcagtcacatatgcccagtaggaaagagctgtatctgtgctgcagagagggtcatttcaaattaaaaaaaaaactttttagtaattnaaaagatcagcttgataatcacaataacttgctggacg

SEQ ID NO: 230292 - DNA, 1463 bp, Homo sapiens
  misc_feature (1425)..(1425): n is a, c, g, or t
tagcacctgcgtcatcgaatacgcacaacaagatggaaaatgccttgggccatccagatagggaaaacaagtaggacaccagattgataccactggcatcaaaaccatgaaaaaaacacatgcatgaagaggactgggaagaagtacacaagaagtggctgcattagggtgagaaggagtattcatgtttttctcatccgtctttttcaaaccttttgtaatgggtggttttattaattttataatggaaaatgttaatttaaaagcaagttatttacagtttagtaagctcatggcagggaaaggctgtgctctgtttattgctcttactttttcccaacgcctactcccatgcctggcaattatagagataataaatgtgggtgtggaatgagtgcccactgggaaacctctcagaggactttgacccaggaacatatttgcacagggtttccctcagctggagaaggtttctctgggagagcaccagccaggtgtgtgtcatgggatatatttacagggtggtgagctctcctggtccaacctaaaaggtcccagcaaggtgtagggcccttctggccatttgacatcaccagggcagttagtgctgatacaaaccacagagaatgaacaaactccaactcaaacgggaatggattttatgtcattctgggactttcaaacttgataatagaccaagcatggtggctcacacatgtaatcctagcactttgggaagccaaggtgggaggatcgcttgcggccaggagattgagaccagcctgggaaaggtagcaagacccagtctctacaaaaaaattttttgttctgttttgtttttgagacagagtctcaactctgtcgtctaggctggagtgcagtggtttgatcttggctcactacaacctcgcactccgggaaaatcactggaacctgggaggcagaggttgcagtgagccaatatcacgccattgcattccggcctgggcaacaagagcaaaactccatctcaaaaaaaaaaaaaaaaaaaaaaaagaaagaattagctatcagctccattttatagatgaggaaactgaggcacagaggaaggagggatgggtttcaaggccggtcttggttttgccaagaacttgacttccagcaaatcgtaagccttctgggctttcatttccttgtctctgaacgaaacagctggcaggagtcgaatgcttatcatgtgccaggccctggccgaacactctgaacatgtgcgcacagagtgtgtgttaaccagtgggggagggggcaccaagcaggcccatctgggtgggaatatgaagccaccttcccaacagggcagtcacatatgcccagtaggaaagagctgtatctgtgctgcagagagggtcatttcaaattaaaaaaaaaactttttagtaattnaaaagatcagcttgataatcacaataacttgctggacg

SEQ ID NO: 230293 - DNA, 476 bp, Homo sapiens
  misc_feature (438)..(438): n is a, c, g, or t
ctttcaacccgcgggtagtatgtgttcaaaaaaaaaaaaaaaaaaaaagaaagaattagctatcagctccattttatagatgaggaaactgaggcacagaggaaggagggatgggtttcaaggccggtcttggttttgccaagaacttgacttccagcaaatcgtaagccttctgggctttcatttccttgtctctgaacgaaacagctggcaggagtcgaatgcttatcatgtgccaggccctggccgaacactctgaacatgtgcgcacagagtgtgtgttaaccagtgggggagggggcaccaagcaggcccatctgggtgggaatatgaagccaccttcccaacagggcagtcacatatgcccagtaggaaagagctgtatctgtgctgcagagagggtcatttcaaattaaaaaaaaaactttttagtaattnaaaagatcagcttgataatcacaataacttgctggacg

SEQ ID NO: 230294 - DNA, 457 bp, Homo sapiens
tctgtctttcatttttctcaatggaagcacattccccacttctcaatttgccttgggagctcttatttcaatctcttctcaatccttcgaagcaggactcctccctagccatattctacacagaaggaaacagaaactcagcgtgaggacggctcctgccctgcgacctcaggtcccccagctgccttgctaagagttgaaccgtgcccccagcccctaccctgatacatttcagcaaattgatatgcaaggcccctttccaggccctgggaacatgaagaggaagttgctgatggctgtgctcaaagacttcccaggtgctggtgaaacagacatgaaaaggcacaacccctgcctcgggatctggtggcaagatcaacaggtaaactgcaggtctgatacggattgacaggtgccactcagagtgagtacgggtggcagaaactcagaggggtcc

SEQ ID NO: 230295 - DNA, 496 bp, Homo sapiens
aatgatcacctaagatatacatgctccaaccatattgattttagaacaaaacacagcagcccataacagtttgtggcctctactaactgtcctctgctgtcccatctagaggttatgtttctctatttttaaaataaaatgtagttaaattagcctgacggatgtttcctctctatcccttatctcagacacatacaaaacagacagacaataacaaaaagacatcatctttatatgtacaaaataaggtatgcacacttttttctttgtgcttctgagattggctcctttgcatatataagatacaagccatctgcacgatcaccctcatttcctatctttgttgacatgttcctcttacaacacaagagcaaattacctctatttgaaagcaccctgtcttcaacacagctcatgacaattttatttaatattgatcctttgaatgagagatcaaaagcatgcacaggtcaatcctctgcacattaaaaaaaaa

SEQ ID NO: 230296 - DNA, 925 bp, Homo sapiens
aatgatcacctaagatatacatgctccaaccatattgattttagaacaaaacacagcagcccataacagtttgtggcctctactaactgtcctctgctgtcccatctagaggttatgtttctctatttttaaaataaaatgtagttaaattagcctgacggatgtttcctctctatcccttatctcagacacatacaaaacagacagacaataacaaaaagacatcatctttatatgtacaaaataaggtatgcacacttttttctttgtgcttctgagattggctcctttgcatatataagatacaagccatctgcacgatcaccctcatttcctatctttgttgacatgttcctcttacaacacaagagcaaattacctctatttgaaagcaccctgtcttcaacacagctcatgacaattttatttaatattgatcctttgaatgagagatcaaaagcatgcacagcatcactaaaactttctcctgtggtacatcaattattggtcttcctattgaaaagtacaatttcacttcataagaaatcctcagtgaagagatatcaagtaacaccaaaagcccacaataacagagctccagcatctcataaagctttctgcacagcttgctggaaaacgtatatattatttagcattttagtaaccagacacaaaaccaatgagccaaaggtgtttttgtttttgttgttgtttgtttatttgttttaagacagggtctcggtctgtcgagtgcagtgtcatgatcctggctcattgcaacctccgccttccgggttcaagcaattctcgtgcatcaatctcccgagtaggtgggaatacaggtgtgcaccaacacactaggctattgtttgtattttttaatagagatgggttttcactatattggccaggctggtctcgaact

SEQ ID NO: 230297 - DNA, 798 bp, Homo sapiens
  misc_feature (638)..(638): n is a, c, g, or t
  misc_feature (658)..(658): n is a, c, g, or t
  misc_feature (755)..(755): n is a, c, g, or t
  misc_feature (769)..(769): n is a, c, g, or t
  misc_feature (788)..(788): n is a, c, g, or t
gttcctattcggccatcttggctccacctccctgtatttttctttttaaaattgcatagttgcttaaacttatttttttctctttggatttttaaaggttcactgtatgtatagtcttatatctcagtcgatcttgttagtggcttattgttaaaacatgcagtttttggctgggcatggtggctgtattcctagcactttgggaggccaaggcaggtggatcacctaagcccaggagtttgagatcagcctgggcaacctggtgaaactctgtctttataaaacattagaaaattagctgggtgtggtggcacacacctgtagtctcagttccttgggaggctgagtgtggaggatcccttgagcctgggtggttgaggctgcagtgagctgggatagagccactccagacttagtctccaaaaaaaaaaaaaaaatttaaagaaaaaaaatgtctacaacatgcactccccaaaaatcttatctaaaactgaacttattatgttctctcctaaatcagttactcgaagttcaccgctctcctggaacctcagaatacaaatcatagtatcttaattgactcatccttttatcttatcaaacccatcatcaaatccagatcattttcctttctctgnctctaattaattcattttgntcagagttgccatgatagtctccctaatatactggttatggctttgccctctgcatccaggcccgatgcctttcgacaaagaatgcacatcacaatnaccctggggacctnttttaaaaacttggacctngggccccatt

SEQ ID NO: 230298 - DNA, 495 bp, Homo sapiens
atgcctggccacctgactttgtacccatagctaggagtaaggattttgttttgtctcctgccaatacttgttatgcatacatttcactggatgggaaatatggaatggtacacattatgaacgaaacaccagagattgttaatggatggtacaggaatgctttgccatggtaatgaagtatctttatacaagaaaatgcaggatgagcatctctaatctaaaaaactaaagtccaaagtgatccaaaatctaaaacattttcgagtgccaagatgataccacaggtggaaaattctacacctgatctcatttgatggattgtagtcaaaatgctgtcaaaacattgtttcatgcataaaattattaaacatattgtataaatcaccttcaggctatgcgtataaggtgtatttaaacataaagagatttcaagattagacttgggttctatccccacgataacttgttatgtatatgccaatatcccaaaatcca

SEQ ID NO: 230299 - DNA, 168 bp, Homo sapiens
gagctttaatatctttaatttagagatgaggaaacaacactgagaaatattcagtcaggtagctgctggataccatctgttaaagcattccccaatctgaattcaagttcaacggactctgccacttttactagctatataaccataggcccttctgtgagttttatc

SEQ ID NO: 230300 - DNA, 497 bp, Homo sapiens
ggcatgattttggaacacatatattggtcatttggaaaatataaattcttccaaaagttgacatattttgttatattatatcaaaaagtcaccttcattaatataatcaccaagctcatctaaaaagtctggaatgtactggaagctcttaagctcatagtggcacatagacattttctaagttctaatttatgctttgaagctagaaattgggctgggcgtggtggctcacatctgtaatcgtagcactttgggaggctgaggcaggcgggtcacttgaggtcaggagttcgagaccagcctggccaacatggtaaaaccctgtctgtactgaaaacacaaaaattagccaggtgtggtggtacatgcctgtagtcccagctgcttgggaggctgaggcaggagaatcacttgaacccaagaggtggaggctgcagtgagccgagattgcaccattgcactccagccggggcaaaagagcaagagtctgtctcaaa

SEQ ID NO: 230301 - DNA, 423 bp, Homo sapiens
aggattactaaggaacaatagaaagaactttgaaactccatttccactctaatgatttcccctgcactcctccacacctgctgtgtaagaagagtgagaagaggaggggcagcaggaaccatggctctactggaaatgtggtgttagtgataaggtgttggagtgggaggtcacttccttccctcttatttgggaagggggtttgagccccagttctctcaaaggcaaatgaattgacagctccaagaaactggctgatatataatgggagtgattctctctgcctgcctgctcaactgctaaagttgagtcttctctgctgtggccaaaacagtgaaatgtggtgacaaagtaccagcaagaactggactgtgtttctggagcctaggggcaagtatgaatcttgagtattgagataatatc

SEQ ID NO: 230302 - DNA, 462 bp, Homo sapiens
cagcttgaatataatggggaagctaagaaaaaggttgtttagtaattgtagttctgggaagggaaggagtttctagcctcttaaagattcctgctcccaaggtcattttatttctgtttagtttttcagaaattattcctggtatcaataggttaagaaagtagaattttcccaagtactggccaggcgcggtggctcacgcctgtaatcccagccctttgggagcccgaggcagacagatcacgaggtcaggagattgagaccatcctggctaacgcggtgaaaccttgtctctactaacaatacaaaaaaattagcccgacatggtggcgggtgcctgtcagtcccagctactcgggaggcggaggcaggagaatggcgtgaacctgggaggtagagcttgcagtgagccgagatcgcgccactgcgctccagcctggacgaaagggcgagaccctgtct

SEQ ID NO: 230303 - DNA, 437 bp, Homo sapiens
tacacccatttttgtcaacagcttaaaaagaaggcaagttttgaaccttaaaagtagttatctttccattatgatcattgttcattagtgtgatgtttcatactttgtagaaagaaccctaaaatggtttctacttaagatcgaaacttgatgcttagagattaaattcatttcaaggagaacagtttgccttttacagtggtgtagtgtagacttaacatcatagtcatattttctcatgggatgttaagcttttttctaattttttaagatttgggcatgtcatatttttgtgttttaagtatttgtcagctaaaagttagttaagggagacttttttttaaggcccaaaatgttgtatactttcaaagtgattccctcattgacccacccttagcttccatgtctccatgtttactatgatttcccactaagga

SEQ ID NO: 230304 - DNA, 2061 bp, Homo sapiens
  misc_feature (1105)..(1105): n is a, c, g, or t
cactgagaatatggggtaaatacttggagacaagagagagacaaatgtcctagtttccaaaaaggaataaagtatattgcaaaaacccaagaccaattccctactttaaactgtggtaaaatttgaagagattgtaaaaaaatgaaatattgtgtttagaagagaatgggatgatcaccatgaatcaatatgaatttataagaataagacatgccaaaatgacctcattttttttttgctttatttttagttgtataattgctattggattagagaatagtaaagacatgttgtatcttgactttcgccaagtggttgacagtgtttccttaactatccttgtggaaacatgatgaaattagattgtaattagattgatttacagctgcttgcctggccattgccatgcccgcatgcccagcgtttagttaaataatagttactttatatactggttcctcacagagaactggtggtgaacattaatttgcatatattcagaaagtatggatttgtagttaacgagtttttttaaggatttgtatgttgaaacttgagttcctggatttattcatgattgaggtttctgttagggacttttttgcaaccaagctgtatttgtaagatatataaatctgtttttaatttacatatgtaaccttgacttataaattacttagaagccaaggcgtaatattagcatttagagcaaagtctggctatgttaagaatgctaacgttatgaagaatcttttctttgttcagtaacaactatagtaagctcacttggatgtttttcatacccttgaaatgtcattcctgtgaactatccctaaacaaaaggcagatgttcatatacaaattgataatacagatatattcagcagtgtctttctgagttaatgtgtctgttggccttctggtaatcccacagtcagctgcctgttcaagatatttacatattttttaaaaaaatacaaattccctggaatcatatcaaagagagaaccatatattttgttcacttaggaagttcttttggcagtccatgatggctgctacatccaatatattttttaattaattgttacttttagagaatgcnagtccatagttaacttattaaactttcataattgatatttctttgatgcttgtaatattttgtttctagcctcaaaaaagtgtgataacttttttgaatacttgcagacatatagcatatactataataaatataattaatatgtatataataatgataataattctaaaataacagccctagtcatcagtgtttccatttcttgttcttgtctcattcctatgcctcttccacagaaagaagtgtttttggcttttcctgctgtagacttgttatacccaatggtgccagaagataatcgattcaaatggttagcttagccttattttatatttcagtccagataccattttgtgaatatgttttaaaatgttaataaataaagaacaaaatttgatgaattgacatataaactataattaaaacctactttaaagactcatagagcttgctgctttaatgaagaattgaagaaattgatgaagaatttattttagtgttttgactgagccaaaataaaatcagtttcattgttgaagaaacacagtttaacataaacttgtagatagactattaaagagtgctgtatcagttaagtgagcactgtcttctaaaatttcatgtattcaaggatggagagggtcaaatgaatagttaaaaatacaaattaaggccaggcatggtggctcatgcctgtaatcccagccagcactttgggagtctgaggcaggcggatcacttgagctcaggagtttgacaccagtctgggcaacatgacaaaacactgtctctaccaaaaatacaaaaattaacctggcctggtggcgtgtgcctgtggtcccagctacttgggaggctgaggtgggaggattgctggagcccccgaggcggaggttgcagtgagccgagatcgcacctctgcattccagcctggttgacagagtgagaccccatct

SEQ ID NO: 230305 - DNA, 556 bp, Homo sapiens
tcagtagttatcaactgggcttagttccagtctgcaggataggataaggtcatttttttttcttactcgggagcaaagttgattacttggggcattttctattcatcaaagaaggcagcaacataaaagaccaactcaaaccatgcaagtatatttaaaactgtatttgcatcacatcgacaaacaatcctttcaataaaacaagtcacatgtacaaactcaaggctaatggggagaccatgtgcactttacatctttactggcaggcctttctgaatcacatgacaaagagtgtgactaaatagtctgcaaaggggatggagtgaagactttgggaaaatgattaaatctatcatagctaacatcttacatcatgtggaaacattagagaccttctactaatgtcagaaacaagaaaacagtatacttgatctccagcaccgtatttaatattgtgatggcagtattaatgaatacgattagacaagaaaattcattagaaacatgagaattggagggaaagaggtaaaactttatcagattatatataaaatcc

SEQ ID NO: 230306 - DNA, 355 bp, Homo sapiens
aaccgtgcacagagaggcgagctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatggccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttca

SEQ ID NO: 230307 - DNA, 463 bp, Homo sapiens
gagttctctggatcagctctgtttcctctgcatgtaacttggatgagtgttgaaggtggcacacagaaccttgtgaaactgtcagactgagactctaaggtccattcagccagtttgactgaggctggggaggcctttgagaacaagctccctctgctgtctttcaggtataaacaaggtctgcatggtagctttggaactagcacgccagctgcttggtatttctgggatcccttgcacgaaatatgggctccctagcattacctgtcagatctggtgctttttgtttcattaaaaataaaacagaaagccctctaagcaatggcattaaagaacatctagaaaataaccctctgctttctcaggaaagatgtcagtatgtccacggcaggattgatgaaagaattcttgaagcagtgaagaaaacggaccaagcttcagggaagttggcataagaagtgag

SEQ ID NO: 230308 - DNA, 521 bp, Homo sapiens
ggtggaggtggagtctctgggactctgatgtggtgccttttttccattctgccccatttagccttgtagagaagtagcgagtcagggtgtatggtaagggagaggacttagcatatctctagttattggaatcgagagaaagaccccagaagagaggacattaagtttcacaggacattacgtgaaagctgtctcgaccatgggcagctgtctcaccccttcactataggaggaggcgtctttgaaggcatttcacttttgagaagaaagcccatgtggggcatggcagggctcaggcatcgcagccacattgaagtccattactcatagattcactccatgcaagctgcttaatcttgcttagcctcagtgttctcttctgaaaatggccatcactgggcaggagaaaatgaaggtggagccatgtagtttctctacatatgtaatattataatatcggtgaagtccataagaatggttattgaatattatatactgatcacagtgctagtatttcataa

SEQ ID NO: 230309 - DNA, 413 bp, Homo sapiens
atggagtctctctctgttgcccagactggagtgcagtggcacaatctcggcttactgcaacctccgcctgccaggttcaagcaatcctcctccctcagcccctctagtaactgggattacaggcacacaccaccaggcccagctaatttttgtatttgtagtagagacagggtttcaccacattggccaggctggtctcaaactcctgacctcaggtgatctacctgcctcggcctcccaaaatgctggaattacaggcatgagccaccgcactagccaagccttgtttttataataagctattttgttttaaatatactggtatgtagtgtagtacatatgtaactgtcatatgactatatgttaatctagcttaaaggaataaatatttaggatatttactatttttgttg

SEQ ID NO: 230310 - DNA, 514 bp, Homo sapiens
cacaaacttcagcattagcctgcgtttaaatctattactgtcaccctggcctttccatagttgctggtgtcttgtccactattatatatgtggcttctgtaatttatttttttctaattatgttttttattttgagaacattgtagactcacgtgcagttgtaagaaataacacaaagaaatctccttacctgttttctccaatggtaacatctttcaaaactgtagcataatatcacaactaggatattgacagtgatgtagtcaagatgcagaacggttccatttccttatggctacacctacttcctgccagctccctgccccctccttaacccttgatgaacattaatatgttctctatttctataattttgtcatttaaagagtgttacataagctaggcatggtaacacacgcctgtagtcccggcttgagaccaggaggttgaggctgcggtgagttaccatcatgccactgcactccaggctgggtgacagagtgagacactgtct

SEQ ID NO: 230311 - DNA, 277 bp, Homo sapiens
aattgtagccctgttattttaaaaaataattacatatgcatgtatctgtaagcaatgtacttaaattttttttttgagcttcatataaatggcaccattgtgtgtataagtcatctgggactcgcataattcaatgttaagtttccaaattcattctgtgtgtagcttctgggtaatgttccattgtaaaaactgtatgaaaatttatcgatgtattttcaatggacatgtgggttgttttcagtgttttgttattaaaatgtgctgataatatttt

SEQ ID NO: 230312 - DNA, 476 bp, Homo sapiens
ttactgccagtgaggaatgagctcccatcagacataacctgttcaggagctatgctgtcccaatgccgcaggatactcctttatacatgaaggcctgtgatcattgccctttattcatcagataatttattataatgactgcctgaacctctgaaagattttgctgtacttaaacacaaaatatgcttagcaaaacaacctgacaaggatgattcatggatagcaattaagtgcagaatcctgtgcctaccaaatcctaaattgggttgaagatctggccatcccgctgacaacttgatatggaatacagtaggctggcccttgtcagtccaccccactctcaaccctctcattgctcctgggcatgggaggtatccctgaaggggcaagctctatggatgacacaattccaattccaattttggcctctggcaagttgcttcacttctatggccctgagtttcctaatcataata

SEQ ID NO: 230313 - DNA, 430 bp, Homo sapiens
acctgttttatggtgaaagaggtgtgttaatggacacaagacgattgcatactaaaccccatatcacccaaagaggtgaggcctgagaaaatttaaagtgaagctaagcataaacttggaaataatatgcatgggattgtagtgttgtcctttgagatgcagaatgtgtgttgacctgacggtcatttaaccattaagatagactgtatgagtccaagaaccaaagagtaaaaagtggagtgaccttattttcatgactctgagaagcccagtgcttaagcttccatgagccagccagggactagtccggaaaatagatatttcttgggaatgtggaaggtttgagcaatctcatctattgggttaaccctcctttgcacagttatttagaaatgtagaggtaaataccaggtgaacaccaaaaaaaaaa

SEQ ID NO: 230314 - DNA, 426 bp, Homo sapiens
cctggttggcctccaccagtgcaggtaccttagacaagctctggacccctctggcctccatgtccatacttgacatttaggggtggatggtgatgcctctcccagttagtggctctaaggatccaatgagttatgagagcaagtgcagggcttggcacctggtagaaggtccctaagcaattaacaaaagagagttggtgttttgaagggactgaagccacaatccaccctgcagacatgggcacctctgtcttttccattttggctcccaagtcagccttataaaaagtcatcaataagtctcacccccaatttgtgttgcttttgaggggttggcagtgtcatgcactaggagtgactgtgataagtatttactgggtacccgctgtgtgctgggtgcctacagatgcccgcattcatcttcac

SEQ ID NO: 230315 - DNA, 690 bp, Homo sapiens
cttaggggccccacaacacagaggcacattcattctctccacgtcctggaggtcagaagccaagacggagctaaggccgaggtgcgggcagggccgtgcccttgtggctctacgggacaggtttctcctctcctttcacagcctctagaagctgcagtgtccccgggctcggggcccttcctccatcttggaagccgacagtgcagtgtcttctcggcctgactctgaccctcctgcctcactgtgacgcctcccgtgatgacactggcgcctcccagatgatcctggatcaccccccaccaaggtccctctccccaaccatgtctgctgccccctgcttgccacacaggatgccgttcagggcctggacagcagccgtggcagccccaggtgccatgtccccgctggccactggggggctcaccgcgtgtgcacaggcaggcagcggctcaccccgtgtgcgtgggtcaccccgtgtgcgtggacaggagggggctcaccgcgtgtgcacaggcaggcagcggctcaccccgtgtgcgtgggtcaccccgtgtgcatggacaggagggggctcaccgcgtgtgcacgagcacagagtcctggtagagccggtcatacatgcagatcttcaggtccacgctgggcttcggcacccagaccggcacatcgatggccacgcccacgaccctg

SEQ ID NO: 230316 - DNA, 468 bp, Homo sapiens
ttattttcaaataagagtagagatatgtgttcttgactgtcctcagaatgagagtataactaatctggagagtcataagtctccagattaacaagaggaggctgtgtaataactctatcaaattgtgtaataactctataaaaaaggagtaaacaaaaacccaatcagataaataagaaacataagtgagatcaagaaataaaattaaatataacatttgctatgctaaatgtgaataatctaaatgtgtctgctaaaacatagagactgagaatggctagaaaatattcattgaaaatgaagacatttagaagaaagtaattagcaaagtatgaaaataaaaacatgagaaataggaaaattcaaaaatcaaaaggaaaacaaaagtaaaaataattacatgcaagttatatttttaaggaaaaagacattaaaaaactgaatagttttaaaggacattatgcagtg

SEQ ID NO: 230317 - DNA, 422 bp, Homo sapiens
agaatttcaaagccgggggctctatgactggctggacgctggagctctcctttaaaggatggaggcaacttggccaactgcatattattttctatggcagtggcccccactgttctcaggccatgaaactcgggaacggattgtggctgtcacgcagaatcaaagagatggattggccgtgttgcttcaggactcaatcttctcaaagcttctgactccagacagacagtgcctccccattctgctggctgagacaggaggggtataagaccaaaaatcgaagtgtgtaagatcctgaattccactgcctgccaagcaactgaaagtgcagttatcatcagctgcttctccctgatctattttcccattaaaaaataaagacttggatcctgcaagagctctgggatcccttcgatggcaaa

SEQ ID NO: 230318 - DNA, 373 bp, Homo sapiens
gctattcagggtcccttgaaagtctatatgaattttaggattaagtcttctatttctgcaaaaatgttggggttttgacagggattgtattgacattagttatttttatgtatttgtgggattcataaatttagcatgattaaaatgacaggacacttgtttggttttcattttgaatcaacaaaatttcatgtattttgtggcctttggctaggctgtctaaatatgaatttatatgttttctgtgctgttgttaaaaaaaattggaaagcatgggagcagtataaagaacaaactaccacctgtttatccatgcatttgtgtgttttaaaagtaaaataaaagtatttctatgtatgaaaacatataccta

SEQ ID NO: 230319 - DNA, 409 bp, Homo sapiens
ctttagactggggcatggttgtgcttatgagaaatgctactgagcattaggaactcacggttaccatccatgctatttcgcatttagggttctgtcctcaaagttagaaatgttttatattggccaggcagggtggcttatgcctgtaatcccagcactttggaatgccgaggtaggcggatcacctgaggtcaagagttcaagaccagcctggccaacatggcgacaccctatctctattaaaaatacaaaaatttagccgggcattgtggtgtgcgcctataatcccagctactcaggagactgaggcaggagaatcacttgaacccaggagacggaggttgcagtgagcccagatcgcgccactgcactccagcctgggcaacagaataagactccatctcaaaaa

SEQ ID NO: 230320 - DNA, 433 bp, Homo sapiens
gcctgcagtagattagaagcagtacatttaaaaatgaaagagggattcttgcagatagtactgggaagaaaggacagctggtaacccaaatataaggaagtgggccaggaaattataaaatgtaatgcccagaagaagtaaagaaccatggcaattgaagaacagctggcccaatgcccaagaatgtgttctacaccctcctcaggaatgaatgtgcttccaagtccaacacctactgccctgcctgtcaccaagcacagcttctgtggatatttgatgaactataacatgaagaaatttagaatgagtgagggaaattaaaatgaagtccagaagaccagcagagatttcaccgggcatgtgggtaggaaagacgtgtgagaaaaccatttgaaatggaattaaaagaaaacgtgttcagctcactatataa

SEQ ID NO: 230321 - DNA, 434 bp, Homo sapiens
ctcattagacaggcttagagtctttctcttctgccagaggcttctgagtgggctctgagatacagtcctgagggacttcttcagtcatgaagttggggaggagcatgcagatcagaaacagactgagtcaacagcgaactccacctgtccctttgggaaggggagtggcctttctcagactgtgaatgcagcccatgtgtaggggcaccgtgctggtgtgggaggtgaaggctccatggctgcccagctgggagtccgtggtagcaggagggcctggcgttgcagaacggctcaccccgtgtacggccctctctcagagttccttgcctgcatgagtcccttctaccgcctgcaagtcccacgttgggaagcaagtgggctggaaagctccatccacccatgggttgactgtccttaaagggcaggttcagctc

SEQ ID NO: 230322 - DNA, 418 bp, Homo sapiens
tagttacatatatgttctgccttcactgctgattcttttagtgtcctaaatgggaagttttccatgtcctttgttttgttttgttttgagacagaatttcgctcttttttgcccaggctggaatacaatggcataatctcggcttactgcaacctccacctcctaggttcaagagattctcatgcctcagcctcccaagtagctgggattacaggtgcatgccaccatgcccggctaattttgtatttttagtacagacgaggtttcaccatgttgaccacgctggtcttgaactcctgaccacaggtgatctgccgctttgttggcctcccacagtactgggattacaggcatgagccactgtgcctggccatgtgtcctgtgtttttgatacaaataaatttgttgtagccaaagc

SEQ ID NO: 230323 - DNA, 1127 bp, Homo sapiens
tgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagcccctccttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggttgctaatgtgctctctggacgttattaa

SEQ ID NO: 230324 - DNA, 728 bp, Homo sapiens
ccgcacccagccatatatttttaaatggtcttactgagatgcaattcacatgccataccgttcacacatttgaagtgcagaattcatagttttcactatattcacagataagtgcaggcttcaccacagtcgattttagaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccatcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctc

SEQ ID NO: 230325 - DNA, 907 bp, Homo sapiens
gattactgactcaaaactctctcactgctgggcgaaaagaatgagccagaaacttaaatgcttttagaatttggcccatggccctttgatttgcgagtattctttatggtttaaaatctcctcctagtagctcataaacatgtatttccatattgatttggggctcttggtaacccaatttgtgtgattttaaagctgcagaggctgataggatttatctttggatgacatgttggcatgtgcgtggcttgcgcctggtcatggatacggtgtcccacagggtatttggaggcaggaaaggatcatggagagaggcctgtatgttagccctgtagccagcggccttgacaaggctcagaggcatcttaaggacacctcaagagcttttcagcaaagatgtcacatttgccttaggattgctgcccccgggcctcacacccagttcacccaagagggctctcgggaagcgctgcccggggtagtgtggtggtggtatgcaggggtcggggggaaccactcttggagaaccaactgtgctaagaccatggagcctgcagtgagttgcccaggttcacaagcaagctctgtcgctttctagtgtctgacctcaggcagctcttcccctccccaagccatagctcctgcatctgtaagatggggagaacctgtctcagaaggctgctgtgagaatgaggtgaagtgctgtatgtacagtgctcgcatggtggctggcacctagaagaaagtgcctgttacatgttagctgtctttattgttataattagtgtccaagctcacccaggaacagagatgctcagaccaacataaattctggatctccatgtaactctgggcaagttagtaggtaacatatttaagtcttggtttcctcctctgtaaaaaacac

SEQ ID NO: 230326 - DNA, 200 bp, Homo sapiens
gggttgtgtggtttgatccttctcatcttaaaactttgtttagttatgggacctactccaacttactttatgcacagtaaataatgtgtactttaaaaaaatctataacgtatatcataataatgacagcctgagattaagactgcaaaataaaaagctgaaagggaaaaagtttccttttgactttttctcaatagtgc

SEQ ID NO: 230327 - DNA, 418 bp, Homo sapiens
aaataatcgctaaattaccaagccaagcaattgcttatggagaaagccacaaaaggaaaaggcatccttaacactctgatattaaaacaacaacaataaccaaaaaagactttccaagtttataattttttaaagtctgtgttttcctcatgttctcactcataggtgggagctgaactcgagaacacatggacacagggcagggaacatcacacaccggggcctgtggtgcagttgggggctgggggatggatagcattaggagaaatacctaatgtaaatgacgagttgatgggtgcaggaaaccaacatggcacatgtatacctatgtaacaaacctgcacattgtgcacatgtaccctagaacttaaaattttaaaaaaagaattttccagaaaaaaataaagtctgtgtttta

SEQ ID NO: 230328 - DNA, 294 bp, Homo sapiens
acgtccagctaatttttttatttttagtagagatggggattcaccagattggccaggctggtcttgaactcctgacctcaagtgatctgcccacctcggcctcccaaagtgctgggcaactccggctttttacttctaacccctctttttctgtgtttcttggtctccaggtgttgatgaggggattaggacacggaggtcactgcctggtttcctgctggcccctgtgaggatctcagtggtggagagtggttcaatgagtcctgcagggcacccccttttgtggctcttcag

SEQ ID NO: 230329 - DNA, 445 bp, Homo sapiens
gcctctttgcagtcaagataagaggaaggcttctgtctcctgctcatttctgggaatggaatgcctcggtgtaaagccgaccattcattctattctgaggtaggagaaaaccgccctgtggttggaggtgagacatgctggcagcaatactgctctgtgactctttgctacactgagatgtttgtgtgaagagaaacataaatctagcctacgtgcacatccaggcacagtacctttccttgaacttattcatgacacagattcctttgctcacgtttccctgctgaccttctcgccaccatcaccctgttgccctgccacactcccctcacaaagatagtaaaaatagtgatcaataaatactgagggaactcagagaccagcgccggtgcgggtactcgcacactgagctccggttgtctgggcccactgctgtttctctata

SEQ ID NO: 230330 - DNA, 385 bp, Homo sapiens
aatatgtcattctccccatattccacaagctgtgagctagttgtaaagttaatcgtcacacactgtgtgaaaaataatgggaaaaaaggtcaagaaaagataagtcagccaggcactgtggcttccgcctgtaatcccaacattttgggaggctgaggctggtggatcacctgaggttaggggttcgaaaccagcctggccaacatggtgaaaccctgtctctactaaaaacacaaaattagccgggcatggtggcgcatgcctgtaatcccagctacttgggaggctgaggcaggagaattgcttgaacctgggaggcggaggttgcagtgagccaagatcacgccattgcattccagcctgggcaacaagagtgaaactctgt

SEQ ID NO: 230331 - DNA, 488 bp, Homo sapiens
ggagaaaagatgggagattacaccttctcccttgaaggccaagtcccagaattgcatatatcccctcggtctcagcttatgacatgagtacatccagctacaagtcaggaaatgtggtctttatccagaatggccatgtgcctacccaacagcctggccccattactgaggaccaagaagagaatggatgtggagagcatcaagcatcgtctgccacgacacttaagcaacggtgccaaacacatttcatcccgagaggctggggatttgaggtcaatcattactgagaattaggaaaacttttctaaatgagagttgagaaaaccacatgcttttatttaagcgtgttttattcctccggaagttctcttaagccagatcaaataccaggcagtacactgccagatcctgtccgctattggaaggaaaataaaacctacacaaaagaaggtcagcttactcactgtcatatgaaagatcttactctg

SEQ ID NO: 230332 - DNA, 245 bp, Homo sapiens
tttgtttgctgtgcaggatgccttacccttggatggtattggaaacacactaccagcaaattctggctctttggatcctgtccaggagatgccacaccatcatttacaccctgagaagtaatttcctctaagaaaacatttttgattctttatctccaaccaccaacccaggtagaatctcagctctgtcttcaatcaagtcctttgcccattttaaagaattgggttgttcttttattttttgc

SEQ ID NO: 230333 - DNA, 352 bp, Homo sapiens
cttctgttcatagtctgtaaaatcagatgaactgccaatcagagaatgagagctatccagcctggccttaacattctttcaattaatacataaacaagaagggggagattttgggagccaagtaaactatcatgaaggcaggatgtgggcaaactcacgactgtgcctgccaccaggaggtttgctgagggtggtcactccctggcgccggtctccttgaggttatctactgtgacatctagagcctattgttagaggaatgcagtcttgcaagcctactctggaccaaacagctgacctcttcttccacccccacttctcaccatctcttttgcctaataaacacagaggg

SEQ ID NO: 230334 - DNA, 381 bp, Homo sapiens
cgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggtaccttgcaaaatactgtcataagtgctaaaggacgaaagtgggaaaaaacagaatgataacatggttcacattttaaagaattaaagtgctggttttaatagta

SEQ ID NO: 230335 - DNA, 569 bp, Homo sapiens
cgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaa

SEQ ID NO: 230336 - DNA, 360 bp, Homo sapiens
ttcagaaatggggacaatgaattaagcatatatgtatattaaaaagtgatatgcactcctagggtttacatatgtatatgttaaaggtatttatggaataaatcctaggaaagcttaagttgagtcacttgaggtgttttgactgagactgaaaattaaggaagataacttctgcatgttgacatacaatactttcaactgagtaacaataataatatcctaaattcaagtacggttggtgtaccataaagatgtacatttctagtcatttaaaaaatgttacttgaattgaaatgtcgttttttttagttagcttgttagataaagcccccaaggaaataaaaaaaaaaacaatgaaga

SEQ ID NO: 230337 - DNA, 204 bp, Homo sapiens
aaggctctttctcagtatgactcatgtgaacaatttaaacaaacagctgtggcaggagatggccactgcagcctgctcgagtaggtaaaatgtactgaacctgtgtggttaattagatcaatcttgactcattttctttaatgagacagtataacacacaacgtccaccagacctgttttctgggttttgttttacataatttg

SEQ ID NO: 230338 - DNA, 356 bp, Homo sapiens
gtgagccgagattgtgccattgccctccagcctgggcaacagggtgagactccatcttaaataaataaataaataaatttgtcatccagttattctgtcacctcatcttacttcaatccatggcacagctcagaccataactggattttctgggttcttatttatgtgtttgtttattacatgtctcttccagtaaaatcaggaatcatggccatcttatttattctgtattctccatatataagaaagtgcctggcacatagcagacattcaaaaaatatttttgaatgaatgttactaaattgtattgttagagaaggcaatatggcaaatttattaaaaccacatattttggg

SEQ ID NO: 230339 - DNA, 580 bp, Homo sapiens
aacaaatagacactatacgtaattacagtaataaatgctactaaaaagaaatctatgagagaaaataacaagagaactctttataatggtcagagaagccctctctgaggtgacagttaagctaaaatctaaaggataagagagctcagccatgccaacagccagaagagttcaccacgcagaaggaatacgtgtgtagggaaaggcctatgtgatttggaatgttgtgaacaatccggagctcaagaagagactgaagagttaagagtcaaagatgactctcatatttatggtttatccaaccagatgtatggtagtgccaatcagatgcagaacactgggagaaacacaggtttaggcagcacttacacgtttaggcttgagaatcctgggaggatctaaacagtgatatcacgtaagtagctgaaagtataaatcttgcttcttgtgaggctggtgcatcactccctcacctatactgtaccatgtgattagggtcccagatgtctcaaccctactggcagtgtctgtcctagactcagcctagtggtggcagcagctgcttgaacagcagtggtgg

SEQ ID NO: 230340 - DNA, 706 bp, Homo sapiens
aacaaatagacactatacgtaattacagtaataaatgctactaaaaagaaatctatgagagaaaataacaagagaactctttataatggtcagagaagccctctctgaggtgacagttaagctaaaatctaaaggataagagagctcagccatgccaacagccagaagagttcaccacgcagaaggaatacgtgtgtagggaaaggcctatgtgatttggaatgttgtgaacaatccggagctcaagaagagactgaagagttaagagtcaaagatgactctcatatttatggtttatccaaccagatgtatggtagtgccaatcagatgcagaacactgggagaaacacaggtttaggcagcacttacacgtttaggcttgagaatcctgggaggatctaaacagtgatatcactatcctaagcgaaggcacttaaagagagcaacacgaactcagaagcaaagagttgcagaccctcatacagccagtctttccgatgtaaaataaatctcaactgctcaaaacctaaaggcttctgtggtctacattcaccaaaaaaggcagaaaatggcgtctatcattaacaaagtttggcctacctacctagcaacattagccagtgaacagatacctttacttcagtctcgtcagattattctaccttcccaagtattaaatgaatatcgttttgtttcacttacttta

SEQ ID NO: 230341 - DNA, 435 bp, Homo sapiens
ccagtgtgacgtgtgaacaggtccctgtgtcccagcagcaagcaggtcctggtccacacacggacgactgaaggactgcacttctgaagtgggggacagggaggggaggggcaggagaggaaggaagaggaggagctgctggacttctgactttttttatggctttgcccagcaaggaagtctggaattcacattaacataaactataaacgcagaatcagttgatgaggacagttagtgaggagatggtcttttggggataaaatctggcaggattgctgacctggactctgtcatctaaagttctcacacaaatgaccattacgttgtgatgcatgaaacaagtaacttaatatgtatttttgtctgagtataaaatcattgtgttcactttggaaaatatagaaaataaaaataaaatatactttaacagca

SEQ ID NO: 230342 - DNA, 753 bp, Homo sapiens
aagagtccagtttttacccactttctcagttcaggcttcccatagcacattcctcagtgccatagccgagctttgtgcatgctcgtttttctggtgatttctcttactacctacttcccgggtcaaacatccccattctgggcctaccaagcagacagttattatagacacatcaaagggaaaagaaggacctttcttagattgagttcgagcagggaatgtagttgtagtctcagctccagtccctgaccaggtcctaaagctccagcccttggggcacgtgtccctccctctggcccccatgggcctcatggcttctcctcctccctgagctcctcccttccatgggcattagatcatgagatctttgtttgtggcatctaaagatcaacttttctttgaagttggttgtggttttctggtttttctttttcataatttgtgttggaggtatggaagagtatgctcgtcttccaccctttaaagcaattctaaaagactgaaaaggtagtttttttaaaatggagtcttgctctgttgcccaggctggagtgcagtggtgcaacctctgcctgctgggttcaggcaattctcctgccacaacctctggagtagctgggatcacaggtgttcaccatcatgcttatttttcgtgtttttggtagaaatggggtttcacaccatgttgaccagctggtctgaaactcctgacctctagtgatctgccctcagcctcccaaattggtgtttgtt

SEQ ID NO: 230343 - DNA, 495 bp, Homo sapiens
gtggagtctgaagttgtcatgcagtgactcatgcaagcttaggcagatttggtgatatacgacacagagatgcaaagaaatgttgtagctgacacacaccggctggctctgggagatgcagaaggagcacgtcacccaaaatagagccagacagacatccttaaggaaagagccaaggggctgcatcttaaagaatgaagaaaggatttgtcatgagagatgggacaggaagttcttgagaggcagagggagattgtgagaatgttgggaagggaggagagattctcgcacatctgggaagctgacaatccatcagcatgtccagaaggaaaataaggaggaggagcagaaacagatgaggctggatatagaagcagggctgaagctgtgtcgattgtggtaaagagttgcgattctatccagaaggcaataggtagcattctaaacagagatcttttaaaacaagagtcagcaaatattttctgcaaggggcta

SEQ ID NO: 230344 - DNA, 407 bp, Homo sapiens
ggacacttgtcattctatttgccctgttaatggtaagtttcatggtacatcataggtgttcaatacatgttttgactttttaaaaagtttgctttcactgtcatgatttagttcatgagcatttagtaaacaagcaggaggagaaggatcccctcaacactgatgacaacgatgatgatgatgttagtaatgaagaggaaacaagatagaaaaagaacctgtatgtagggtaacctgtcaattttctaatgagcatgcctaggtcaaatgagagtgccggggtcttaattcaaatccctcttctaccacttagcaggaagcatcaacaaggcacagtatgacccattctcactttctttgtctttaactagaaataaagattcctcacaagctgtgaaaatcaaata

SEQ ID NO: 230345 - DNA, 395 bp, Homo sapiens
gacagtttcttttttacaaaactatttccacatttgtcaaagatgcaatgaaacatctctaatatataatgtgaccctataaaagtatattctaagtcagaatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcac

SEQ ID NO: 230346 - DNA, 142 bp, Homo sapiens
agaacctgttttagaatggcataatggtccacatttgggtttaggtgttgattttattatgggtaaggcttgtgcttgttcccacatgttaaccatatggcctcagccacagggcacttccaaaggaagtgactgtttctgg

SEQ ID NO: 230347 - DNA, 384 bp, Homo sapiens
ctttttgccactatactagccttacaagagaccctcaagggaattgtaaacatgaggaaaaaagaataatacttgctcccagaaaaatacccttaaatacatagcccacacaccttgtaaggcagacaaacaatagagatgacaaagtaacaagttaacaatttcacaataggatcaaaacctcaaatatcaatgttaaccttgaatggtaatgattgaaatgcccccagttaaaaggcactgagtcgcaagttggataaacaacaggacccagctgtccttatctccaagagctccatcttacatgcaatgacacccataggctcaaataaaaggttggagaaatatctattatgcaaacagaaagcaataaagggccagagt

SEQ ID NO: 230348 - DNA, 378 bp, Homo sapiens
tcatctgcttaaaatgcttgtgggcaaaaaacaaaaagtaaggtccaccaatatgcactttaagttgagatcccagcatgaataaaaacaaataagagggctgggtgcagtggctcacacctgtaatcccagcactttgggaggctgaggcgggtggatcacctgaggtcaggagtttgagaccagcctgaccaacatggagaaaccccatctctactaaaaatacaaaaaactttagctgggcgtggtggtgcatgtaatcccagctactcggaaggctaaggcaggagaatcacttgaacctgggaggcagaggttgaggtgagccgagatcgcaccattgcactccagcctgagcaacaagagtgaaactgtctc

SEQ ID NO: 230349 - DNA, 377 bp, Homo sapiens
gtaagccagggattgtacatattggaaaggaagggattgtacatattgctcacaaatgacatgattgactatgtatgaatcccaaagaatcaatttttttaaaaactggaactaacaagtaattatagcaagtttgcagtatataagattaatatacaaaattcaattgctttcctatatgccagcaaagaacaattggaatttgaaattaaaaacacagtaccatttacattagcaccccaaaaatgaagtacttaggaataaatctaacaaaatatgtataagattgatatgaggaatactgtaaaacttggatgaaaaaaaatcaaagatgatttaaataaatagaaatggtccatgttcatggataataagaa

SEQ ID NO: 230350 - DNA, 400 bp, Homo sapiens
ttctcctactgtcctgtctccaaagaaaaggagaaagtaaaaactgaaaaataacagactgattggcgccactggccaggcctgtaggttaaagattaacccccaccccaaccgcttgtgctatccatagatcacagacaatggtatgaagaaatacttgccttcctcaccacccctacctagtcatgcagacaatggtatggagaaatacttgccttggtcaccaccccatctagtcgcgtaccccatgcttgctcaatctatcacaactttttcacgtggaccccttagagttgtaagcccttaaaagggccaggaaccctttcttcagggagctcggttcttgagatacaaatctgccaatgctcccagccgaataaagcctcttccttctttaacc

SEQ ID NO: 230351 - DNA, 395 bp, Homo sapiens
accagcctggccaacagggtgaaaccccgtctctactaaaaatacaaaaattagctgggcatggtggcagatgcctgtaattgaagctactcaggagactgaggcaggagagtcacttgaacccaggaggcagaggttgcagtgagccgagattgtaccacggcactccagcctgggcgacagagcgagactctgtctcaaaaaaaaaaaagaaagaaagaaaagaaaaaagaaaagaaaagaagagccaagaagtgaaaaaggaaaacagacaaattcctatcaacacccccacctccctgccagcccccagcgttcctgcagggagctagggccttgaacccctcacctcccgctgtgggacctgggggtgggcgtctcacactctctgagcc

SEQ ID NO: 230352 - DNA, 288 bp, Homo sapiens
ctcctttgccttccatcaggattgtaagttttctgaggcctccccagtcctgcagaactaaatctaatcgacaacgtgatgggactttgtggtggtgattaatcccctcatataaaagacctctgagtgctgctttgtctccttctgccacgtgaggatacggtgagaagaggctttttatgaatgaggaagcaggacctcaccagacagtgtgtctaccagtcccttggtcctggagttcccagcttccaaaactgtgagaaataaatttcagttgttcataagcta

SEQ ID NO: 230353 - DNA, 433 bp, Homo sapiens
tcatacataaaatttatattagttcaacagactttttgcttgtaatagagtgatatttaaatgatattttagaaaaagctgtttcctcaaacttctgcagatttccttctagccaaataaaatcagattacaacactgcttactactgtcagtattcagactcataacatttaatgttccagtatattgcgtgttcattatatccatatagcaaatatcctcattgcctgatgaataatacaagtaaaatttatgtaattatgttctttgcatgtaaagaatgtatcatttgagaaaagtttatagtaagaccaccgtaaaatgctaaagtcacttttagtattcgtttttaaactcagtgtactttggtaccttctccttcgcatttttttttctgtttatagttttaccttggaaagataaaaaacaaaaa

SEQ ID NO: 230354 - DNA, 398 bp, Homo sapiens
tgaaacagggtcactctgtcacccaggctggagtgcagtggtgtgatctcagctcactgcaacctcagcctcctgggctcaagtgatcctcctacctcagcctctccagagtagctgggactacaggggcatgcaccatgcctggctaatatttgtactttttgtagagatggggttttgccacgttgcccaggctggtctcgaactcctgagttcatgcgagcttcccctcttggcctcccaaagtgctgggagtacaggcgtgagccaccgcacccagtccctcatttgttcttataacaaccctaaggcctgtgattcttctctatgtcaatgtcatggaagctgtgtgaggtagaaactcaccaggtcacctgctggagctcacggggccttca

SEQ ID NO: 230355 - DNA, 428 bp, Homo sapiens
cataaaatgaattcttctagaaataacaagacatgaaaaaatagataccagggtggctgtaccttccaaccacaccataatgctagtaaattactgcccccttcctttaagatttagaaagcgagataaatagcatagaaaatgttgatagtggcagaaaaggaagtaccagattcctaactcaagttcagctactccttcaattcacacatgcacacacacacatacccctgcctcaaaaatgtcacacatacccctacctcaaaaatgttaagaaacaaaacaaaatacatcctttccaattctgatttttcagattccttttccagccaatagtagtcccagctacttgggaggccggggcaggaaggtcacctgaggttaggagttcaagatcagcctgagcaacacagtgagaccctatcaca

SEQ ID NO: 230356 - DNA, 266 bp, Homo sapiens
gtgggcttgacattaccatcctgctggagatgttggggagcacttgtaccacaccttcagtatccaccatggtcactcctttttgggctaggtgagcgcatgcctccttctgccaggtgtagaacttgatccatgggtaaaagagcctaggcccccactccatttccagactgaagctcagggtccccagaaactcccaggtaactccagagtctagggtgaggtatgggaacaagaatggtaagttcacacccaggaaggatttt

SEQ ID NO: 230357 - DNA, 489 bp, Homo sapiens
atactggacatcacaggaccctctccggctggataccaggctgtagaaccaccagatgcttcagatgagaaaggttggatctgtttcacagggaaggggctaaactgtttcaagaggcgaccacgcgctgggcactctgtactttgcaacctaccaagtatcatcacaagagctatgaaagtgaagagagacatacgttatctaagaatctgagagagatgactcagtcagcatcctctctcttggtgtacaatggtagggacagctactgtgtcatctggagcatgacaatgagaacacagacactggatcgtcctgatatagcctgcagtccatctgggcctctagacattcatttgcatttgcattcatgcgcatcccctactactccaactcctacaccttttggcaggatatatccacacagctggattggaatcacaagatgtttttattttttgcctcattaaactagtttctctcaaaaaa

SEQ ID NO: 230358 - DNA, 430 bp, Homo sapiens
gagccaccgccgcccatacccctacccccagcgccgaaggaaaatgctcctccccctaacgaacacggcccctaaccacatactttgcaacctaccaagtatcatcacaagagctatgaaagtgaagagagacatacgttatctaagaatctgagagagatgactcagtcagcatcctctctcttggtgtacaatggtagggacagctactgtgtcatctggagcatgacaatgagaacacagacactggatcgtcctgatatagcctgcagtccatctgggcctctagacattcatttgcatttgcattcatgcgcatcccctactactccaactcctacaccttttggcaggatatatccacacagctggattggaatcacaagatgtttttattttttgcctcattaaactagtttctctcaaaaaa

SEQ ID NO: 230359 - DNA, 402 bp, Homo sapiens
  misc_feature (9)..(9): n is a, c, g, or t
acgagtcgnaatcaaacacaccgccctcatgaagtaaaagaagaaggcttcatactttgcaacctaccaagtatcatcacaagagctatgaaagtgaagagagacatacgttatctaagaatctgagagagatgactcagtcagcatcctctctcttggtgtacaatggtagggacagctactgtgtcatctggagcatgacaatgagaacacagacactggatcgtcctgatatagcctgcagtccatctgggcctctagacattcatttgcatttgcattcatgcgcatcccctactactccaactcctacaccttttggcaggatatatccacacagctggattggaatcacaagatgtttttattttttgcctcattaaactagtttctctcaaaaaa

SEQ ID NO: 230360 - DNA, 415 bp, Homo sapiens
ggccacaaggaactgggtgcaggaaggtggtgaagggcccaaaggacgcgtgcgtggcctcaggaagtgccggaagaaagcctgagtctgaatctgagaatttctccaggtttaccttcttgaggggtcgccaaactgttttccaaagcagctgcctcattgtaccttcccattctgtatctgttcatccatacagccatacatgacagtttctccacatccttatcaacacttgttattggcctttttttaaaaaatcatagtcatagctggtgggtgtgaagtggtgtcgctttgtggttttgatttgtatttccttgataagtaatgatgttaagcatcacctcacatgcttaatggccatttgtgtatctttgaagaaatatctattcaaatcttttgcccatttaaaaac

SEQ ID NO: 230361 - DNA, 327 bp, Homo sapiens
gattaaggattttgagctggggaggtgactctgaattacatgaatgggcccagtataatcacaagggtccttataatagggagactggagtgtcagagtcacagatgagctgtgatgatggacgcagtggtgagagagagatgtgaagatggaaggagagggccatgggccaaggaatgtgggtggtctctaaaagctggaaaaggcaagaaaatggatcctcccctagagactccagcaggaacaaaaccctgctgacaccttgactgtaggacttccaacctccagaactataaaataataaattcatgttgttttaaaccacta

SEQ ID NO: 230362 - DNA, 582 bp, Homo sapiens
ctcaaatcacaattggaatgagagactcaaccagctgtgttataactgcactcagcactaagagctttctgttagctattaacctgttaacagcccgcaggtgctagcgacctgtctgtggaagaagggataagatctggtctggtggtctggcggtggcttaaaagtagccccattgaggtgctctgagaatgccgttttgttttgaatgctacagctgcggtgtactcagcttactaactcctcttggcaggtcaccctcagctctgattgtttgtccaccatgtgtgtgtttgctttcatctgcgttaattgctgcttcatctgtggcatcatcggtcacctaatgcttgaatgttagtgccatgtcttcattcttcatccgtgtccctgtctgggccgcagctgcagccaagccgcagtgcctgccttctggaggtgtctgaggtaatatcttcatttggtcacccttcactgtataacacacttctaagattttttgatttgggtttttgttcgttttcttttctgttgtgcatttggtctgcatattttcatttttggcttgattatgaaacatta

SEQ ID NO: 230363 - DNA, 623 bp, Homo sapiens
tatttgacttctttactgcaacctgttttatccgcaaggtctttaaaacttgtatcttttgctgaccttctatcctgtcctgttacttagaatgcctaaccatccaggaatgcagcccagtcagtctcagccctattttatccagcccctattcaaaatagattttctctggttccatatgcctctgacatctcccccttctttttaacatgggcacacttaatcctaagagttgtagagggatgaagattcattttctgtaactacttcatgctgaacaggggtgatgatatttttgcctaactagtcagagtcttcttgaccctgaaaaacaaaacaaaggatcagtgacattttatgcaaagtcaaaaaatataacttcagtcttctattagttcagtccattcagttaattcctattctgtttgatagtcatgaacatttcagttctccatgaatactgaaagttttttctgtattctaatgtcacaatttctaaagttacaacaaacttgcatttgagaacatctgtcaaagtcttaagttaactataaatcatcttttgaagaggatcaacacaagttgattgtctgcatgggaaagtcttagggcagtctcagcaa

SEQ ID NO: 230364 - DNA, 696 bp, Homo sapiens
ggttttcccttgtgtcttcagctttcatgtgtggaatttatttgcttacacatactacccctcttcctttgcttttctctttaatactttttattttagcaaaggagagagtcgaagttataaacatctggatccagctccttccctcaaaacttaaaaaaaacactttgagcttcttccagccacttaaaaagccaggctcattcagagctaggcaacataccggaaagtaaatggtcatctagaactattgggttcttttttttccccgagtttttactttaaagaaaggacatttcaggatgtgtttaagagatagagaagggctgggcgcggtggctcatgcctgtaatcgcagcactttcggaggccgaggtgggaggattacttgagtccagcctgaacaagatggcgaaaccctgtctctacaaaaaaattcaaaaattagctgggagcgatgttacgcgcctgtactactctggaggctgcggtgggagaactgcttgagcccgggaggtcgaggctgcagtgagccacgtcgcaccactgcattccagcctgggcgacagagcaagaccctgtctcaaacaaaagagatggagagaagaaataatctgcatttacctctgcagtcttcagtaatgactggaacagtgtttgccttaggattttctttcaattgtcaattttcgattt

SEQ ID NO: 230365 - DNA, 263 bp, Homo sapiens
tctatctcacacacttttgtctctgctcttccacgtatatttttatctactaattttcacctttgaatgtccctcttttgaagatgggtgagtggggcttccagttttgtaagggatacttgcgttatgttaggatccagcctaacattttcaggagggtgtgttttggggaagaggtgtgcgtattaataccacaagccagaggatgactctagtggacatttgtcagactttgtggcttccaagcatctgggcccacttcc

SEQ ID NO: 230366 - DNA, 241 bp, Homo sapiens
ctcctgagtagctgggactacatatgtgtgccacaatgcttcagctgtgtctgtcagtctgtatatagagacaaggtcttgctgtcttgcccaggctggtctcaaataggtcaagtcgtccttctgccttggcctcctaaagtgctggcattacagacatgagccacagggcccagcctgcttacttttctaaaacttaactcatccccacagtttttgcctattgtatgaaaccccttta

SEQ ID NO: 230367 - DNA, 402 bp, Homo sapiens
tgccttaaacagtaggagtatatatatattttgtgtcttataagcccccagcaggagaaggataccctagcgtctctttcatatttgatagcgctcacattttgtagttggtcagtaaatgctagatggatgcatgtctgttcatagtcattttcctgatgctttgttctgcttgatttttcttaagttgacatgttttgtttcgttttgtatttgttttttttgtgaggcagagttttgctctgtcacccaggctggagtgcagtggaataatcgtggctcattgcagccttggccttgctgaggcaggagaatcacttgaacccgggaggcggaggttgcagtgagccgagattgtgccattgtactccagcttgggcaagaagacacattccatctcat

SEQ ID NO: 230368 - DNA, 500 bp, Homo sapiens
tgggatgcatcacagcttctccaaagttttgctttgactttaggcccaattcaaccaacatgaaacacccacaaattaactcccaggaaaaacatggctctttgagaaaagaactgacacttagtaagcagctgagcctgtcagtccaggttgcaggatggagcgagtgagctctcggcgggtacagtggcttgcactagctgaattcattactattccctttgtgcagccttgtgctttgaccactcgcatatatggaataggacttacaaaagaaaactgttttgtttggcaggtgggaaatcatttcaattgagatattttttctgtttactcaagtaaatataaagatgctttgattttccacaaagaaagagttgttatccctatttgaatttatgttgcttcaaaaacaaacatcttacttttagtatcagaagcagaccattctgttccttagggaagtgatattctttagtagactggtgggagacttgtag

SEQ ID NO: 230369 - DNA, 595 bp, Homo sapiens
  misc_feature (558)..(558): n is a, c, g, or t
agagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattgaccttgaaatccatgacgcagggagaattgcgtcatttaaagcctagttaacgcatttactaaacgcagacgagtttgaagtggagagacagacagacagacagagaggcaggcagagaaagagagtaagctcgtgccgaattcggcacgaaggtttgcttaggcgcagacggnggcgagcccatgccagtggcccgggctgggtttgtcc

SEQ ID NO: 230370 - DNA, 417 bp, Homo sapiens
gtactgggattacaggcgtgagccaccgagcctggccgagatggctcataagtttttggaactgaccagagtatattatattgactcttaaaagctgagagccaaatggaatgtttattaaatgccatataccctcatcggagtagggctggaaagacatttagagaacttccactgtctttgcctcccctggacaagtcccctgatggtggctgctgtctattggtggacactaacaagcatgcaagccctgctgtcacactgcctgagtttgattctcagcccctttgctattgagctgtgtgccctccggcaagttgcttaatgctgcatgtctccattttcccattggtaaaatgaggataataatagtgcttcctcagaggtagggctaaatgagacaataattggaaaggg

SEQ ID NO: 230371 - DNA, 558 bp, Homo sapiens
aagaacaactaagtagaaaatcaacccaaaggaaaagagaaacatattaccggtcacctgagatgaactctttattagatagaactttagctctgagtttcctggcagttaaggtaaaaagaaaaacatgtgctcattgtctgataaaaatcaatgtaatatgattaggtcttgagagaaacatgtagatatgctgagtgctcagataagattacgtttgagaataggcagattcaagacacattaaaagccatgcaaaaatccatactccttaatctaataattccagttacactgaggaaataaaaaagagggggaggaatgactatgtgtgtgaaaatgcttttcacaaaattatttatgaaagtgcagaactgtaaagagccagaatgggaggtagagttaattgtggtgcactcattcaagcaaacacaatgccggcattgtaaacagtgaggttctccagcagcacagagaagcaaggtgcgtgatcggctccataagaacaatcaggagataaaattatttgttcaccaaggttctaactatataaaaata

SEQ ID NO: 230372 - DNA, 570 bp, Homo sapiens
caggtgtgagccaccacgcccggcgacagctctgtcttgaggctgacagtgatttgtgatgccctccccccagggccagggctccaaaatccagcgttttctgtgccctccagaggcaatggagaacatcttggttccgtcatcactggattgctctgaatgagctgcacctgaggcacctgtacagcactgtcagctttgggcagaccacactctctgggtgtgctctcctgccagagtgtaaccacgtgtttacttctcagagctgggtacacaaagatccggcatcagggaaccttcactggattcccttcgagccatcttggtcccatatcaaaaccctggttagggccttcaacagaaaaggtttttggaaaactcatttttcctgaataaattgctgaggtcttagtttttaagaaaattctcattatatactcgatgcttaccatgaaacagattttgtgggtgagttatctgacttgaatctgtctcctcctctctgagatgagactaacagtgcatgctctttgggtgaggatccgatgctctctccacccctgagtctgt

SEQ ID NO: 230373 - DNA, 379 bp, Homo sapiens
caatatgctagaccctcactacagctatactcctcaaatctatttgtatagtcgacacaagagttttacagcaaatgcaaactatacctatgtaggtacatgacacttgtctcactcaaaaataactgaaacagaactcaaagaattctcttttgggaaaattctacatctaaggccgggcacggtggctcacacctgtaatcccagcactttgggaggcttaggcggcagaatggcatgaacctgggagttggagcttgcaatgagccaaggtcgcaccacggaactccagcttggcagcctgggcaacagagcgagactccgtctcaaaaaacaaaacaaaaaacaaaaacttacccttagtgagggtaattgggga

SEQ ID NO: 230374 - DNA, 689 bp, Homo sapiens
cgttttacaatggaataaaaagccacccaaagaggttctctgtccaaaaagtagagaagcagaatctggtacagggaaattaaagaagcacaggaaatatacttaactgaggtttctagataatgactatatgctcaaactaaatatgacttaaaaatagctttgtggcatgcactatacaaaagtgatataaaacctatcactagaagaaacagacacatacaatatgctagaccctcactacagctatactcctcaaatctatttgtatagtcgacacaagagttttacagcaaatgcaaactatacctatgtaggtacatgacacttgtctcactcaaaaataactgaaacagaactcaaagaattctcttttgggaaaattctacatctaaggccgggcacggtggctcacacctgtaatcccagcactttgggaggccgaggtgggcggatcatgaggtcaggagttcgagaccagcctgaccaacatggtgaaacgccatctctactaaaaatacaaaaaaaaattagctgggcatggtggcttgcacctgtaatcctagctactcaggaggctgaggcaggagaattgcttgaacctgggaagaggaagttgcagtgagctgagattgtgccattgcactccagcctgggttacagagcaaaactccatctcaaaaagaaaa

SEQ ID NO: 230375 - DNA, 208 bp, Homo sapiens
gtactggcttgcctgcaactttgctggtttcagcactgaaatgtctgaatcctggaaactcttcaatcataagcaacccagcatggttggttaccctatgctaggcagtagtttaggtgggagattagggttatctcacggaagaggcaggatcgtctgttccctagacttactccagaagaccttaaagggtcagcattgtgatccc

SEQ ID NO: 230376 - DNA, 750 bp, Homo sapiens
ggccttctcctgtctgccaccacgtgagatgtgcctttcaccttccactatgattgtgaggcctcaccagccatgtggaactagttcaagatttcaacattttaagataatctgaaaaaaattggaatgtgcccccagctgcgctactggtgacttcttcaacagttgagaaactgaactatgtgttcatgaaaatactccatcattaaagtttatgcaatactctctcaacactgtttatcaaaggaaccaatatggaaggaaaaacattgctttgaagggaagatggatggatcccctagtaaactacagcttgaggtgcaatttcctaaagttcaaatgcctgaaaaaggaaacgaaagaaagaaactcaactcttgagacagcttcaatgctagctttgatctcaattatagagttatttatgaaaagtgcatttttacaactaaaaataaattaggatcaaaagcttctagaggctatactatggagtgcttaataaaaagttgagtaaagagcaaaaaaaaaaaaaaaaaaaaaaaaaaacttttggcgcggcgcggggcccgaaaaaagtttctaaacccccgtgttgggccggcgggcccagtaggttagtggcccgggcccacaccggtccaagaaaaccgggctggacacgggggggtttccccaaaaaaaaccgcgggggaccggcgttctggcaacccagggggccgggcctccggcctcaccgggccaggccgtagg

SEQ ID NO: 230377 - DNA, 371 bp, Homo sapiens
gagtcattaaatctcaaggatatctatttggtcatgttttcttgtggtatttcaaggctactggtgacttcttcaacagttgagaaactgaactatgtgttcatgaaaatactccatcattaaagtttatgatcttgtccatcattcttaacaatttgacagcgtgtccagaacattgcgcctaaatgaatctaacaagaggtaagttgaacataatattggtatttgaaagtcttcaatagaattaggcccttaatttagctttttctaagactttaaacattcaaatgtttcttctgcttatacttaaatagtctttaaggcaacttatttgttccctgaacaaacttcagttgcttaaaaaaaaaaaa

SEQ ID NO: 230378 - DNA, 429 bp, Homo sapiens
tcatggaagtttttaaattaaaaaaaacttcttcaaaaatgagattgtgggacaatggtttggggaatgttcaaattgtggaccccaaaatggaaggtggttttggaaccctggcagtcactacttcgaagttttggctctgttattgaaagtggtggggcaggatatggtggctcatgcctgtaattccagcacttgataggccaaggcggatagattgattgagctcaggagttcgagaccagcctgggcaacatggcaaaacctcgtctctgaaaatttaaaaaattacccaggtggtagcgcacacccgcggttccagctacctgggaagctgaggtggaaggattgcccgggcccgggaattcgaggctgcagtgagccatgattatgccactgtactccagcctgggtgacagagtgagaccc

SEQ ID NO: 230379 - DNA, 230 bp, Homo sapiens
aggtgcccagactgtggtctttaagtaccattccctacgagaaggaaccaaggcttcatggaaaatggtggattccagatctggagcaagaaatgtacacactgagcccgcaacgtcttatttctaaatgcaaggacatgcctcacgattgatgggaatatgtctgagggacacaggagctagcttggaggcattcccactgggacactttgagcatgaggaattatgac

SEQ ID NO: 230380 - DNA, 409 bp, Homo sapiens
gaagtgtcaagaaagttgaacgtttctgagagattggtagattagctcccagggcagtcccgcagcacgaggtcacctgtaatcctcccggatcagacacggtgccaacccaggtgcacccacaacccttgcatggcagcatctgtcatcctggtcactcaactgccttctgtccttctggtaagaacatcccgcccctgtggaaaacagcctgtccttcctccaggcaggtggctccaatctcaatcatggcacctcgagaaactacgggtgatcatggccaagctcagccaaggcagagccattcttcaggatttataagtgcagtgctccaccgaaacagggaaacactgctctcttttcctctgataccattaaactgacatgacatcagactgaagtggccttt

SEQ ID NO: 230381 - DNA, 334 bp, Homo sapiens
cggaccctccccacaccccacccaaggcacctgattcctaaggaagaaaaatctacctctaaagcacccgcttcttcgcttgagaactaccctctcttttcatttttggcctccccgccgggtgagtggaaaccgcttgcacattctatagaacccgattctaatccagacgatccggagaatttgtacggtgaccggcagggggggcgggaggagagagcgaagtcaagtctccagggccgctggcgacttcggaagccgcgcgcccggcgctctcggccgcccccggccgctcgcccccgccgcgccgccgccctcgcccccgggctcgccc

SEQ ID NO: 230382 - DNA, 241 bp, Homo sapiens
gtacagcatgggcaaagagcagctttagtggaattaacataacaatgtgggaggaaaaacaaggcaggaatcagaaccctgtgggtgaaaacattgcacaggagcccagggccagagcacagcgtgtcagtgaacagaagctgctgccatgatttagtccaccttcttacctagatcagccttcgcttgggcagggtccagatgcggagatgtgaaaaacgtgatgccaccaggcctgtgt

SEQ ID NO: 230383 - DNA, 446 bp, Homo sapiens
tgggttcaagagatcctcctgccttggcctcccaaagtgttgggattacaggcatgagccactgtgcccagccactaatgcatattaataacaaaaataatagctcccaatttttgagcattttctttgtgccatgcaatatctacgtgctttatagacattgattatcttagttaatcctcccatcagccctgtgaggtgggctaatattatctctcttttacaaatgaggaaccaaatacagagattggagggattgatctggtaggtggctgggatacaaatggaagtttaatgcttacattaagcaggacacgggagcgtttctttcttcttcaatttgttttcacctccaaggccttgccttggtcttcagccccctgagcttcacctttctagcactggttcttaacttcttactgaaagaaatgacaagccactgatct

SEQ ID NO: 230384 - DNA, 519 bp, Homo sapiens
ttagttaacataattttttaaatctatgaaatcttacctgactgcagattcatcaggaattccaacatctattaaagaaaaaggtaaaatgcattttaaatcaataataaatgtacagaatattaaaatcataagaatgcacagtgatgcatgcctctaatccaaactacttgggaggatgaggcaggaggatcacttgaggagcccagaagtttgagaccagcttgggaaacatagtaagactctaccttcataaaaaaattgtgcacacttgtgtgtatgctttagatcctgtttttgttgttgttgttgttgttgttttggtttggtttggttttttaaagcataagactgacgctttgttacaaagcattcctttgggagcatgcctgcgaccttattagaattaacattcattatacgtattggtaggtaattaatgcagtaagaactcttccctctgtatttattagatgcaaagaagaataaatttattaaaatttggtatctacaagtgaa

SEQ ID NO: 230385 - DNA, 301 bp, Homo sapiens
atgacttttcttgaatctgccagagaactgaagtggaaagacaaccaaatagccagaaatgtaagagatacatcccttgctaggaaaaaaggggcatgagcacttgcttacataaggttgactcatgaatgccataagaataactgggctagatagtttataagttggtagaggctgagtgtgggctggcaagagaaagtgaagccccagatggccttagatatatggagattttataccctcttgcaggctcttttatcacagtcccaccaggcagtttctcctacccttccctactgca

SEQ ID NO: 230386 - DNA, 440 bp, Homo sapiens
ccgcggcgcgtgagtgcctgtgcacgcgcttgtggccggcacacgcgtcctgcggggtcgggcggctcggggcggaccgaggcgtgtgcggcgggggcgtgcggggcatcgcgctgggggcgcgcgtgtgtgtgtgtgtatgtgagtgtcctcgcgggtgcgcgtgcacgggcttgtgcctggcccgcgggcccgaggggaacaatgctcggggcgctccgccggagggatcctgggccgccccgcgcgggacccgtgactgtcgccagcccggggcggaggtgcagctgcctcctgcctcgcggtccaggggtccagtttggcattttccctccctggtctgaggcgttttcagtctcgggtgcgacgggggcggggccgcggggcccgacgcctcaagtcttatgcctggggtttgagcggtcaccgcgcggcggccg

SEQ ID NO: 230387 - DNA, 381 bp, Homo sapiens
aagagataagtggtagcaatcttaacaaattagtgattttatctggttaggccgtgtaatcaaacacgtgggcaggaaagtggatccattatgttgtactcatgattgtggtgctgaaggtaacccccattgccctgtaggctgcccccagaagcagggggtacagccaatagtattcttagaagttaatcaattctgtaacgggttgagtgttttggtctcatttttagtccgaggtgccctgatgctggcctgtgactaaggggagtcagtggcttgttatgaataagaggacacatgagctgaatctgaggaagttcagaagcattttataagttgtttaaaatacatccattaaagtatatgattattttttggtaa

SEQ ID NO: 230388 - DNA, 713 bp, Homo sapiens
  misc_feature (106)..(106): n is a, c, g, or t
  misc_feature (230)..(230): n is a, c, g, or t
  misc_feature (232)..(232): n is a, c, g, or t
ttgagctgttcaacaagttccgcacaaggcctaaaactcaattgccttattcttttgcttctgctcgtccgtatacaactaacagctcaacccacacctctagacnacagtagtcgtgctttctgctaacggtgacattttcagctcttaaaaagaagcaaggagattttcaaatgctagagtatctctatcagaaggcataggacattgtgtccaaagtctcaagaacnancaacactttccttctgacctggtccaaaagtcagcaaacagcaagcaggcagaggccctcataaggacttttctgtcctcctttgaccaaactgtttaaccgagcctaggggtgagggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaaatctaaataaagcttattttaaaatatgaaa

SEQ ID NO: 230389 - DNA, 470 bp, Homo sapiens
aaaacagtgatatagtattaatatctatgtaagttctgcaccagccttttagtaacttggagaaaactaggaaaaagttaattaatgaagaaatataacttatgtttcttgtagactggtaaaactccatggaagtggttaatatcaggctctagattaataaatacctggtttaagttccagttctgtcatttgttaactgtgggaggttgggaaagttgtctaacatcaaattctaggtttcttcatctgtatatgagagttaataataccatctaccagtgtggaatgataagacaaggaagactcagaagggtgaggaggtggaaggggggtggatgatgagaaattacttaataggtacaatgtatgttatttgggtgacgaatatcctaaaagccttgatttcaccactatgcaatttatgcatgtaacaaaattgcacttctaccctataaatttatataaat

SEQ ID NO: 230390 - DNA, 490 bp, Homo sapiens
tatttaagcacaatgcatctccctctgattgtgtcatgtgctggaggagaatgtgaagttctgtctgtctttagcaaacatgtttcaagtactgtctgtctgaaaaccaaatggaagagggtaaacctgatgatccacttgattttagttttaggacctggatgcataggcagatgtcagtttacaaggattctgtgtactttaaggaatgttttctgagcatgtccagtacaacagacgctctgttaggtagctgtagttaggattttttggttgtaagtatgtgaagatttaaatgtatcagctcacttactcagaaaatctgaggcagtgctagccaaaccaaatggttcaagcaaatgtcatcagtatttggcctcttccagtctttttactcctctatcctctgtgtctgcttcacttctacacaagctttctctatgtggtggctccagattttatatcttctagtagatatttttttaaaaaa

SEQ ID NO: 230391 - DNA, 358 bp, Homo sapiens
acaattaaaaaatcttcaaacagttttaacattatattctaaaggtagtcattttccctgtcgaggaaatctgaatttcatcctgattcctcttacgccttatagttgttttcccagatttaaggggactgtaagaggcatgtcagatacacaaatgttttatgtgatcacctgctgagtggtcatagaagccagaaaggcagtcaagccacagccgcagcccatagtaaatgctcggccagtagatccccctcttgctgttggccttcagtttatgcttttttccacacctgcttttccagacttccttctagaattccaaagaaatgtaaataaatataaggaaagggagatggaa

SEQ ID NO: 230392 - DNA, 598 bp, Homo sapiens
tgaaactccgtctctactaaaaagacaataattagctggtcgtggtggtgggcgcctgtaatcccagctactcgggaggctgaggcaggagaatcactagaatctgggaggctgaggttgcagtgagccaagatcacgccactacactccagcctgggcaacaagagcaaaactccatctcaaaaaaaaaaaaagctaaatttcaaaataagggaggatcgctgggcgtgctggcttatgcctgtaatcccagaattttgagaaggggaaacaagatgatcacttgaggccaggagttcaagaccatggtgacaatacagtgagaccctgtctctatttacaaaaacaaaaacaccatcctcggcaacatagtgagacccctgtctctacaaaaaagaaaaaaggaaaattagccaggtgcggtggggcacacatgtagtcccagctacttgggaggcgggggtgggagcattgctggagctcaggaggttgaggctgcagtgagctgtggtcacaccactgcactccagcctgggtaatatagtaagaccctgtctcaaaacaaaacaaaaacgtaattaggccgggcatggtggct

SEQ ID NO: 230393 - DNA, 353 bp, Homo sapiens
aggatttgcgtttgtaacaagtccccaagtaatacgggtgctgctggttgggagatcccactttcgaatcgcaggttcactctacagtcccattgttaacttataaaactcttcctctctagttcttctttttgtaaaggtgtgtcctgaggaacctcagatttgaaagaagagtgaatggaagtcaaatgtggaaaccactcaaatgtccatcaactgatgaatgaataaacaaatcatggtatatccatacaaggaatattattcacccataaaaaggaatgaagtcttaatacacctacaactggatgaacattgaaaacattatgctatccattctgcttcaggttgga

SEQ ID NO: 230394 - DNA, 207 bp, Homo sapiens
gtaactactcataataaaatagtagatatcagagacaggaatgctaaatgcctgctctaacgtattgcattcttgacatttctagcccctgtggctgttcagctcatcctaacacttcacgccacaagaacagacctaaccagatctctatttttgtctgttgttctttagaaatgatggagaaagcatcttaagccttctgcactg

SEQ ID NO: 230395 - DNA, 569 bp, Homo sapiens
aagtgcatcattgctctgtgcattgaaggacagtgaagtggtggctgcttgtctgtgtgcccagaaccatcaggaaatggcttgagtaccccctgggaaaaaggctttgttaaaaaggaactgcttgttcactctgggacacttagccttctgcttattagtccttttgctgtgttcttaccaggttgagggacacttctttccataaatgcagacactgaagctggaatctggaacatgtgttttcagtatttagagatctgcagagtggacacatactggcacatcacaagcatgattgttatggtctcaaaagtgtgggaggatctcccaatcccaagagttttgagagcagcctgggtgacatagtgagaccttgtctctatgaaaaaactttaaaaaataaaaattagggcatgatggtgcacgcctgtggtccccattactcgggaggctgaagcgggaggataatttgagccaggaggtcaaggctgcaatgaactataatcacacctctgcactgcagcctaggtggcagggtgagatgctgtctcaaaaacaggaaaaaa

SEQ ID NO: 230396 - DNA, 300 bp, Homo sapiens
ttactaaaggataaaacagttttatgtctgagaataaaataggtgaaccatatgtgataagcacgataaattcttatttggcatttacagtatgacaggcacttttaaaattacttacaggttgagcatccttaatccaaaaatctgaaatgctccaaaatctgaaatgctccaaaatctgaaattttttgagtgccaatgtaatgccacaagtggaaaattccacaccctatctcatttgacaggtttcagtcaaaatgcagtgacacaacacacattttattcagtatcctcaaaagg

SEQ ID NO: 230397 - DNA, 409 bp, Homo sapiens
tattttctttctttttctgctctacttaacagatgaagcttaatttagcattttaggcagctgtgccctctgttggccttttctgaaattgcaatcaagtcgagctttgcattgctggcagacaaagttccctctgtatttgtgcagtgagaattataacccagaagcagaggtaaccaaggagctcttgagaaagtatctctggtaactagttgaggtggaagacaactccaggataaggaggcaaaacagacttttatgattcccatttaatagatgaggaagctgaaactcacatacggcattgataagaggctgaaactgaactctggaactccattctgagtcctgttgtggactcccagagctatactatatttcttctaaatgctctagaatgttatttgca

SEQ ID NO: 230398 - DNA, 544 bp, Homo sapiens
tgtcacagcttcagcaggtccctccattcagggtccctaacttcccgcaacattcactcatgggttgaaaaccagattagtgagggttaagtaaattgtgtggtaagaaaattgaaacagggcatatatagatgactagctggactttgggaggacaagagtgatggagtgctgattggagtttttggtggaatcttaaggttttgttttgttttattttaatatgttagataaatgtttatatgcttcctggaagagattgaagataaagagaggagatgggatggaatggcaccctctctggcaccctctccattgctctcacctggtgtctcaaactagaaacttcagaaacagctctaatttcttttgtaccaagcctttgccccacttaacacatagtaaataaatcttatttttacctcagaaatattatttgaatgtagtttctcttctccacggtaatgttgctttcattacgtcagcatcatctctatagggatgttgaaacaacttcttcctgcttctcttcctttaaaaaagg

SEQ ID NO: 230399 - DNA, 2910 bp, Homo sapiens
aggaaaagtcttcggacttgcagggggaattcctcctgggctaacccgggagcggggtccaggccacaaccggccggcggcggcacaggctccatgtgcggctccccctggaggcggttgagcccctcggagcaggagcgcgtagcacacacctcgggccgccaccgcctcccgcccgccaccgcacgcgcacgcgcggttagtagtcgctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaatattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 230400 - DNA, 3016 bp, Homo sapiens
aggaaaagtcttcggacttgcagggggaattcctcctgggctaacccgggagcggggtccaggccacaaccggccggcggcggcacaggctccatgtgcggctccccctggaggcggttgagcccctcggagcaggagcgcgtagcacacacctcgggccgccaccgcctcccgcccgccaccgcacgcgcacgcgcggttagtagtcgctgctgcgcggccgccggcgggactggtctgaagagacgcggggaccaagtggcaacgacttggacatctgagctgtcactgccgaaaacaggccgcaagagagcatctgcccaagcaacaaagaggaggtgtttgcttgggagttaaaagcaaatggcaaccaaagctcaggactgggagagaaaagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 230401 - DNA, 2932 bp, Homo sapiens
aggaaaagtcttcggacttgcagggggaattcctcctgggctaacccgggagcggggtccaggccacaaccggccggcggcggcacaggctccatgtgcggctccccctggaggcggttgagcccctcggagcaggagcgcgtagcacacacctcgggccgccaccgcctcccgcccgccaccgcacgcgcacgcgcggttagtagtcgctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 230402 - DNA, 492 bp, Homo sapiens
attttccttcttcagtatagaattcattctaggttcatgtattgcatttagttgccattacggctaattctcctttaatctgaaacagtccctcagtctttgtttttcctgatcttgacatttttcttacagatggttgctacatggaatatccctccacgtgggcttgtttgatggttcctcatgattagattcaggtacgcatcaccatataatgatgttatctccttctcaaggtgtttcttctataagcacatgatgttaatcatctcactggcaatttcttttttctttttttcttttctaatttttatttttatttatttttaattttttaacttttattgtaggtttgggggtacatatacaggtttgttacatgggtaaattgcatgttgctgaggtttagtgcacaaatgatttcatcacccacgtagtgagcacagtacccaataggtagcttatagacgttcatcctcctcccaccctcta

SEQ ID NO: 230403 - DNA, 421 bp, Homo sapiens
ccccacgctaggtcctcttcctggaattcccttccccgcctaagaaggaaggatgtgctccctctgcaagactctaatcaaatgtgtgtattcatctcagtactgccaaggcctgccatagagatgtacttgggatttaataaggtggttaactatgttactagctgtgtgacctcgaccaagttatttaacctctctgtgctctactttcctcatctgaaaaagggggatgatggtaacataccttagagggttgtttgtgagtattaaatgaggtaacatatgtaaacagcttaggaccctgcctgccatatagtatgtgcttaataaatgtgacctcacagtaatcgtttctttggtgccggtgagtgatttttgaagatctcttctacgtaatagacaatgaactatgtttaaggta

SEQ ID NO: 230404 - DNA, 351 bp, Homo sapiens
tgggccactacccacctgccctaatcaccccagagcccggtaccagagaactagagacagcctatatgccccagagcctactgaaattattcaaatgagctaatattacacctgcttaccctgcctcacctatttcttccctcagaaatcacaataaaggctcttactttttcttcctgctccctctgcctcttgaccgaccatgttgaccacggtgctgcccccatgtggccctgcaaggcttgggaagctccctccacttgggatctgtgggtaacaaagatctttttttttttttttgagacagaatctcgctctgtcaccaaggctggagtgcagtggcgcatctcg

SEQ ID NO: 230405 - DNA, 493 bp, Homo sapiens
actttgtgtgcactcactggtaaccatttttattctcgtcaatgcaatcacttgtttcctttaaattgggcaaatgaatggggggtttctcagagacagctgcttggcatttcaaattacttgactgttggttccatgattgcttttcaggaagtcaataaattttgctgggagataccagagtaccccgctcccccaaatatgatttgtggcttagtacaccacagtaaaccgtgaatgatttgcctaaagttcagaaaaataatcattttagatcatttttaatagatttctgtgaagtctggtgcctactgagaaattacagggtgggagtcactggcaaaccctgtcttcacttcctcctttcctctctctctgtctttccttcttccctctctctcctccttcagagagggcttcctcaaccccagcactccttgagggccaggacactcagttcaccctagaagttggtatcttaatctgattatgt

SEQ ID NO: 230406 - DNA, 523 bp, Homo sapiens
cagtaatttttctgttattgacttttaattcagagaggacacactgtaagatttcaatccgttgagatttgctgagacttgtataaggtccatgatatggtctatttcgataaacatcctatgtgcacatgggaagaataagtattttatagtgttgtacacacgtgaattaggccaagttggttaatcctattgttcaaactgtgtgaggttgattcaaggataaagaaataaaccagtgggatagagttccgagacacacacacacacacacacacactcttcagctgatttatgttgagatgttggggactcctccaattcggtggaaaaaaaatgatgcttttcaataaatgatgccaggtcaattggatatctacacgaaaaaaaatgagctctagccccgtaccacaccattcacaataattaatatgtaatcaatcatagatctaaatatgagccctaaaacaagcttctaaaaggaaatacaggaggatatcccaataaaaaggtactaaccata

SEQ ID NO: 230407 - DNA, 682 bp, Homo sapiens
gctccttagcatatgaattgaggcgcatcggagccctcactgctgggccagcccctcccgggctcctccggttccgggaggtccacagcccagcagcagctgcccctgcacgttgtcccctccgtccagcatcccggggccgaggagacagtgcccctggccgggggctgcgctggcttcaacttcccatgggcaaaacggggtcccgggtcagtgttcacagagggtctcaaaccctgcaggaccctgaaattgtctgggatccacaccagtcggaagaaaaaaagaatagaaaacgcagggattcacctcctctgcaggcaccctcatgccgaacactaaacaggatgatgttgaaaaggatttggagatttatgcaggtcacgagcttgaggaatttttccattgaatgcaccatgccttgggtttcccgtttcccactgaaaatcccatggctgacactttttttttatcattaccttgggagatgaagaaaaactcatctgttagggcagctctgtgaatgcagatgctttgggttgttttgaatgaatgactgaatgttctgaaataaagcaggaaggtgcctgcgggataatgactggtttcgcaactcttggccgggagtctagacccctctgataatcaatagaaatggatgtatattaaatttagcaataga

SEQ ID NO: 230408 - DNA, 461 bp, Homo sapiens
cttgttcttccccagtcctcacttaattcttaattggatataagccagggtctgtctctccagaatatcatcggccagcgtggccaatcatgagagagcaggaccaggggtcagttgaggcttattctaagatgagatgatcaaaataccaacatgcttttaagttatgattcttgatattatggtaactaggtatgcagtgtgtctgaaagagtcaccaggccacaagacccatctgaaggaagccagggatcagaatataaccctgtttacgtgatttccagctgccacccccccgtagctgcagctgtggttgatggtccctagactctgacaggagccaggcgctctcaggttggtcatgagagatttctccacagggtcacagaggacaacagtgattattcatgatgctgatcctggggcaggatgttggcttgaaaactagacttaaaatgggt

SEQ ID NO: 230409 - DNA, 426 bp, Homo sapiens
caaatcaaatgcccaactgattatcacacaactgatgaatggtaaataaaatgtggtatatttataaaataaagtattatatggcaataaaaaggaatgaagtactgacacatactaaaacatgatgaaatttgaaaaacatgctaaagaagccagctacaaaagatcatatattttatgatttcctttatatgtactgtccagagagtaggcaaatctacaaacacataaagtacattagtgtttgctttaggttgtagaggacttggtgacaaactgaataagagtgttctcaaatggattctgcttgtaacagttgtgcaactctgtgaatatactaaaaagtactgaattgtccatttttaaatggatagatgtaatgatagttgaattagatttcaataaagctgtttttaaaaagttaaa

SEQ ID NO: 230410 - DNA, 281 bp, Homo sapiens
agccatgtgcctgcaaccaactgatctttgataaagttgagaaaaataaacaatgaagaaaagacactgtattcaataaatgttgctaggaaaattggctagccatatacagaaaaatgaaactgaacccgtatctctcactttatacaaaaattaagttggattaaagacttaaatgtaaaacctgatactataaaaattatagaagaaaacccaggaaaagctcttctggacactggcctaggcaaagaatttatgactaagtcatcaaaagcatatgt

SEQ ID NO: 230411 - DNA, 377 bp, Homo sapiens
ttcaagctgggaactgctcagcgccgatctgcctggcgttctattcagtcatccctctgctcactgagacagatgcatattctgatgcctcctttggagagacttatcagaaactgaaaacaatgcaaccatttgtctctcgcctacctgtgtaggcgagagacaaatggttgggaagccccctccctgcttcgagttgtccccacctttctggacggaaccaatgtacgtctcacatatattgattgatgtctcttgtctccctaaaatgcatgaaaccaggctgcgcccgaccaccctgggcacgtcatcaggacttcctgaggctgtgtcacagacgcgtgtcctcaactttagcaaataaacctcctaaaatg

SEQ ID NO: 230412 - DNA, 314 bp, Homo sapiens
taaagcaagaaaggtgttttattaccatggcactactgaaaagatcaagcagtacttctagcaacatgcagtataaatgtggacactaacagtcactaaaatcatgaatgtaaaaatattatataaaacataaacataatacccagataatattattgttgttattgtagcatttggtcagggaaggagtcttcaaaatgctggagcagaatagtcaagagcaataaacctgacaatgttcttaggatttaaagtgcccaaacaataatctcactaaaaaaaaatggaggcggtaagtattccttcctcttttg

SEQ ID NO: 230413 - DNA, 459 bp, Homo sapiens
gagaagtttctgaaggtacttgatggcccttgggtagaactgaggggtctggcgcccaggatggagggtgggggaacagttttaaagttgctaccttttatacagtgaggaggctaggcagtcattgaccaccttctctctcctttctacagcctcctccaggctttgatttcctctcttcaaggtcagttttgtgaaccgattttttaggaggatggggggatggagaatgcttttgtgagggaacctggtgacgacctgctgtggcaactgttcactgttgactatagatgtattgggagatgctacagcggaatcaggctttctgatatcaacggcaataatttgattctagaggtcaaggggttgcagttgccacaataagccagagggaatgattagtaatcagagttttcatccacagaaatctgtgacaatgattagctgattttaagtttt

SEQ ID NO: 230414 - DNA, 472 bp, Homo sapiens
gacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtcgacgcggccgcgaatttagtagtagtagtaggcggccgc

SEQ ID NO: 230415 - DNA, 343 bp, Homo sapiens
aatattgtgattgaattaggcccatccatagaatgcagggtaacttccctgtctcagattctttaatcacaggtgcaaagtcacttttgccatgtaaggttacatattcaaaggttctggggattaggatgtagatatccttgaggtccattattcagtctaccatactgttagcagtactattcgtataatcagaagtgattccaaattaaaagagaataatacatacatgtgactaggacaatctctagtactcagtaagaactcgatagggcttagattcttcatctcttaaaaaaaatttataacctctggtgctcaaagtgaccatcttggctcccct

SEQ ID NO: 230416 - DNA, 466 bp, Homo sapiens
ttgtaaagtagccaccagggtttgaggtgattgactgaaattttgaaagaagttctactgtggttaaaatgctgtcaaacagcattgcatgttacagaaaaatcattcctgatttcatagccatcccaatcttcaacaaccaccaggctgatcagttagtagccatcaacatcgatgcaaaactctccaccagcaaaaaaaaaaatatatgactccttcaaggctcagatgatcattactatttttggcaataaagtatttttaattaagtggtctaccatgaaacccccagtatctctgagttatgcctttatatgtaaaggtagaaatctgatcaaaagaatgaagagacaaaactggatactttataatgcaaaaggctacaatccacagtacatagcgacaactgatataaagatgaaacagcaaaagattcaaggagaaataaagacaaattcaaaaagga

SEQ ID NO: 230417 - DNA, 399 bp, Homo sapiens
taagtattcccaatgtctgtattttaaaatgttttttaaaagggcacaattgaatgaaatttttaatatgtagcttttgagagattctactctgctttgttgtaactgctggtcagatggatgtagctgactgctttggcaccagatttgcacaaggcataaggctgctgcagaaatctgggtccagaacggcactatttggtgtccacatggcttttgagcacttgaaatgtgactggtcaaagctgagatgtgttgtcaggtgtaaaattcccactgagttttgaagacttactatttttaaaaagcgtataaaatatctcaatagtttttaatagtgattacatgttgaaatgtaatatttgagtttatgagttaaataaaatgttattaaaatta

SEQ ID NO: 230418 - DNA, 398 bp, Homo sapiens
acaaagaaaaaagagagaagacagcaaattaccaatataagaaatgagacacaagttaccactacagattatgcagacatcaaagggataataaggaaacatcacaaacaactgtatacacttaaataaaagggactaattcctcataaagcacaaactactacaactcatccaatatgaaatagataacactgtatctattaaggaaattatatttgtaatttaaaaattccaaaaaagaaatgcttcattggcaaaatttcccaaacatttaaaggagaattaatatcagttcaacataatctcctctagaaaatagaagagggacaatccattcaattcaaaacattttatgaatccaatattactctgataccaaaaccagacagagacagcac

SEQ ID NO: 230419 - DNA, 657 bp, Homo sapiens
ggcgatttggagaggattaggggagagtagtgaaagaatactcccacagggtcctccaaatcctcctcctgaatcctaccaacgaagaacacatgttggagccctggaattgctttttaagttcgtttctctccctttccaagcgactcggtgcagcgctggcaagaattttaagtggctgaagcaacgtatttggggtcgctgccattgggttcctttcagttgcctccttcaattcctccaaacctcgcttcatcccagacagctcagattcatgcagagattccgatcgccctgggaggagcctgagggttgctgccttttcctcaagtctacattgctggcagctgttgtaatgtctaagtgaagggccaggaccgagttcaggttaggataaaaggggaggtgagagggtggctggataaagagagaggacatgaggaattcccttccctgtgtgagaaaaagttgaaaaaagaagaaaaaaaagctccaaatgaatgaaaggattaaatattaaaaaaaaaatctgagtactagatgaaaacttacaagaatttccacgttaaaacctttacaacctcgggatggtgatgtgtttttcactattcaaaattcagaaattacaaaagctggagaagactggtaagttaatat

SEQ ID NO: 230420 - DNA, 364 bp, Homo sapiens
agattcattgaatagtaaattcttttcccctaatgtgtggcattctctgttgcttacctataagaaaaagaagttagtttgaagaaaaaaagtttgtttatatttttaaaatttttctcaaattaacacgtgcaatatcgaaagtacaaataataaaaattttataacaaaaataactgccttcagcctcaattgtccttactgtaagtcccactttacttcctcatgtcacctcataattattttatggaatttatatttaaatcagtagttggggtttatatttttacagctgtattgataccattcctgctaagccaaatagagtcctatatccttttttaaatatatatttttctcatcc

SEQ ID NO: 230421 - DNA, 294 bp, Homo sapiens
gtgatttgtggttatcaatgtgtgcagccttttgttatgaatatatacttttaggccaggcaccgtggctcacgcctgtaatctcagcactttgggaggccaaggtgaatggatggcttgagcccaggagttctagaccagcctgggcaacatggcgaaaccgtgtctctacaaaaaatcagctgggcgtgatagcgtgcctgtggtcccagctactcaggaagctgaggtgggagaaccacctgagcctgggaggccaaggctgcagtgagctgtgagagtgacacccctctc

SEQ ID NO: 230422 - DNA, 461 bp, Homo sapiens
attttatgattctaaaggaaatccttctagttaggaactagagtagaaactactgttttttggaagccacataaacctaccatccaaaaattccactgtgtcattctagtgtgtcaggcgagatgcgggttaagccagctgttgggccaaagtagtgaacaagccagacgaagtaaaaattaggccaggcgcagtggctcacgcctgtaatcccagcactttgggaggccgaggcgggcggatcacgaggtcaggagatggagactatcctggctaacacggtgaaaccccgcctctactaaaaaaaataacaaaaaattagccggtcgtagcggcgggcacctgtagtcccagctacttgggaggctgaggcagaagaatggcgtaaacccgggaggcagatcttgcagtgagcccagatcgcgccactgcacttcagcctgggcaacagagcgagactc

SEQ ID NO: 230423 - DNA, 351 bp, Homo sapiens
aatttattcaattattgattagaaattataggtaaaaatcatccaaatcatgcaaattctgaaaaactagaaatagcagctgttaacagtattggtatatgtcccttcatatactcaaatacatatatatatgcccagtattattttctattaatttttaaataactttttttactataaaagtgattcatatataattcagaacccctggaaaatataaaaatgtaaacaaaaaatggactgaaatatttccactcaaacataaaccaatcatttttaccaattcttccaaatatgtacacttatgtctgtaaaccccacacttttcaaaaaataaaaatgacacaagta

SEQ ID NO: 230424 - DNA, 284 bp, Homo sapiens
agtagagacagggtttcaccatgttagccaggatggtctcgatctcttgacctcatgatccacccgtcttggcctcccaaagtgctgggattacaggcgtgagccactgcacctggccaatttccttttttttttttttaaatctcctattttctaatcctttatctttttgctacactttctgggagatttcttccacgttattttctaactctctttgtccctaataatgcttttcttgcttaaggtctagtttgcttaatactattatagctaaatttgct

SEQ ID NO: 230425 - DNA, 272 bp, Homo sapiens
aatagtaaataatgactgttttgagattaatttagaaacaatccctatttaagagctttcatatgcagtcatgcattgcttgccacgtgaggagcttgagaaatgcgtcactaggtgatttcaccattgtgctaacatcatagcatatacttacacaaacctaggtggtgtagccaccatacctagggtacacggtatggcttaggactcctaggctacaaacctgtactttatgttactgtactgaatactaaaggcaactgtcacacaat

SEQ ID NO: 230426 - DNA, 398 bp, Homo sapiens
aaactcagaaaacaattaactggccagcaagcatgctaaaagggaaaagagaatccaaaaatttcagtagctacagtatagaaagatgcaactctcataacaaaaaggtaagaaaaaaatcaagaaatgctttgagaaacaatgacaaataattaaggcaaccttaaagcaaaagccaacttgagggcatgccaatcttattatttgctatagcctctgaataatttcagttgattcatgataaatcctttcaattgactaaaatggcttagtgaaaataaactaatagtgagcttctttcacattatccttataaattaaacataatgagaatgaaatttatagaacatatctttaatcttttactctatactttttgatgtgtctattggcatgtg

SEQ ID NO: 230427 - DNA, 271 bp, Homo sapiens
taacttttttttcctatgagtttatctacttaagatacctgattatgaatggaatcatagactgtcactttgttcctggcttatttcaattaacatgatcttctccagaattatcatataatgtgtctttttaaagactgaataatattcgactttgtgtatgtgccacttgttattaatctgttcattggtcaagggacatctggattgtttctgccttttggcttgtgttaataatattgcaataaatttggttgtgcaaatatctctt

SEQ ID NO: 230428 - DNA, 489 bp, Homo sapiens
tctttttttgggtggggggatggagtctcactctgtcacccagggtgcagtgcagtggcatgatcttggcttttgtgcctgcaactcataaggaacaggtttaggccgggcatggtggctcacgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatcc

SEQ ID NO: 230429 - DNA, 401 bp, Homo sapiens
atgaaacatctgcaagtagttgactgtttgtctctcctctcccctactcctgcatgtttccctatcatttttgtcaaataggagttagtgaacttgttaagtatagtgatatctcttccctaataagctatcttactatggttcaaaggcaacaccagtgtgctgccctctctctgcagtacacaagcaaagaatggtatacatctactaggtggtccgggcaataaggcctctgaccatatttgccttctccttcaagctatggctgtgaagaataatttaagaaataatctcctgtattcacttgtgcccattactggttttcatcaagatacttgggtgtaattcctggtaaaacaaccacagttgatgttaaacaagtctctgagaattaaataaaa

SEQ ID NO: 230430 - DNA, 424 bp, Homo sapiens
cctcctgggctggaggaaatggagctggagtgagatctggctgcagaggctgagaggttgcaaggtttgggcaaggctgcagaggatggcagggcttgcagggagatagagattgcacaggcagcgggggtggggagtggggggtgcgggtgctgcgactgggacctcatgctccacagctaggagaggttgcacaggctggaagaagtgccaggagggaaagattgctggagctaatagagatttgctgcctggctaggagagagagataggctgagaggtcgcacagcctcagaggttgcacgagctggggaggagaaggcccttcctctcaccttcgtcttctactgattaactgtaagcctgaggtccccaacatacctgccttcagacacccataacccaccccttgccactggcgaaa

SEQ ID NO: 230431 - DNA, 309 bp, Homo sapiens
ggacatttcccaggattggacgaggccagtaaggtgaaagagtagaggcctgaagattccagagagctagtaacaacttcactgaagtggctgagatccacagtgtgtcaggaggtgtttctagagaggtacagtagatgggaaatgagaggacatgaattcagtaagctccttaacctcctgcctcatttatcaaatgggtctgatgaaagtgatatatatgaaagcacctggcataatattggtcagattgtggtgcttgatgatggaatggtgcataaataaataaacacgggctctcaatcaatg

SEQ ID NO: 230432 - DNA, 267 bp, Homo sapiens
cattttaaaggaaagaaaatatgtaaattctattgagcaaaattctgtcctgttgaaacttagttctaaaggttttgaatcagttgttacactctgacacatgactgttgtttgcactatattatcatgtcttctttaaaagtaaatatttttggtttctgtaagaagcttgtttaataatgttgtaagccgtggctatagttttatcaagactctgaacacaagatgtaacaatgcaaataaatttatgtagtgagtaaagttgct

SEQ ID NO: 230433 - DNA, 367 bp, Homo sapiens
ttttactcagaaaacatccttcaatccatactgatataaacaaatgaattgatgaattcttcggagaaaacagacaaatcttccttaaggaataatttttaataattatataaatactatccccttctggaggtgagcttttctctctccttgtggactggacttagtgatttgtttccaaagaggacaatatggaaaagaaaaaaggaataactttatagttaggaaatcagtcagactccaccttagtcaagtgttaagtgttaaaatcaccagtgataactcatgtggtagcacatctgtggtattagtcccataacccacaatcccagcctgatcatgagaacatattaaaactcagattgaa

SEQ ID NO: 230434 - DNA, 455 bp, Homo sapiens
cagagaccaatttaggctcatactgttttttttttttaatttagcttattgtacctgatattttgaacttttaattgctatcaaatttcagctctggttttatgcattgttgtaatttctcagtgaatcccagtgcttctttccttcttgaaaaatgccatttcgcccaggcgcggtggctcatgcttgtaatcccagcactttggtaggccgaggcgggtggatcagctgaggtctgtagttcaagaccagcctggctaacatgatgaaaccctgtctctaccaaaaatacaaaaaaaaactagccaggcatggtgttgcatgcctgtaatcccagctactcaggaggctgagacaggagaatcgcttgaacctgggaggtggaggttgcagtgagccaagatcgcgccactgcactccaacctgggcaacagagtgagactccatctcaaaaa

SEQ ID NO: 230435 - DNA, 434 bp, Homo sapiens
acatgaggttttaatgggtctcttgcctgcatggctaaatgggaactgcgctatgtaacaggttgcctttcggcttggagcccggatgctcagtgatcacatccctagaatgttctctctctaaaggaaatcttgtcggaagaggctgtgttatgtgagttccagctgttcatctaaagtggaaggagcagtgagcaggagggatgccttcagcttccgtccgtcttaaaaacaagtgtaacataatgggatatggccctcaggaggaaggctgatttctcgggcatacggggtactgctgtcattatttagcatgtattaagcaccccacagcacatgcggtgcacaaggaaagcatagttccaacccacatgctacaacaaggcaggacacagaaactgggccccctgacattcagtaactacactggcaga

SEQ ID NO: 230436 - DNA, 579 bp, Homo sapiens
cacttctccagccaggactttgaatggctccccattatctgttgcgttaggcacagaccagcctggcatgggcaatatgggcaaactgatttcttgccattctgttatattttccaggtcaatggaactatttgctctttgtgctttgctgtttgtgctctgtatctttgctcatgttggctttttctatcttaaatagtctccttgactttaattgttcttacgtatgtttcagggccatttgatacggaacttcctttgtgaagcttatctgtactttttcttcccatctagatgagctgtctctcttctttaagtttaaaccaccataacattagagtctgcctttttgcgataattgccttaaatcctgcttctacccacagtataagactgaagctatttcaagacatagactgtcctcttcatcatccaactttgtacatagtaggtacttggcaaatatattttatattgaaaatagctttgaatcaggatggatgcagagataattctttatccaaacaaaatgtttatcattaaaatctataaataaagttgtttatgtgagagaatccc

SEQ ID NO: 230437 - DNA, 515 bp, Homo sapiens
ggtggagggccccgtgatggcgtggggacttgcgttttcccctatgcgcattccctgaaacggaaactggacgtttcctcaaatttttgtcatgtgccactgccccttcccagtcacctggtctaccccgtcagcccctcaggctgtgtagaaattccagaaccgtcactgttgtgaagaaaagatggtggaatcaccaggaccacgaatggaaacgctctttagaaaagcagtttgaagaaactgactttctccttgttctgtaaagtgcacagggcggcactgcgggcattcagagggaggagggcccttcctgtttgaaaaagccccagggctttttccccatacagacctgatcacctggattaaaataaaacaaaaatacacggcagccaagtagtttgtatcatgcttatatctcagatcactagaacctggcctgatgggtttatatgtttgtatgtatttttaaatgaatattttaaaataaaactcagtgaaatcgtcacagcaaa

SEQ ID NO: 230438 - DNA, 419 bp, Homo sapiens
cctccagactggtccctcagcctgtatttttatttatttatttattgagatggagtctagctctgtcgcccaggctggactgcaatgtcatgatctcagctcactgcaacctctgtctcctgggttcaagcaattctcctgcctcccgagtagctgggattacaggtgtgcaccaccaccctcggctaatttttgtatttttagtagaagagggtttcaacatgttgtccaggctggtctcaaactcctaacctcaagtgatccacccacctcggcctcccaaagtgctgggattacaggcataagccaccatgcccggccctgtgttttttagagtcttagaatattagttatgaattataagcccccttctatttcctataggtatccaatagtaaaagaatcagagagttattgaa

SEQ ID NO: 230439 - DNA, 462 bp, Homo sapiens
cggatttctatctcaaaaaaaacagcagcagccagagactacctctcttttttctccactgttagatgtgagttctaaatttcttttcaaagaatcaatatgtcaatatgttcagttcgttacctcctacttttaagcttcctcataaagcaacattttccgattacctgctccaccctgactcattccagttacctgctttgtcatacccatttttcccgccaaaccactcaccccatcactctctttaaatcagccaatcggaattatttagcctgtgcggtctaacgctagctaataggggaacaacacagcaacagggaccacttgcgtcagggataagaaccacttcccctcccgtgtccagatgtgtgctcaccattgctccatctgtaagggtgcacccttctatagaagtatcttgccttgatgagaattaaaaggaaaatgtgatattggagt

SEQ ID NO: 230440 - DNA, 393 bp, Homo sapiens
accctgactaatggaaaggatttcatgggccagcaaggttcaccagatatataatgtgatgtagctgaaacaacagagtactcttttccaaatctctaactcacatctttttgtcaataaatggctcctatcacttcagctgcagcctttcctctccactcctttgatctttcttccccacccaattagccctctaagtgatattctatacactggacacctcttggaaaaatgaaaaaatgtgagcccaatgacaccatttgccataagactgagctgtaaatgggcaggagctggaaaagaaactaatctttggaagagcaaactacatgcccttgccaccctggatgtaggtgcccagtcacactgctcatgggcatcacaggcagagca

SEQ ID NO: 230441 - DNA, 137 bp, Homo sapiens
gtcatcacagcacagtgttgacctgcttgttaacatgaaatggggtggtggggacagcttctgcttctcttgcataccatcataaataagaaaagatactttgccataggatcccctcacccacccctttgattagg

SEQ ID NO: 230442 - DNA, 477 bp, Homo sapiens
ataagattgtcttcttgttttctttcattctttaactccatttttttggttttgttttcatgattagattttccttctcatttaccacctgtttttcttccctctgccttctataatccaatctcctctgattagactttttagtcccaatagtgtcattgtgggccaacctcacccctttgtggtatttaggatcacagatttctgaactcttaatatgacctcattaattagaagcaaccagtgaaatttcaatctgatattttcaaaccaaatggacatgctttatacaggaatctaagaacattcttgatccttgatcttgataacatgtaaaatggctaactagtaactagaccagaaatagcatcggggcgatctatctggttcctgcatctttttatcatagttttccttggctgagaaagtaatccagtaccaaatgttgttaaatgaagatatattatgctagagaaa

SEQ ID NO: 230443 - DNA, 462 bp, Homo sapiens
gaggtagtgcttcaggaatgaaggaataagcaactttgttaaatggttctaatagagtcagaaaagtgtctatgaatttggcatcatctagattaatggttgctattacaaaagcatttccagtgttttggtggaaacagcagacaagtgaaaggaagtagagccatagcaattgcaccggaatcgacctaattcattcttttgaaggctgtatgatggttcatagatgcttctaccacaatttactcaacctttcactattgatgaacattccctttgttttcatttttgtcactgaaaataatagtacaataaacattcatgtttctctgtctctgtgttcatccttacacactggtacaatgtatttatataggaaacattctaggaatgggcttcctgggttgaaagataggtgtattttatataattttaaactatattgttaataacttcccccaa

SEQ ID NO: 230444 - DNA, 404 bp, Homo sapiens
cttaattacatctgcaaagacccttttgtccgaatgaggtcccattcatgggctccaagtggactaattttggggggttggggaggcatcatccaaccccttgcacagcattcttcctcaggatgcttaaaattgcgaaaccttttactcctgtttttctatatctctcaatgagcctaacaaaatggcagcccttgggaagtctccaggcagtgccattgaccaacaaggttatcgccaacccagttttcctgtagagcatgctgaccttgcctttccaaactcctggaaagcaagaacaaaagtttttttaaaaaatttacatagaattggcatatattagacacttcatgtttaattgaacggatcatttttgagtaaacttttcttgtgatagcctgtgg

SEQ ID NO: 230445 - DNA, 510 bp, Homo sapiens
cagacattagtaacgtcattttagccccaaatatatttcattctgggtttatattttttggactcacacagcttatgatgattttatccaaagttcatgccaccagagttggaatttttaatacaaacatttagaccaggcagtgattggcagttctgactgttaataccccgtagtaggtcttctaccgtggtcagaagttaagatttattttgacaagctttctcttggttttgtagactagaagctttataatgggggttaccccatgactatatatctggcataggttattagaattcatagcaaaatggtagacagccttctcccatacaaccagagcccgcagatactggaacatgatattaatgaagttatttccagttattaccttctttaatgggtagaatctggacattggatttgaattacaaccagacaataagtggccatgaatgtcagcatctcaacttaggaagactcctgattaaaaacaacaacaacaacaaa

SEQ ID NO: 230446 - DNA, 207 bp, Homo sapiens
gctctgggtgggccctgtgaattatgtagtgagctcagtctgtagctcactgttgcctgacaatgcaccaagctccttaggttaaattcaaggctatcagcctttccagtttttcctagagttattgtcctgctgagccccaggtgacaggtcaccccctgctcttgtcagaggtgttggaaccagagtgactccatcttgagtagc

SEQ ID NO: 230447 - DNA, 547 bp, Homo sapiens
ataatagaacctatacataaagtagttgtgaggattcagtaagaatgccatgcatagcgtgtctgatagtgtgctgtaagtgtccaatacattttagcttttatgatggctgaagtctcaaattctttctgctgtactatacgtactttgaaaaatattttaagactttagaagtgtttaagcaacctccaagtaaagctagactcttgatctctagttggatgtatcatttgttgtgatctcagccctctgaaatagtaagttttaaaaatagcgaaaaggagccacttaaagttgttttgtctcagttgcaaattgactctcggttgccgagctttatgctatattattatatagttttaaaactattcctttttaactttcttaattttcaattttgttaaaagaatgaatactttagcagcttttcaagccttttttaaaaatctttataagcatgtaattaaatacaaatatgttcatacctgtaacctattaatttagctttcttgtagttttaattcattaaaataaaaaaataaaagtt

SEQ ID NO: 230448 - DNA, 383 bp, Homo sapiens
atgaaatgggcgtagtaaacccccagtgtgctgtgaggacctgggtgcaggcttaatgggcagtaactgggaaaggcctgggagggatattttttttttgagacaaagtctcattctgttgcccaggctgaagtgcagtggcacagtctcagctcactgcaatcttcacctcctgggttcaagcaattctcctgactcaacctcctgagtagctgggattacaagcacctgccaccacgccgggctaatttttgtatttttagtagagacagagtttcaccatgttggccgcactggtcttaaacttgtgacctcaactgatctgcccacctcagcctcccaaagtgctgggattacagacctgagccacggcacccggccgg

SEQ ID NO: 230449 - DNA, 822 bp, Homo sapiens
ccttcaaggttttattctaatgctggagaagcttaataaaaactttgtgataagttacacagctgttaactgacccaaagaaaagtaaagtcaaggttaggaaatactgaaggaagcatacacgtcctatgttgcagagagtgattagaggaaaccccaggatgaggcatgtcaactaagaagagatgacaaaccagaccgcaatgcagtaagacaagacatttattgggcccttaggaattataattcaggagacacagatttggctgtaagccaaattgtgttccaaaccaagtgagggtttttcaaaggaaactaaaggattacacaagttgttttgaaggaattatcatgggtggaggcggccggcttagcacaagtccatagttcatttattgttgctgtttaggagttgcagcgctggtgaaattcagctgtttttcaggatatcatggttgtggtggttaggtgcacttcaaagattcaaggcaaggtactgggttgttttgcaaggttgccagtggtgcaggcagccctgagaatggattctgctttagagccctgaactgtagtgatgccgttttctatgtttcacagataacatttgagcagagacctaactgaagtgaaggggccaagtcatggtatctgggagaggaacattctagccatagagaatgtgaggtatcattcattaagattcaaaaaataattctgtgactctagcgttgcaggaaaaaaaacggggttcttgtcacacgaccaggaaagattaggctcgcagacacgtagaagggtgacaagtggaatttattaggcaga

SEQ ID NO: 230450 - DNA, 600 bp, Homo sapiens
gctttcacccccgaagggacacaatagaccgttatctggctaccacggggtacctcgacagttctgccaccatacacaatctttgcaggcaggatttgaactgcatctgacattctctaggagtacaggtgtaacatcaccctgaagacacccttctttcagcaaattcatttgacacactcaggacattactcacaaagaactcatagaaaaggatggggtttgtgtttccacatggtgggattaaactaaaacaaaaaagtatgggccactgccccaggcatagtacagggatccacaccaatttctggccattgtctggtcagttgagggatgctccatccctgacactgtcaaaaaataattattgaccctctgagtactcacagtgttctaataaacctcccagcatccttcaggcctcttgagttcaaggaaacacatccttcatttgtagattttaggtaagcccatttacgctgttacttgcaaaataagcccactttgaatggggccccttctaacaaaaggttctagaatctgtcaaattgcaatacagcagacattagtgccctcctgagtctcattcactgtggaagc

SEQ ID NO: 230451 - DNA, 262 bp, Homo sapiens
cggatgctcgggaggatttagttagaacacgtgtgcagtacttcagacgggtgttctaataaacctcccagcatccttcaggcctcttgagttcaaggaaacacatccttcatttgtagattttaggtaagcccatttacgctgttacttgcaaaataagcccactttgaatggggccccttctaacaaaaggttctagaatctgtcaaattgcaatacagcagacattagtgccctcctgagtctcattcactgtggaagc

SEQ ID NO: 230452 - DNA, 321 bp, Homo sapiens
acctctaccttcccagaactttcagtaatacttcctttgtcctgctcctacccatgatttccaaggcctgctttaacatggtacccagctccactgttgcaaatagaactaaatcaggcagcagttagagtctattcattgtacaacctttagacaaattctctatcatcatttttaattctagactgaagagttatattttaaaaagattctatcacagcaaccattgttcctacttacaactctttcaccttgtacccttctctagaaccttctccaaatctatgcctttctgaaataaaattgccattattaatctgg

SEQ ID NO: 230453 - DNA, 541 bp, Homo sapiens
tcgcagggtgccaccgccgtttccaggcactttttctgctagacgctcaagacaagagaagggcatgtgaagggccaggaagccggggcaggggccgccgtgagagagcggaggaggagggtgtgaggcgcaaccgggtctgtttcacgctgaaacgctagggccgtgctttccgctaggcagctgcgcagagcaaccgctcctccgctgggcgcgcttcgctgctggggagggacaggcagggatgcctggtgcaagcgatccctcggccccggggcggcccagcctcgccgagctccattagttggcatccgaaacatctggcaggggctcaggctggggccccagggacgaagccagtttggtgagggcccgcgctatgctgtccaggtggccgttcatggtccgcagctccaccaggatgtccccgacgtgggcctccaagctcgccgcagcggcgggccgggctcggggcggcggggatgtacccgcgtccacggtgccctcctccctgcccgcagtgctggggcgcggggcgcgg

SEQ ID NO: 230454 - DNA, 713 bp, Homo sapiens
cacgagggcttcaggtcatctgctatcaccaacactggtgtcttccagcacatcctctgcaatttcgagctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatccccaccatcattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatgggtgagcacgt

SEQ ID NO: 230455 - DNA, 339 bp, Homo sapiens
aagtttggcgcgcactattatggattgagtgtttgttgctccccaaagctcatatgtgaagccctaacactcaaggtaaccctctagactacatgggagtcgagattatcctccagtggagagaggataatggagaaaccctggaatgtggggtattatatgaagagagtgaacatgtagaagaaaactgaaggttcttttcctgtttccaacagtcaatatttcagcctcttgcaaacatatgagtgacgcagccagcataacatgaaacacaaggctcattaagtttacccaaaggaagcacaacaaatactaaaccattgttgttttaagccaaaa

SEQ ID NO: 230456 - DNA, 295 bp, Homo sapiens
ctctcttctctccctaagtgcaagcaccaaggtaaccctctagactacatgggagtcgagattatcctccagtggagagaggataatggagaaaccctggaatgtggggtattatatgaagagagtgaacatgtagaagaaaactgaaggttcttttcctgtttccaacagtcaatatttcagcctcttgcaaacatatgagtgacgcagccagcataacatgaaacacaaggctcattaagtttacccaaaggaagcacaacaaatactaaaccattgttgttttaagccaaaa

SEQ ID NO: 230457 - DNA, 112 bp, Homo sapiens
cggtgtggattcaggtttctgagcttggcaaaaagaaatctcccctcatttccacatcactgtgcctccctgtcttcagtgagcctgggctgccccagggagggggatgttt

SEQ ID NO: 230458 - DNA, 941 bp, Homo sapiens
gaggttggccaagactcagtcatccaaagcctgcctcagtccaggcaggtgcgctcacaccacgggcagttggcactggctgacgttgcagaactctcctggggccgtggactcagagcacctacagttgacttctccacatgggttgggcctctcatggcaagggtaccatgttccaagcagagtttccctaggatgagcagtcaaaagagaagatactaggatttgactccttaagatgtatcctcagaagtcacacgacagcacgtctgcggcatcatcgcagtcacagactccacacagatgcaaggtagttcagacgcacactgcatctttccacgggttagtggcgagttacattacaaaagagtatgtcagatggcagatattcttgcaggaggcttttgaaaatacaatctcctatagaattttaaaattatgaattgtgataattacaaatcatgggcagaatattgagaaagaaaggatataaatccaattaggtaagaaattgtagcttagcaaaatgaaagcattttttaaaaattatcaattataattatcataatgatcaataatggcaggtttctgtgaaatatccaacccccttgtgggtaatattgcagcatgcattgcatactggttgttactgcattctaataacctggaagaccgaaagcatttgggattttttcacagtgaaattatatgttaccataacatgctaaaatccctcttgctaattctgttgataaaattctagtccttgcattgaaattataacttcctatcaaggaaaactcgttttaccaccttcaaaaattcacattttcctgctgaggctttacctgtgtctaatattgttaaagacagctccgtttatcctgtagtgttggtgaatccaatacaaacttttccttgtaattatggggaagatgggc

SEQ ID NO: 230459 - DNA, 462 bp, Homo sapiens
agaatccaaatggcagaaatcagccaggccacaatattataattttaaagattatgctggcacagctctttgataacaaagataattattatgttagctttcacaatttctaattgttttaagtttgtgtaagtttaagcaataattcagaaaccttctcaagtagaatgcccacgtgtttcagtcatcagaagcatcattattagcttcactgtgtgcagaattgccaaatatatgcacgaagatagttgaataaaaacataattccatgtttagaagttatccatttaaaatagccagttccaaacaatgtgtcaacaacacatagtatgggcatgctgaccaccagctgtagtaacatcaggtatttatattgagaacaacgattggtacaaatttcttcccttcctctggttaaggaatcagcaggcatggtttaaaaagaaaagaaaacagtaaaaa

SEQ ID NO: 230460 - DNA, 478 bp, Homo sapiens
cttttatcttccatctcgtgcagtacctatcatgccatttattgatgatacaataattgtctatttctctcttcccaactgtttctcacatcaacttaactataatggcttcagttaaaacctgaatttatatttctttgtatctccagtatctctcgcctaatgtataacatacattagattcacaaaaagtgtttattacttaaattggttgaaaaaattgcaaacaaaaaatctctacttaaatgtcataaaggttttgtaaagtaatagtatagagagaacttctccagctatcaaaatatttagcaccaaattttttgcttatgaacataaaagaatcttttatttccatcaatattaagactatcatctgatcttctgaacatgttcaatattgctggcaaacagaattacctgcattttgtcaatgatgaatgttaagacaattataaatattttaaaatcattcttttat

SEQ ID NO: 230461 - DNA, 387 bp, Homo sapiens
gcctgggtgacagagtgagactctgtctcaaaaaataataataataaataaaaaattagctgggtatggtcatgcatgcctgtggtcccagatatttgggaggctgaggtgggaggatttcttgagcctgggaggttgaggctgcagtgagcggtgatcgtgctactgcactccagcctgggtgagaccctgtctcaagaagttagggagtcctaatacaacatctggatttgttatttatttatatggatagccatgctgtacttgctaagaccacaagaataggctcagagagaggggaaagtttgtgtaaattatacattgaattaggggtaaacaatctagtctgatgactccatattcagagccagggtttcccaattttag

SEQ ID NO: 230462 - DNA, 402 bp, Homo sapiens
ctgaggaaactaatacaggtgtcctaatggaaaggcccatgctctcatagctgcttggcagcctccagggtgagtaagatgtggctggaacgcaagcacgcattgtctgcaagtcctcagctgctgagggaaggctggaccttgtgcttggctgcagggtgtggcctctgacacggaagcacttttccagccctgggtgactcttggagtgagtattatcacagaccatgtctgcacaatttacatccaccaatgaattaacttctatttacaagacttgaagaaatgcaccaaggtcggctgaatgaaaactcaacgtcagtagcattttgtaattgatgatgatgatgatgaattaatttgtgtacaatgactatcaatacctattatcaatatccatta

SEQ ID NO: 230463 - DNA, 360 bp, Homo sapiens
cctcccgggttcatgccattctcctgcctcagcctaccaagtagctgggactacaggcgagtgccaccatgcccggctatttttttgtatttttagtagagatggggtttcgccgtgttagccaggatggtctcgatctcctgacctcgtgatccgcctgtctcggcctcccaaagtgctggaattacaggcgtgagccactgcgcccagccaacattgacattttaaagaaatattttcactcctcttcataacttcatgctcttactgagctagagtcctctgacagactctagcttagaaaaagtaaggtcattttctcttaagtatgtggcgttgactggtgatagctctttgctt

SEQ ID NO: 230464 - DNA, 567 bp, Homo sapiens
gtggcgccgggagcaaaagcagcatgatgcagctcatgcacctggagtccttttatgaaaaaacctcctcctgggcttatcaaggaagatgacactaagccagaagactgcataccagatgtaccaggcaatgaacatgccagggaatttctggctcacacaccaactaaaggactttggatgccactggagaaagaagtcaaagttaagcacttacttttcattggattgcttcataatttcttggtgatggaaaattcattcctaaagcaacaagattaaaggatgcttgggttggcgttgcaaacggtatggtcaccaaatgggcgacaaacaatgccctttctttatcaaaggtaactgaaagagcagttcagagtagcacatgaagatcccatatatggcagcatgtgaggcaataaaagacatgaaaaggatgtaaggatacagcagttaaaacagttattggaggattctatcttggatgaagatgggagcagctccagttcctctgaagtaaagagaaacacaagaaaaagaagaggaaagaaaaggaagaaagaaaag

SEQ ID NO: 230465 - DNA, 397 bp, Homo sapiens
ctagttttcacacacacacacacccacaaaaaggcataatacctgtaagaaggaaagcagtcctctagaattgaagtgtttgaaaaaaagctatgagctcaatgttttggaggaaatcccttctatagcagtggaaagaaggcagctcactttggactttgaatggtaggaccgtatctgctattcagtttttgaaatacagctgtgccatgtgcactgaaccttcacactgggactcagctgccatgcttcaccttgggtataatgatgacagaggttgagaaaggtgactccctccattgatgtatttcgccatgattacctcccaccaaatgatactaatactcctgaaaatacttaacatttataaaatgtttattttctgattcatgccaaa

SEQ ID NO: 230466 - DNA, 232 bp, Homo sapiens
cctaaaatgctggggcctctgggagcaataaagaaggcctcacttgtcaccttcatcttggggagaggtctgaaagctaaaagctgacttctcgggtagtgctgatggagggtggtgtattcggagggaggtctgaccccctcgagtccctaggtcagggcccctttgatggaacacgcttcaggcaggatcaattagtcacacgccagtggaattctaagttaaaataaaa

SEQ ID NO: 230467 - DNA, 386 bp, Homo sapiens
aaattcagtgacctcatcaactatcccctagtactcctacagtaagaaagggcaagtacaaatgtcaaaagagaaacccatccaacaaacagtaacattctcatagcggtactttgtcatttcctgattagaatcaaccaaactatgatgacactgaggttatagtcccaccttattttttaatacttcctctttgctttggatttttattagcttttcaaatcatttaccaatttagatatagccatatggttctaataatgtcactatgccttccaaattttaggatactatcccttccaaggaaataatagttgaagttgcaaatgggtacagatcaaccacaatctcagatttttgtttgttttaacctgagagagaaaagc

SEQ ID NO: 230468 - DNA, 434 bp, Homo sapiens
aatatctacagttccctttgctgtgatttgaaggggaaaaaagctgctagtataatgttccattctaaacatgggtctgacgtttttgtttccaaattatccacacatcatcaatggataaaaagttgtggtgagaggccaggctagcatcccgagcccattgatcaacgctagcaccgtcactaaggtaggacacctggacaccgtgggcctcccggtgcagtcaacaggaagcacacagccccgcctgcctcaaagcagaactggagtctactcaagcctttagggcagctgttttccactggggcacgtccgccccacccagaggacactgggcagtgtctacagacatctgtggctgccacacctgcaggtggggagtgctactggcatctcatgggagagcctggggtgctgctcaacaccctacagca

SEQ ID NO: 230469 - DNA, 223 bp, Homo sapiens
tcctaatttgtatgtatatgtaatattgatctctcccttgcactttcatggctttagttcctgctgctgtcatttcttattggactaatgcagtagttctctggccagtctactcttctccaattttgccgccatttcagttcatcttctacactcagaccaatcagtgatctttcttgaaaaatggttttaatcaaatagaaatgttcagacacacaggata

SEQ ID NO: 230470 - DNA, 183 bp, Homo sapiens
tttgtttcctgtaaatagaattattccttttgacttaacaagaattctgacacactgagggtcctccatacatgtgaagctatcattgtgattattcagtaattgccaagaaaaaggcatacctgatggaggaacccttatgtttgaaagaatagaataaagttttaattccttttttatgca

SEQ ID NO: 230471 - DNA, 1080 bp, Homo sapiens
acatataaatgattctaaggccttctgacctgtctttcaataggatggtattacccaacaattatgacgtctacacatacttttcattttcaatcacattgggacaaatttttatctttatctcatttctgctttctcctgtatgtataagtgctgatattttactgctctctacaaagagtaaagtctattatggtcttacaacttaaatttgattccaagacaaaggttaattggtaaagattatttcccaagcgttaatattgtacatgaatcagaaggtcagatggcatttctggatctgacagctcttatcataatgaaggtttgaaagaaatgtcatcttgcgtactaattaatggttttagccctagtgagagatcttttatttaacgccagtaagttaatcgcagttgatgtctgtgaactgtcaactctcaagctatgcatctatttgaggtcattgctgacaaaacccctattttacaggcaacatcactgaatatacatcacttgccaatgtatcatagacatttgaaaacttatagaattcagcaaatattgttcattttatttactcattttttaatagtaattacaaactatgaatggaaaaagctataatttaatcattggactacatacattcaatttttaaaaaagactctgctaaatagaaaagtgtttgaagtatttatttttccctaagtaaaaaagtaattttgtgagacagtcacaattataatcctgatttctaaaatttattaatttgagatcttcattagaagaattgagacattttttcttctgaaaacaagacacatacacaaatatatatatatatatgaaaaacttccaatatttaagaagtatttcctctgaacattcttagttacaaatgctattttaaattttttctgaagtgagtttatttagacgagattgagcgcattcagggtggtatggctgtagactgaaataagtttatttagaaatctagatcattttatactccaggcttcatgtatatgatatttcttatatttcttatgaaaaataaaatctttttttacaaaaatc

SEQ ID NO: 230472 - DNA, 190 bp, Homo sapiens
gtaataaccagaacaaaatagttctctatgaccacagacaaatcaatttaatacacaaaggtcatataatacatatttaataaattaaataagtatgcaaagaactaaagacattttaggtgatggtaaactgactaactgggggaaagatgttgataacaaaaacagtaatagctgctaacatttattg

SEQ ID NO: 230473 - DNA, 395 bp, Homo sapiens
cagacttgaatgagcctgtaagtgtattctcccccaaggaaatccacataagaccccaggtcagctgacaccttgacttagaccttttgagaccctaagcagagaattctggtgagttacattacactcaaacttctaacccgtagacactgtgagataataaaaggctgttattttaagctgctaagtttgtggaaatttgttaaggctacagttaaaaaataaataaaactttataaagcccctattattaaaatagtccaagaagtaaagctactcttgaaacagatggaaatatagaaagtcttggcaagaaaacagaagatataaagaagtgggaattttagtgaaaaatacaataactgaaataaaatggatgaaagagtgaattcata

SEQ ID NO: 230474 - DNA, 555 bp, Homo sapiens
atttgagaagccctgttgtttaccatcagcctgggaattaacattagctcaatcttgtctggacctgaaatacatatcagtttcgattattgagcatctgtgtacttttgagacccccacgctcaatttgcaaactaattctgactgctaagtttctgagcaattcccctggcctcagtccttgcatggtaacacccctgatgaggctcagaccatatcttgtgtttgcaaggttttttcttttttaactgaatggagttttgcctttgatcccttactctgtgcctgtggacctgctacctgccaaaggcttccctcttgctgacagtcaacctgcctggtattttaagtactgccttctagaagtctccatgtgtctcccatgctgacgatacttggatttctatctattgttactataacctcagatgttgtgctttacttgtcagatccgaccatgacttggaagtatccagaaataggacagcgtgtagaaatacttcccaatcaacagctcaacaaataggactggacttccaggagtcccagggttta

SEQ ID NO: 230475 - DNA, 528 bp, Homo sapiens
agattttgattgacctgtgatataaacttagattggatgccactaaagtttgcttatcacagagggcaagtagcacattatggccttgaagtacttattgttctcttccagcaacttatgatttgctccagtgattttgcttgcacactgactggaatataagaaatgccttctatttttgctattaattccctccttttttgttttgttttgtaacgaagttgtttaacttgaaggtgaatgaagaataggttggttgccccttagttccctgaggagaaatgttaatacttgaacaagtgtgtgtcagacaaattgctgttatgtttatttaattaagtttgatttctaagaaaatctcaaatggtctgcactgatggaagaacagtttctgtaacaaaaaagcttgaaatttttatatgacttataatactgctgtgagttttaaaagtaaagcaaaagtaaactgagttgcttgtccagtgggatggacaggaaagatgtgaaataaaaaccaatgaaaaatga

SEQ ID NO: 230476 - DNA, 511 bp, Homo sapiens
attttttatagagatgcggtctcacatgttgctctggttggccttgaacttctgggatcaagcagtcctcccacctcggcctcctaaatgcagtaacatttgatgacttgagatttgaatactttagcttcgaagggactgtgcttggttcttgggggcaatgccttccaaactgtccatcatgacccagtatgtctttttttagaaaattttcttggatgggcacggtggctcatacctgtaatcccagcactttgggaggcccaggtgggtggatcacctgaagtcataagttcaagaccagcctggcccaacctagtgaaaccctgtatctactaaaaatacgcacacacacacacaaattagctggatgtggtagcacacgccagtagtcccagctactcgggtgggtgagacaggagaattgcttgaacccaggaggcggaggctgcagtgagctgagatcgcaccactgcactccagcctgggcaacagagtgagactctgtgtt

SEQ ID NO: 230477 - DNA, 553 bp, Homo sapiens
gggctttgtgagtgaccagactccacccctgtcctcacccctagagagctctactgaggagcctacctcctgtttgctcattttaataagattgttctctctctcgagcctgagtgatgacaggtagccagctagaactaactacagtgttaactttgccttgaaatcctctgcgagctctgcagctggagacagcttgcgccatgagctcattaagcaacagaagcctgtctccccaccaccaagatgcaggcaagaaaacctgtaacagatccacttttacactgagtcgaaaagatctgtgctcacccaatccccaacaacttgcttggggttgtggtgtgaggggaggggattccatttcccacccccagtattcaattagctgccaattaggcactgaaaggtcccccatccccctgccagccctgacccagaagaggagaggaccgcagagctctcagccaggctcaaaggccttttgattgtgcacctgagtttattctgctcctttcactcagggcctggcttcctttgaaagtgaaatgtttta

SEQ ID NO: 230478 - DNA, 613 bp, Homo sapiens
aatacatgacacaatgtacttgtccaaactcatagaactgtacaacataaaaagtaaactctgatgcaaattatagaccttaattaattaaaaaatagaataaaatcaacaacaaaaacatttttccgaattatagagattactgttgataacatgttcatgtatctctttccaaatgtatatatgtaaatgtatcataattagttttttacatacatgaatgaatttgatatttctccctacactgccaaaaatcaggctttgactaaatacagagtaactttttgcagagatagtatttcttctagctgtaagaaggaaatatccttaatttctctaggaaattcaatatggatcccaagggatgtgtcaaattctaggcattagtggtgttaactggactctaaagatacataactttagcatttttaattatcaatattccttccaatgttcttaggcaacaacaaatttttcattctttcatacattcatgcattcattcatctatctaagaaaaagttacagagctcatataacacgtcagttaatgttttttggcaccaggaacttgtcttagtggagtctgtattcctatggagaaaaaaaaaaa

SEQ ID NO: 230479 - DNA, 442 bp, Homo sapiens
ggagctcgggcggctccaggcacttcttcccttgagtgggtggactactgaggtcccctgggcacggcgtcatggtgcggaacgtggatgacctggatttccacctgccctcgcatgcccaggacatgctggatggcctgcagcgcctgcgctctcagcccaagctggccgacgtcacactgctggtgggcggccgggagctgccatgccaccgcggcctcctggcgctcagcagcccctacttccatgccatgtttgcgggtgacttcgccgagagcttctctgcgcgcgtggagctgcgggacgtggagcccgccgtggtgggacaactggtggacttcgtgtacacaggccggctgaccatcacgcagggcaacgtggaggcgctgacacgcacggctgcgcgcctgcacttcccctcggtgcagaaggtctgcggccg

SEQ ID NO: 230480 - DNA, 564 bp, Homo sapiens
tgcggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtct

SEQ ID NO: 230481 - DNA, 449 bp, Homo sapiens
tcattcttcatttatttctgtctaggtcccaggttttcttgcattaggattagtttccctttttttctttcttcttctctcttcagtttccttgttttctgttggtctaaatttcccccacagtatttcactaagttattcgctccacctcctctctctttcttgatttgtgctcccccactctcttctgccctttctccttctcatcccttctctacttcttcctttcgccccttcatcttctcactcttttcttcacccttccttgtcacctttctcttcctccctcttttctcagttccctctccccccttctctgttccccctctccttccttttccccctcattctagcgtaggctttcccgagcattcctgtaattggagccctgaaggctatggcttttaatgtcttgccatgatatccgactgacatgttctttttcatat

SEQ ID NO: 230482 - DNA, 344 bp, Homo sapiens
catgggggctgatttgtgctgctgctgcagatgacaaggatgattctctccaactccctattgggaaatatgggaaatagcctcgtacttcatttgtgaactgtatgccagaaatatgttaacatttcaaaatagtttttaaaaatgtaaaataattgagaaattccatgtttctatcatgctaatgatggtgctttattttgtcattaactttttacctaactgtaatgcaccacaagtctgtttctgaagattatagagggtagaaatggaagtgcaactttatttagaaagagttattttcccttaaagctaactttttcttataagagcaggccaattac

SEQ ID NO: 230483 - DNA, 533 bp, Homo sapiens
caaaatagataagtatagaatttaataattatattatttaatgattcatgagattacatgtatgccatagagtgttgtccatagggagatgggttataattttgaacagagtggaagccctaaaagtgatatttgtgcatgagccaaggcttggcaccatgtagcttcaggataacagctccgccattatgcacacacagacatttccatatatcactgtacctcgtctcttaagcagaaacaagaatgcagggagatgtatgtatgagagagatggagtaagggaaagaagtaagaggtacagtccaatggcttgccatagacgcttttgacgtgcatagcagggagttgatgccgtggataatatgccacgtaaatcacgtctccacttagcatgtggcacaaagcagatctgtgagaacaacagtgatagaagccggtaactctgttgattactaattttgtctaccctaagcaaccaccccttattgaggacaacaatgaaaaataaacacatcttatttctgcatgaa

SEQ ID NO: 230484 - DNA, 403 bp, Homo sapiens
aagactacaggtttctccatggagcagcacagagggtgaacaaagaccaagaaaagctgttcaatacacaagaaaataacacacacactgtttccacggtatctcacggcagacataacttcctaagcccacccacatctgcacaggaacaaaattggagctgaagaagcaaaagagtaagctgcacccttcttatttctggtctctagagctgggattcttgactaacgatggaaggggaagcagtgagatatgaaatggatatgagattaaagtttccagcaggactgaattttaataactgaaaggactggaaagtgatgcagtctactcaagatattaagatatggaaaatagagatttaacagagcataattaaaagcagagtttggagaaaattaaa

SEQ ID NO: 230485 - DNA, 489 bp, Homo sapiens
atgtattcttcttcaggtgatcaagatatcaaaagcagaaactataaaataaaagcccatttgtttgatggcaatagagtcaagcaatcctagcaggcaaaaacccactacaaaaaaattaaatgacgaatgataaaccaagggaagcattttcaacacacgtgttgatcagttaatagtctttgtaatatacatgataaattgttaatctcatcactatacctaattcattatttacgttaccttgggcaagttactcaatccccctgcgccttggcagactcatttgtaaaatagacagtaatagcacttacctcacaggatgggattaaacataaaacacctaaatcagggcctggtgggtcatgctcaatacacattaaatgttagctgttgctgttactcctatcatcaaagaccaataataaaaggtaagcataatagaaaaatggacaaatgatataaatagttaataaacaaaagaagaaa

SEQ ID NO: 230486 - DNA, 351 bp, Homo sapiens
ctgactcaaaccagttcaaattcttcgtcacaagagtcaggtaagtcattttacctctcttgagtcctctctatgatcacctttaaaatgatggctcccaaggctttgttcaactttgaccacatgaagactgaaggtctttgactatgaaacaagggcaaaaatgactactgtgggattgttcccagccttcctcattacccagccctccaaagggagcactgcaactgccagcacagatttcatctctcctctttccaccccacttcgaaagaggaagaattcctccctgctggagaaagtctgtcaacctacatagtaaagattaaaatcaacatttttgattccaca

SEQ ID NO: 230487 - DNA, 383 bp, Homo sapiens
aactggttaactattctacttagtcattcaccagaattagacaattctatatactaacatggaagatatttaggacacattgctatttttattttttttaaataaggaagcagcccaggcacagttggcctgtaatgccagcagtttgggaggccaagtcaggcagattgctaagcccaggagtttgaggacagcctgggcgatatggtggaacccagtctctacaaaaaatacaaaaattatccaggcttggtggtgtgcacctgtagtcctagctacttaggaggtggaggtgggaggatcctttgaaccccgggaggttgcagtgagcctagattgtgccactgcactccagcctgggcaacagagtgagattatgtctg

SEQ ID NO: 230488 - DNA, 461 bp, Homo sapiens
  misc_feature (4)..(4): n is a, c, g, or t
  misc_feature (40)..(40): n is a, c, g, or t
tttnttcattattctccaacagatttctatttgagacaanattcgctgccccaactcaatagcttgttattccttcctaagggacttctgtgtgctactccagtgtccgaataattcagtctatcaacttccaccaatgcaagtcccttctaacttcaaaaccctgaagaaatcatttttccaggaaggctttcctaagagctttttgtttgtttgttttgtttttttgagatggagtctcactctgtcacccaggctggagtgcaatggtgtgatctcggctcactgccacctccgcctcctgggttcaagtgattctcctgcctcagataataataataataataacaataaatacaaatacaaaacccaactatatgctgtctaccagaaaactactttaaatatagaatataatacctagggacagtatagaatagaatagaatagaatgaaaataa

SEQ ID NO: 230489 - DNA, 369 bp, Homo sapiens
ctgtgctctgtcactggcaagaacaggaaaaacacttggggcaagcaagccagccccactttcacacatgactcacacgactgaaggaaagaaagggcatccttctcaggctgtcactgccttcttttattacaattcttactttttataatattttaaataatattaaaggagatgtaagatttgtaagtttatcaaagagacatgagtttttaaatgttgagaaacacatttttctaaagatgcaaatcagccaggcgcagtggttcacacctgtaaccatagtactttgggaggctgaggtgagagggctgcttgagcccaggagttcaagaccagcctgagtaacacagggagactctgtcacta

SEQ ID NO: 230490 - DNA, 809 bp, Homo sapiens
gtccaaaacgagattctcctgagatctcagatgggcattggtcaataatagttacccatttctatttcatgagagttccttatgtggtttggattaaaatttgtttagtgacacactggcaatgagaaaaaaagtcaagagtcactttgaaatgtccaaaattaaagtacaatttcttcaggaaggttcagaaaggctgacattttaataaaatatcctatctgggcaatgtgaaatgagataacataaggaagagcctagcacactgctccctgggcatgcaaaatctagagtctttgttcttctgtgtattattaactcttttaacaaactacaagtatccagaagagaggtcatccttaaaactagcaatttctagattctaaaagatatccctgaaattacagattttcagagttctgtttccaagggagtttatgctttatgcttcaatttaatccctattttctatgatgaaaatattttatacttctctataaaacccagaatattaaaactaaaaccttacaatgaatctctgttgagaagtcaaaacaagtaagaattattaactgcatgtgagggaattacattatctgggagagatcattttatgtcagaattacaaggtcagtgaagtgttaagttctttcaaaatatttttacattctttatgctttctaagcctactgcttaagagagcttagaagcatacctttgataacaaacaagacattcataattttaaaaaaaaagactagttccatgtttcttatcctgcttcaaaaaaaaggaaaagagaagagaga

SEQ ID NO: 230491 - DNA, 975 bp, Homo sapiens
cctcagcctcccgaagtgctgggattacagacgtgagccatcaggcccagcctataatggaattcttattatcagattagcctttctgccttaaacaaccatgaaactgccctaatccccaagatcactgatgagatgtttcccacaatttctctgtctctctgctggcgacagctttccaattgcagcatagcaagctggaattctggcagagtagggatgccctgctgtgttgagaagagatcagagtgaagggctgccgaaaccgctgcagtccataagtcgtggccctggagagaatggagctgcttatgtgggaggcagagatccacaccatggctttctcatgagttcttagctgaaaactgggctgtacatgtgtagggaagactacctgagggttaccagagagaggctgctacccagttgagagcaaagcagataatagaggtcaggcagataacagaatccagagcctctacaatgtatcatccagtgtccttgacacaatctacaattcctaaacatacaaggaaacagaaaaatatgacccatagcaaaaacaacaatcaatagaagctgaccacaaggtggtccagatgctggacttagcaaagactttaaggaaattattatatgttcaaaattctaaaggaaagtgtgtttaaagaattaaaggaaaatatgtttaaataattaggccaggcgcggtggctcaagcctctaatcccagcactttgggaggctgaggtgggtggatcacctgaggtcaggagttcgagaccagcctgaccaacatggtgaaaccccatctctactaaaaatacaaaaaattagccaggcttgttggtgcgtgcttgtaatcccagctactcgggaggctgaggcaggagaatctcttgaacctgggaggcggaggttgcagtgagccgagatcgcgccagtgtactccaacttgggcaacaagagtgaaat

SEQ ID NO: 230492 - DNA, 457 bp, Homo sapiens
ggtcactcagcccgaggagaaactggacctcccaactccccacctacctgcccttctcgctaggtcattcagctatttgtctcctagttcaccctcatacacctgtttgccacgatggttttgcctttaggcttttgcacacgctattccccacctggaagactcttggtctcttttccagatcaacttctatttgtcattttttcctcaatattggcatcacttttaggagcctttccgatcttccaagaaaggtttaactgcccctttgacgtatatcccctattaatgtacttaacacattgcattgtaatcccgtctactcatctggttcccccaccagattgtaaaccctgggcagggtctgggttctgttcactgttttatccccacttctggctcagcacataatagctcctctgtaaatatcagctctatattgttccgaactcaacaa

SEQ ID NO: 230493 - DNA, 300 bp, Homo sapiens
ctaatatagaatttatttttttaaaaaaattattgagtgaagtttcacttcactgcccaaggatttccagaatatacccttccaaaatggctaatgagacttttccagacattctcgtactttaactagaaatgtttttcaatgcagggtttccaaatgtgcctatgcaaaatactttttgactacacataggtactggtaaaaggaaagatttttgttcacttaaactatttcgaacacatacaaatatgtaattattttccaaaataaaacaaccaaaagtcagtttcagacagtagg

SEQ ID NO: 230494 - DNA, 443 bp, Homo sapiens
ctgcaccatgtcctgggaatagctgctaccacttctggggcacaattctctctagtcctcacaatgatctcagaggtgacattattaatcccttttcaaggtgaagaacattcagctcagagaggttgagtggttcccccttgactcccagccagtaagtggcagggcctcagatggaaacctcacctgccctctccaaagccccagccctttctcaaacaccacactgtgtccctgggtccagagtcagcagctgctcagccgtgtgcaagcagcctaagcccagacctctttccccatcgacccttccccagccatagccattcactcggtcattcctttacaactagttactgcacccctgtgggccaggcgtgctggagacaccgcacgtaagacagatacagtcccggccctcacagagctgaggagtttgtctaaaa

SEQ ID NO: 230495 - DNA, 508 bp, Homo sapiens
aggtgggctggggctgctcccccaaccctactttgcttctaccacttggccattttcctctcctcagatggggcaccaataacaaggagctcacccttcccactcccagccctcctgctcctgccacccccccaggttctggttccatttttcctttgttcacaaactacctctggacagttgttttgtttttggttcaatgttccattctttgacatctgtcattgctgctgctagcagcgccaaatgttcatccacattgcctcctgttctgcccatgatcccctcccccaggttactcttcgtggagaagaggggctggggcatggcaggctgggtgactgactactcccctaggatgctgcagcagagagagcaagggggcccaaatccaccataaagcatgtaggggccacctgctcccccgggtctgtcagggaggggtagccatgatttgtcccagcctggggctccccctctggtttcctatttgcaattacttgaatta

SEQ ID NO: 230496 - DNA, 465 bp, Homo sapiens
cacacacacacacatacagaataaaagacttgagatgatatacaccaaaattatgtctctgagggctggaattaacaatttttctttaaaaatcttattcgtatttcctatttctatactataaatatatactgtttgattatagaaagaacaatataatttttttcaattaaaagaaagcatgacatttctttgtataggcacaccatacttatttgaccattattttactcttaaggtggttccctgttttttgataatgtgaacagtgctgactcaggcattctcacatacagatcattaatttctagtaccattatttcggttactattttggaagattaataagttctcaaaaatgagattgctatgtctatttgcgctatgtctatttgcatctgtgcagtttgactgcaccacaaagtacacttttaaagtgtacaatttaatacaattttatctgtc

SEQ ID NO: 230497 - DNA, 388 bp, Homo sapiens
cggggtccctcttctgggaagcatgggctgggacaaggcaggcgccggttttctgcatcccaaatgtcctggggcatgtgtcccttccttgctgaccgtgggtccgggccagagcgcaaggtccaaagccggcggcttggctccaccgccaggggcaaataccagggcgggatgcgtgctgcggggcgcccgggggctcccccttgggacttctagggtccaggggtccccgcgggcgcgccccaagccttctccctcagctccgggggcccgggcgcgcgcccatcccccagccccgcgtccctgcgcgagggccgggctgggggtggggtcgccgcgagctcggcccccagagttcccgcgctcaggcccaggaagcggcggccgc

SEQ ID NO: 230498 - DNA, 501 bp, Homo sapiens
agacctaaatttaggcctcactgactcctaccttgggcatgtaagcaccagttggatcagatacaccagggaaactgaggcccagaaagggatgtgatctgcccgattgtgcagaattcagagcccagctggaacctgaatgtcctgaccccccatccagtgccccccttcctactctatgctgcctctcgggtgacacacacagcagcaagtgagccctgcagacagagacattctagaacccaggcctgggaccagtgctcaggagccatactctcagctagattgccttcagcctgccaggaggaggagcagcccagtccagactgaaagcctccaaggaggaagttctaccggcttctccatgcctccaaacccactgtaccttgtgcattccatctggaattttcttctgttgaaaggaaggtgctgggtgggaggaggagggagaggatcaggaaaaataactaataaatactaggcttaatatctgaaaaaagt

SEQ ID NO: 230499 - DNA, 415 bp, Homo sapiens
gacatagagtctattttatctgatgttaatatacctatttcgacttgtttttgtttctgtttacatgggatattttcttctatcccttcattttcagtctatatgtgtcttattaggtgaagtcagtttcttgtaagcagcatatagttaggatattttttaaaaattcactcagccagtctatgtctttcaagtggagaatttaatcaattttcaatcaagattattattcatatgtgagaaattacttcattttgttatttgtttttgtttgttttacatatactttgtttctttttctctcactttttattattgtggtttagtatttttctataatagtaaaatttaaatcatttcaagtcttcatttgtctgctgtactagggagtattttaaattttttgtgttttcat

SEQ ID NO: 230500 - DNA, 270 bp, Homo sapiens
gccagatcaacaaggctgctaagggcaacccagatgtgtagtcaacctgtttaagagatgttccaataattagcccctcccactctccaatccttgctgagagccgttcttccatcagctttctttcaattcctataatacactaagccttttcctatcacagagcttccgcacatactcatctgtctctttaaaaagctttgtcctcaaatccttgcctagctaacacttagtcatgtttctagttatgctataaatgtcactcttcaa

SEQ ID NO: 230501 - DNA, 488 bp, Homo sapiens
tggcttcctgccctgagtagcctggaggagccttcagcaggatccggctttccatgcccccggatgggactcacctggctgtagcacagctgcactgcagagccaggttcagcttacagctgcattgtcccctcgccctgcccagccttcctggccttcttgtggggctgggctgagcagcccaaggaggtctcctgttacaggtcagggagctaaatccttgtttgcaaaacacagcctgagcttcattcacttccttctggccctgcccctaggaatgtaggctcagggagcactccccaggcgacctgtggttacggagtggtcagctgggggagaggaggtggagggtgtctgaccctgggctgggaggcaggtgcatttcggtgtcagatggggcttctgccctgacggcatctcctgtgccggtggtgggacgcctagacacttcccaaagaagaggcccctatgaacccagagttgcaaat

SEQ ID NO: 230502 - DNA, 294 bp, Homo sapiens
gatcatgtcatatgtattctacagtcagaaaattgttgaaaattgctaatctaaggaggtctaaaaggagaataccatctgtttcttgtattcatactttcccatgcctctttaagggtatgaccaggttgtaatgaccctttcaagggcaaaatatatgtgtcattcaaaaggaacaataccaagatttgatatgtgaacaagcacatgaattaagcaccaggaatgatcctcccttcaacatcagtccctttgttggcttccttgttaatgagggagcctctaactcaccac

SEQ ID NO: 230503 - DNA, 706 bp, Homo sapiens
cttagtattctggggaatggtccagattccccaaaagggaatgagctctgttgcaggaggctcactgtttataaagttaataatactctttcctttttgttttttagcttttattttttcccctggaaaatataaaatatgggtttaaaagaaacatcaaccttgagcccattttttggggttctctatggaaaggaagaggagagattatggttcttgatatggccaggtacactaagaaaacttttttttttcattctttaaaaatctaagtaaatattaacactagaactcatcatttgcatatttatttgttattaaagccccagaaaatgtatcttactgacttatgatgatgatgtatttgatgaatatgagtcaaaaattttgctaagccttatctcctcttctgctctaagaaaagagattgttgaaagacctgtgctggaagtagttgaaagcatatttttattgcaattaaattctcagtttttataaacaagggataatgttcaaacacagtggacagtgcattatggactatttttttaagtctcagtatgatattcttttctttcagaacaggaatgtttcacttacccgtagacgtttctgagttggccatatttatttctaaaacacaaagggaccctgcagtagacttatgcagatggcagactattttctttttttttttttaatttaa

SEQ ID NO: 230504 - DNA, 652 bp, Homo sapiens
cttagtattctggggaatggtccagattccccaaaagggaatgagctctgttgcaggaggctcactgtttataaagttaataatactctttcctttttgttttttagcttttattttttcccctggaaaatataaaatatgggtttaaaagaaacatcaaccttgagcccattttttggggttctctatggaaaggaagaggagagattatggttcttgatatggccaggtacactaagaaaacttttttttttcattctttaaaaatctaagtaaatattaacactagaactcatcatttgcatatttatttgttattaaagccccagaaaatgtatcttactgacttatgatgatgatgtatttgatgaatatgagtcaaaaattttgctaagccttatctcctcttctgctctaagaaaagagattgttgaaagacctgtgctggaagtaaatgttcaaacacagtggacagtgcattatggactatttttttaagtctcagtatgatattcttttctttcagaacaggaatgtttcacttacccgtagacgtttctgagttggccatatttatttctaaaacacaaagggaccctgcagtagacttatgcagatggcagactattttctttttttttttttaatttaa

SEQ ID NO: 230505 - DNA, 407 bp, Homo sapiens
aaagccgcccactggcgctgattcacactgaagtgtgacatgggccggtgatgcaatgtgtagaattgtttccacaaccgcctgaaggcagggcccacagcctcctccttgccgaagcaagcctctgggttcaggctctgtaacttccaaggccatgagagtggtcaggccctgcttggtttcccggcccccgatcacagatcatgctggaactgctggccccaacgccctgaggtgactggccctttcttcatggattccggtcacatctggtccatctttgtcagctggcctctgggaagaatgtgggctcggccacctggagcagttgcctggggagatcagaggagccctgaggggttggcagagcgccctcgtggtatccatacccccatccctgtagctga

SEQ ID NO: 230506 - DNA, 450 bp, Homo sapiens
ggttaggcgtgatttgttccgttcctctatggcctagctggtctttaacccccgccttcgattctgagtcagacagactccccagtccggcagcactccttggacagggcagcaagtgacagcagtgggtatacagccggagtcgtttcgtgcaaaaatcaaaaagaggccgggcacggtggctcacgcctgtaatcccagtgctttgggaggccgaggcaggcggatcacttgaggttagtagttcgagaccaggctgggtaacatggtgaaaccccgcctctactaaaaatacaaaaattagccgggcgtggtggtgcgcgcctgtaatcccagcttctcgggaggctatggcaggagaaccgcttgagcctgggaggcagaggttgtagtgagccgagatctcgccactgtactccagcctgggcaacagagcgagactccgtctca

SEQ ID NO: 230507 - DNA, 489 bp, Homo sapiens
ctggtaccagatcaccagattgctgagcaactgatgctaattttataattcaatttactaatgaggtaatgtgacaaatgtttaaaagctagtcatctgtagctagaaccaagtcatccaaggaagttcgtacctgctgtgtatttggatacaaatctctttgttcttgaccaaaatgaatctgttcaatttccttaagtaaataaagctctttagaccaacacaaggtgaaagaagaggtgaaaatgaacttccattcttttgcaaagaatcaaaatactaaataagcagaaaaaactaatgaaaagcttctgaatcaacttatggagagttaaaataattctgattaatcttaacttaaaattataagtacgctaattaattttgtatatttaacactgttttaaaactttgtcagtttaaaactttcgttttataatgaaattctatttattctatttaaattaaacttaaatatttaaacttaaa

SEQ ID NO: 230508 - DNA, 302 bp, Homo sapiens
atcaaatactttaatggagacccagaatcccagtccctcttatacaaacatcattgcatagcctccctctaaccaagagacagatagagccattcctgtgccctgcacctggcaggaaagccctgctggagcctgtggggagctggcgaggatgagccttggtgattctgccccagagcagggattctcagggagctccggacaccttccagggactgagatggagagtggccatactccgtcttggaaaggagaatactgagggcctctgaccctcagtattctgacccttctgacctctc

SEQ ID NO: 230509 - DNA, 829 bp, Homo sapiens
ggttacatgggagatactcagggaaaaatgagtaaatctccaacaggtggctttcaattcaagcataaatactatcttcaacttaaagaaagaagatttgaggtgcagtagtggggagttaaccagcaaaagcacattagacaagagtaaggtacgttatacagacttaagtccatgcattctccattgataagactcttcagtgatttagttatccttctcttcttggtgtcgagagaggtagcttttaaatggtgatttcctttatagatgtaaattttccttacacaagtaacttctactctgttttcacaacttcctttgttagcattttttttttcaaaataattagcttggaataatttttaagccaaagggacatattttggggttgcatattctggtttcctaccattatattttggggtggcatagtttggtcttatacactgtgttctactggcaatgaaaagagttcttgtttttcctccagcaatttgtcatttgttaaagagcttagcagttctaagagatatagaccagctgtgctatctttttgtggttttcagttctctagtatgttgagcatctttttgtaagtgtacttgccatctgtagatcttctttggtgaggtgtctgttcagatctgtgtgcatttttaattgggctgtttaacttattgtttagttttaacaattttttatatattttgaatacaaattctcagatctgtattttgcaaatattttcttcaatatgtggcttgtctttttgttctcttaacaaggtctcttccagagtataaactgtaaatattaaaaaaaaaca

SEQ ID NO: 230510 - DNA, 297 bp, Homo sapiens
ataatttaatttaattctggtgtaggaggattttgagggaatggaactgacattcactgagtgctttccgttgattaggccctgtgctgtgtgcactttatgtagtttatctcatgaaatctttaccatagccatgtgaggtagaaggtgggatttgacccatttcacagagaggaggcaggctctggaacgaacttagcgtaaggtcatagaataaaatagtagagctacaactttaagacagttggttctgaagcccgtgcttgatacaagtcacatgacctgtatcatatttat

SEQ ID NO: 230511 - DNA, 578 bp, Homo sapiens
agctcatttaatttcaaatgtagggatgattttattttaagtggctttcatttacaaaataacaatgttttacacaactgagccattttcctcattcagttctctcttgttattgcttatgcagaaatatttgatcaaatttacttattttattgtattataaaatattatgtaccaaaactcaaagattcaaatagataatttagttgtaaccctatttttttttcctttaccctttaggaaatttaaacatgtttttatcggacacaaaacccaacatgttaacgtttcaattccacttatgaaatgccattatttcataagctgcctattcaccctccacttctttcatgcaaattcttcttcctttctctcaaaaacgttatttcctttgcacagtctgtcattttcgcaggccaacccctagccacgtgcagtatttattctgaccattagatgtcaccaatctctttgtaagagcagctgtagatagacttgattcccggagaaacggactgataaatacataatttattaaatctaaaagtcaacaatatctgtgaagaatcatttagatg

SEQ ID NO: 230512 - DNA, 446 bp, Homo sapiens
cacagagaagaggcaccgaactccacctgaggagtcagcgaaggaggggacatcttagttaggacctgaagaacaggagttcttagccaggcacagggaaggcaaagataacagcaagtttcagaggcaagagagaggacaggacctttgaaaaacaggcatttggccgggcgtggtggctcacgcctgtaatcccagcactttgggaggccgaggctggtggatcacctgaggtcaggagttcgagaccagcctggccaacatggtgaaaccccgtctctactaaaaatacaaaattagccgcgcatggtggtgtgcgcctgtaatcccagctactctggagcctaaggcaggagaatcccttagaacccgggaggcagaggttgcagtgagctgagatcgtgccactgcactccagcttggacaacagagcgaggctctgtctt

SEQ ID NO: 230513 - DNA, 461 bp, Homo sapiens
cagaggttgcagtgagccaagatccgccactgggctacagagggagattccatctcaaaacaaacaaacaaacaaaaaaacacctaacaggatattttctccagaggaggcaaggttgacttaagttctgaaagatgtgtaggactatatcaagtggacaagaagagcatatgaatgcagaagccaagtcagtaattctcaacctaatccttatagaatgtcctggaaacttgagaaatgtactaagggctgagtcctacctcagaccaattaaaacagcatttatggggatgtgtcatgggtatcagtgtttttaaaagtcctccagtgaatctaatgtgcagccactgttgaaaacactgcacccagctattcttatttttattgacaaaagtgtttaggaatatgaatgttcctttgaccactgcttaaaatgcgtcttgtattatccaaaaaagcca

SEQ ID NO: 230514 - DNA, 780 bp, Homo sapiens
  misc_feature (25)..(26): n is a, c, g, or t
ccaggaaagaaagctaggtcgaggnngggtgttgatgaaagttggagaacaggattaagactgggtgggaactaagaatgacaggtacttttaacaatacagctgggatgctgttgatgacatgaatgaaccccactcttactgtagtcatttgctcaagattcaaagtcatgaaaaagagtagaatggaccaaacttaggtactaagagtccccagcctggcagtgaaaacagtatagttcctttgactttaatatggggaaacaggttcctggattgacgatctcaccaaaactatacacaatttttttttattttttctcagacctttcagggatgaatatatacaatttctgagaaagaaacctgagtacctttaggaagggaaaaggaatgctgaatatccccaaataacatgtcttacatgtttggtaagacttactgtaccctgtcctagaagatagaagatgccctgcccttagaagacaaagagactgtagagctatgccttctaaatcttaagccactcttcagataatggatcccttcatggtcagcccaaacatctcaagaacttttaatttgtaccgtttgtctttttttccatttatttaataccacaaattcactttattattatgaagccaatatctacatcttctcacaaagattctcttaagaaatgcagaactggccgggtgcagtggctcattcctgtaatcccagcactttgggaggccgagggtgtacccgaggcgggtagaacgcggaaatgggaac

SEQ ID NO: 230515 - DNA, 726 bp, Homo sapiens
  misc_feature (25)..(26): n is a, c, g, or t
ccaggaaagaaagctaggtcgaggnngggtgttgatgaaagttggagaacaggattaagactgggtgggaactaagaatgacaggtacttttaacaatacagctgggatgctgttgatgacatgaatgaaccccactcttactgtagtcatttgctcaagattcaaagtcatgaaaaagagtagaatggaccaaacttaggtactaagagtccccagcctggcagtgaaaacagtatagttcctttgactttaatatggggaaacaggttcctggattgacgatctcaccaaaactatacacaatttttttttattttttctcagacctttcagggatgaatatatacaatttctgagaaagaaacctgagtacctttaggaagggaaaaggaatgctgaatatccccaaataacatgtcttacatgtttggtaagacttactgtaccctgtcctagaagatagaagatgccctgcccttagaagacaaagagactgtagagctatgccttctaaatcttaagccactcttcagataatggatcccttcatggtcagcccaaacatctcaagaacttttaatttgtaccgtttgtctttttttccatttatttaataccacaaattcactttattattatgaagccaatatctacatcttctcacaaagattctcttaagaaatgcagatattggcttcataataataaagtgaatttgtggtatt

SEQ ID NO: 230516 - DNA, 368 bp, Homo sapiens
atctcaagaacttttaatttgtaccgtttgtctttttttccatttatttaataccacaaattcactttattattatgaagccaatatctacatcttctcacaaagattctcttaagaaatgcagaactggccgggtgcagtggctcattcctgtaatcccagcactttgggaggccgaggcgggtggatcacctgaggtcgggagttcaagaccagcctgacaaacatggagaaaccctgtctctactaaaaatacaaaatcagctaggcgtggtggcacatgcctgtaatcccagctactagggaggctgaggcagaagaatcccttgaacctgggaggcggaggttgcggtgagccgagatcgcac

SEQ ID NO: 230517 - DNA, 501 bp, Homo sapiens
ccccaccctcccatcccctccctagcccctgctccatccaccggtcctcctcgggctggcctcacctggggcagctctctgaggcctgcagggtgctgggggtgctggcagtttctgcgtcctgctcatgttggagccactgtgtgcaagggccaggcacgggcaggggctgtgtaccctgagctgcacagcctacacggcacctccatgtctctgaagcaccttctgcccatggaggtgacgccagcctgtggacttgccctcctgagactgtttgcagcaaaagccccggtccctcctgccagatcagctgcccacagaccctgcccgagcccatagtttgacctcagtgtctctcacacgtgcctgcaccccagtctgcagccacagtcatcccatacatgcgccccaacctcccgtgtctcccacaccctgtcccggccacggcctcagccagtgtccctctgcctggaaccgctgccccccagccccgtctccctc

SEQ ID NO: 230518 - DNA, 184 bp, Homo sapiens
agttcagtggttttatgctgtaacagctttttcctcctcctttacgttgtcaagccactttctcatggtttcatcttttccttcttgctttgtttctggagcacacgttttttacttttttttgattgccttctatttggttttctttaaggtggtgcatttaaaaagcagccccctcttcttc

SEQ ID NO: 230519 - DNA, 522 bp, Homo sapiens
cagttgacctaagctgaatttgtgtgcccaacttcttgttgtgccctgaagttcaaagagaaaaatgaatgataaacattatcattcaatgggcaaatgaagatatttctcatgctcaaatttgtaattaattatgaaaatacattgaaagtcataatgatacttctctctacatgcttttatctaggtatacaatagccatatgatgtttttaattccccatagatgatgaaagaagttatgcatccccaaataaaggataaacatctcttacaaggtacttacagggaagtgctgctctctatggagtggttgctttgcttgtttataaaacactctttttagattcttcaacactagtgtttgttggcatttagtgtgaatgatttaaaatttttacagtctcagtctttcctacatttggagaatgtagtcaatgaatatttcctgtataatgtgtactacccattgcttatctgggaaaggcaactagtaataaagtaattaactcctcaaaaaaaa

SEQ ID NO: 230520 - DNA, 467 bp, Homo sapiens
tcttacatttaggagatcaatcaagcttccatttctttgagcgaaatgaacactgcttgcacacaaataatggaagaaaaatcctggtattcccaaaacagccaccccaagcaacccaagagcctaacagcggggaggtcaggaaaatccaagaagttggcatagcagcccaaaggcagcaccgtgcagctctgaccaggccccaaaggcagcaccgtgcagctctgaccaggccccaaaggcagcacggtgcagctctgaccaggccccaaaggcagcaccgtgcagctctgaccaggccccaaaggcagcaccgtgcagctctgaccaggccccaaaggcagcaccgtgcagctctgaccaggccccaaaggcagcaccgtgcagctctgaccaggccccaaaggcagcaccgtgcagctctgaccaggccccaaaggcagcaccgtgcagctctgaccaggccc

SEQ ID NO: 230521 - DNA, 360 bp, Homo sapiens
cactgcttccttccctccatcctcttaatacctctcacccatttcagcttctaattacagtcaaaagaaacacagagcatattaagggataggggttctgtattattgagcagcaggcattattactgaagctgaggtctcttttcaacaaagatggctagattctccgtctaggctgtaaaagttgaattaatcattactgtgattgatatgttatatacatgtttgtaatcaaaacaagcaaacaggctgggtataatggctcacacctgtaatcacagtactttgggaggctaaggtgggaagatcgcttgagctcagaagttggagaccagcctggcctcccgtttcggcctccca

SEQ ID NO: 230522 - DNA, 392 bp, Homo sapiens
gatgaggaaaagtaattcccttttctgcaactaactgctcatgagacctcctgtgacagctgtgagcttcaaaggccagtcttccgaccccatgattattcccactatacagaatggcacagtgttatcatttgatgctttggtgaaaattctaaacttctaatcagaaagcatgatttgagcttggcactacccaacaaaagttggagaatcactcaggaaggttaacattcagagggaagcaggtgatgcttacaaactctgaagcaccacatagtctgttcaaaggcttcatatcactgatataaagcagtgggtaggatggcatctgcccatttttaaatacagatgcttaaggtttctcttaggacatgggtatcagggcttactta

SEQ ID NO: 230523 - DNA, 443 bp, Homo sapiens
agtggtggttgtagctgaactattctccagtgacccaccgtgttgaaggtgtgctgtagaaaaaaaaggctatagtaacactgaaaatgtctctgacactcaaactgtaagcacctctattacgggatattctgaggagaatgaggccacctcacacttcaaagatgattgtcaaccatttattaaactgtgaaaattgagaaattaaactttagcagagaaaaaagccacccagtgccccaaggaagactgtgaaacctcaacatcagtggtggagtctctaagacatttgaagtgatggaaaaagaactaaattcttttaagtctaaaaagctaaatgtttattttgctgtttaatttatagtcacatactggtaagtttccgggacatttagggtgcatttgtaatttttttaactataaaaatatgagtggaaaattac

SEQ ID NO: 230524 - DNA, 467 bp, Homo sapiens
agcaatagtagagttcaatgaggaggccagtcataaactggtcttgaaaggatacaaggatctggatatatgaaggataggataaataaaatatataatccaagaagtggaaatgtgcatggacagtataaagtgcagtaaaaaaaacaaaactgagagcaatgaaaaataaggctgccaagggcttgcttccaaagagccttgtaaactgttgtgagtgggcagggaggagctgctgatcagattgggtgagatgccttgatctgtactggaccatttttacttatgtgtgccaaaaggtcacacacaaggatgaatgctctttgcttcttctcttctaccactgaaactagatctgcagcaggactgaggccttcttggttcagctagctctcctctgctgctgatgctattttttcacctatcaggcaaagggatacacttttttcaaggcaggcccttattcc

SEQ ID NO: 230525 - DNA, 221 bp, Homo sapiens
cccctgggtaagtctgcactgaagttaggctagattcttgactgtcctttccgaaatccatgctaatccaactcactgtctctgtccctctctcgtccccattttgaatgttctcccttttattttacttttcctaatgttttccaagctttgggctttggcttggaaagcctatctgactactcaagcacatgttaatcttccccttctgtagcattttt

SEQ ID NO: 230526 - DNA, 484 bp, Homo sapiens
agcattttaatataaagcaggcttttttcttcattttcttatggaaaggaaagcattttcagaataatggttaaaatctgtcctttgtagatctgaaaatgtgagcaagtttcataccgaagtcaagatctactgaaagtgttagatgaatatataaggaccagacgctgctgtcaaaaataaaacagatgctggtgtcttgaatgcctccatgtgccaaagctgagttctttgacttatttttgtcattgaattaattggtatatctggtttaattggccaaattgtttttgcttaaatgttcacattttcattgttatattgatatactcaatatttttgagggtacagaaaataccaatattggcaaatttggtatttttgccaattttgtgtgttcagaagaaaaattgttcatttccagatcccagatttatggaaatttaaaaatatatagtaaagtgttggtttctccttatggtta

SEQ ID NO: 230527 - DNA, 434 bp, Homo sapiens
ctttccatgctttgtggcttatcactgagctgtccatggagattctacatggatcaaagatgaggctgtctgcaaactgaggattaaagaaaccagtctgagtcccaaaaactgaagaacctggagtctgatgtctgagggcaggaagcatccagcacaggagaaagatgtaagctgggaggctaggccggcctcgtcttttcacatttctctgcctcctttttatattctagccatgctggcagctgatcagatggtgcccacccagattaagggtggttctgactttcccagcccagtgattcaaatgttaatcttggcaaaatcctcacagatgcacccaggatcaatactttgtatccctcaatccaataaagttgatactgagtattaaccatcatatctatgttactaataaaccagctacaaatgaa

SEQ ID NO: 230528 - DNA, 302 bp, Homo sapiens
ggcaaatacagagcatctttgtctgattctaggccctcatgaccagaaagcctggaattactttgcaggttgacaatggttgaaatttcaggatccattcacttcattggctatgtttttatgcagaacaaaacctgaattgtgggctggtcttcggttggaagactttttggagggcatatagtggaggtttttttttccctcctccagagagcatgtgtaaaataagggactcattcattatgcagcaaatgttgtttgttattggcttgctgtatattcacctttaacttccaaacatc

SEQ ID NO: 230529 - DNA, 416 bp, Homo sapiens
atatataaaatatgattttgaaataatgaacttttaaatttaaaattataaataatttttaaaatgccttctatttaggtaaagaatcttcaaaacaaacttctcatatgatatggtttgtctgtgtccccacccaaatctcatcttgaattgtagctcccataattcccacatgttgtgggagggacccagtgggagataattgaatcatggggggtggtttcctccctgttgttctcgtcgtagtgaataagtctcatgggatggttttattagggatttcccctcttgtttggctctcattctaccttgcctgttgccatgtaagatgtatgtttcacctgccatgattgtgaggcctccccagccatgtggaactgtgagtccattaaactttttatttataaattacccag

SEQ ID NO: 230530 - DNA, 385 bp, Homo sapiens
tttaaataggacttgtccttcagggtcacaagtgctgtgctctgatctctgccagcagaggtgatgggcttagcttatatcccagctgttccttcaaaccctggaggacgtgttgccatccccatcaaagactcctttctgttccaagtgctttttcatttagctggagcggtggtagccaggccagcagtggactctataccaataccttcactccggccaaagcccgagtctaggaggaaatctggagaaggaactgcttccaaccctgacgctctgggccctgtgaaatgaccttgaccatctctcataggtaataactgcctctcactgcaagtcaaccctgtatcaaaaaaaggaaaagagaaagaacttctgttcttca

SEQ ID NO: 230531 - DNA, 564 bp, Homo sapiens
gtgtgaggatttcatcaaatctgtaaaggtgtttaaacagtatctggtctgatactcaataaatgctgaccgttagtcattgtggtagcagcagaagtcacagtcatatcatgattgttgcagacgtgcttcaggtattgttgttgttataataattctatggcgagaaatatgccctggtcttgtctttcacaaaatccattctctggagactgaagatctgttgaatttctttatcattttctcacagagaacaggctttctgaatagggagtcttcacatggcagtactacattgagcaccttttcagtctgtgcagacacatatggaaaagtgcccatgacaagtagacacactgtgagtaaacgcagatcccacaatgtgccattgtgaattcttccagtgctctgtaagcaccatgattgttacccagcctcccagccacaccagcatgagcactggcgtctgctgtatcatagttccagataacagaggccttatttttaaaatttaaaaggattgtactttttgtttttccaccgactgttttttgaactttaaaa

SEQ ID NO: 230532 - DNA, 351 bp, Homo sapiens
catttaactcatttgtgagggaaccagctggattggaaaactggttcaaggagcattggaggaaatgagtacaggtgctgaaaaaacagtgttagaataagattgctagatttgggtacaaaactggtgaatgtccttgtgagaatgtaggaataactgacacagtttctcctgcttatgtggactctaacatgcttctaacacaagatgtgtgggagttttcctcttaccctctattttgccagaatttgtgaaagaacaaccatgcccccattagctccttaggaattctgacataggggttaaaaacagttgcagttaacttgcttaggaatcatccctgcttagtgc

SEQ ID NO: 230533 - DNA, 487 bp, Homo sapiens
cgcggtggctcacgcctgtaatcccagcactttgggaggccgaggtgggtggatcacgaggtcaggagatcgagaccatcctggctaacatggtgaaaccccgtctctactaaaaatacaaaaaattagccgggtgtggtggcaggcgcctgtagtcccagctacttgagaggctgaggcaggagaatggagtgaacccgggaggcgcagcttgcagtgagcagagaccgcgtcactgcactccagcctgggcgacagagcgagactccgtctcaaaaagaaaaaaaaaaaaaaagaaaaactccctttaagggttccatctagttaggagtgaaagaacacttatggagcacctcatgggaggcaggaacttctaagtacttctaggaatgatgtctcacaggaggagtcatctccattgcacggatgaaaccaaattgaggtcttcaaggacctgcccaaagtcataaagctaaaatggaagagc

SEQ ID NO: 230534 - DNA, 476 bp, Homo sapiens
aaacatcagccaacactgaccaaagctgggccagaaacagctaaaataagttttaaatgattgaaatcattcagaataggttttcttactataagatatttaagctgaaaactcataaccatcacaacaaaaataaaactggaacatatccaaatgtttggaaattaagtaataacacttcaaatgggtcaaagaagaaatgacaattaagttagaaaatattgtgaagtatatgataattttaaaaatgcaatattaaaacttatgggatgtggctaaagctatgctcacaggcaaatttatagccttaaaacagatgtataagaaaaacggcagaaaaatcaatcacgtaaggcactgtagtggatgctatgatgttctgcccaaatgtccactctaagactgaagtgcccatgttcccagctgctagccatgttgccaagctgagcacttctccaggaattgcctctcctgaa

SEQ ID NO: 230535 - DNA, 602 bp, Homo sapiens
cgagccgggaatggcgtctcaggggcaagtgagaactggcctgagaaggggacggtaggggcagaagacgccaggctgcctcttggaccagcagcgccggcccagagccacacgactctctgtggcactggcgacaaagcggggaaagtttctggctaagactttcacggagaggcagttcgctggcgtttagtgtgggggctccccggggaagccggtctttggaaagtggagggtggaggtgtggcgttctcggggtccccgccgagtcgtgccaccaccccgtcccgctccccgagcactgccagcagccccaggcgagccggggctctccgtggggcagggcacgcttctgcccccactccactccacagtgagagcccacgtccgtgggtgcaacgagctgcaggagcaccggacacacggccaagatgtgtttttgggagggcagagcggttttcattgcggcattcttcgtttcctttcatcctggagagaggagagggcgggcgccttcccacgccctgggcgcacaggcagatcacttacctccccgcatggccgcgccgggaggtttgccccgcgcggagctcggcggccgc

SEQ ID NO: 230536 - DNA, 468 bp, Homo sapiens
cagtagggtacagtaatgtcctaggccttcacattcactcactgactcacccagagcaacttccaatcctgcaaactccatgcatggtaagtgttctacacagctgcgccattttaaaaatctttttttacgctgtttttactgtaccttttctatgtttagatgtatttagatgcacaaataccattgtgttatagttgcctatggtattcagtacagtcacatgctatacaggtttgtagcctaggagcgaagcaataggctataccatatagcctaggtgtgtagtaggctaaaccatcaagatttgtgttgtttgcaccatgatgaaatcagcaagcaatgcatgactgtagtttgaaatcagcccgagataaggccttcagtcctcagccacagaaccctggactttgagagcagactgacatcctttcctatttttcttgtttttcttttccttttttttaa

SEQ ID NO: 230537 - DNA, 274 bp, Homo sapiens
aaaacgtgaatgtctaattttattgtcttctaaccaactcccacccttctccccaccaaacctactcctctcgtaaacctaatctcagtaaacaagtaccccatctttctacttgttcggaactaaattttggtgtcttttacatctctaccctcaatttatcctgaaatcaatgacctctcaccacctccaccaattccactctggtccaagctacattatctctggcctggattagggcaacagttccggattggtatcccagcttctgctc

SEQ ID NO: 230538 - DNA, 630 bp, Homo sapiens
agaaccccatggcagtgaattgaaccccatggcagtgaatgaatagaacctcatggcagtgaatagaaccccaaggcagtgagtgaatagaaccccaaggcagtgaatgaatagaaccccacggcagtgaacagaaccccacggcagtgactagaaccccatggcagtgaacagaaccccacggcagtgaatagaaccccacagcagtgaatgaatagaaccccatggcagtgaacagaaccccacgacagtgagtgaatagaaccccacggcagtgaacagaaccctgtggcagtgaacggaaccccacggcagtgaatagaaccccatggcagtgaatagaaccctatgggagtgaacagaactccatgggagtgaatgaatagaaccccacggcagtgaatagaaccccacagcagtgaacagaaccccacggcagtgaggagaaccccatggcagtgaatgaatagaacccccatggcagtgaatagaaccccatggcagtgatcagaaccccacggcagtgaatagaaggccatggcagtgatcagaaccccatgggagtgaacagaaccccacggcagtgatcagaaccccacggcagtgaatagaaccccatggcagtgatca

SEQ ID NO: 230539 - DNA, 529 bp, Homo sapiens
agaaccccatggcagtgaattgaaccccatggcagtgaatgaatagaacctcatggcagtgaatagaaccccaaggcagtgagtgaatagaaccccaaggcagtgaatgaatagaaccccacggcagtgaacagaaccccacggcagtgactagaaccccatggcagtgaacagaaccccacggcagtgaatagaaccccacagcagtgaatgaatagaaccccatggcagtgaacagaaccccacgacagtgagtgaatagaaccccacggcagtgaatgaacagaaccccacggcagtgatcagaaccccacggcagtgaatagaaccccatggcagtgaatagaaccccatggcagtgaatagaaccccatggcagtgaatagaaccctatgggagtgaacagaactccatgggagtgaatgaatagaaccccacggcagtgaacagaaccccacagcagtgaatagaaccccacggcagtgaggagaaccccatggcagtgaatgaatagaacccccatggcagt

SEQ ID NO: 230540 - DNA, 688 bp, Homo sapiens
tgtactactaaccttacattagcaacaagtaaatggctttcttaacagtattttcctgggtatgaggatgagtatcctttcagttttatatcccacaaactataactactgtacaactgatcagcaaaaatattatgattaatatgttaactgaggaagtatatcctacaatttagaaagattaacatttaaaatagttaaaattattgaaagttttaacttgcccgaaacagtccctaaccataagggacaattaatgatgctataaaattctatctaacattcctagtctacttgttgttttggagggcaggctgccattcctgcctattttaatctttcgaaggtggtctctgctcccatttaaaggtataagcaattaagagatacagaaccctcagaactaccttctataacttacctaatttctaagcttaaaatgtaatctaggctgggcatggtggatcacccgaggtcaggagttcgagaccatcctggccaacatggagaaaccccatctctactaaaaatacaaaaattagccagacgtagtggcagccacctgtaatcccagctactcgggaggctgaggcaggagaatcactcgaacccaggaggtggaggttgtagcagtgagccgagatcgtgccactgcactccagcctgggcaacagagaccctgtctcaa

SEQ ID NO: 230541 - DNA, 606 bp, Homo sapiens
tgtactactaaccttacattagcaacaagtaaatggctttcttaacagtattttcctgggtatgaggatgagtatcctttcagttttatatcccacaaactataactactgtacaactgatcagcaaaaatattatgattaatatgttaactgaggaagtatatcctacaatttagaaagattaacatttaaaatagttaaaattattgaaagttttaacttgcccgaaacagtccctaaccataagggacaattaatgatgctataaaattctatctaacattcctagtctacttgttgttttggagggcaggctgccattcctgcctattttaatctttcgaaggtggtctctgctcccatttaaaggtataagcaattaagagatacagaaccctcagaactaccttctataacttacctaatttctaagcttaaaatgtaatctaggctgggcatggtggatcacccgaggtcaggagttcgagaccatcctggccaacatggagaaaccccatctctactaaaaatacaaaatacaaattagctgggtgtgggtggtgcatgcctgtatccagctatctcagggaagtataaagcgttgag

SEQ ID NO: 230542 - DNA, 553 bp, Homo sapiens
caagacatgccagcaactgcacggctacttctccatttagccactatcccagagaattctgccaccttccagagccaactgttttcccctttctctgcgtttgatagtttcctccttttcaggacagagaataaagggtccctgtattcatgccttcctggaaatctcagtgcaaggccctatcaggaggtttcctggagcagctaagggaacagctagaccacccaggaagaaatgacagaagcctacctgacttccaatctgcttgcttcatggtgtaatgggggcctagacagaagcaccccaaggacacttacaacaactgttctgccagctctagtccattggagaagatgtgccaacataccttctcaccatccctagagcccaaccttgctatggaaaggtcaaacccttaccattggccctgccaaggatccccagacagagaagcacaatggaggccataaattatggcttcttatcatggcctccacataacttaaactctggatggtgaatgaaatctggggccaagtcttaaagggtcagg

SEQ ID NO: 230543 - DNA, 367 bp, Homo sapiens
gcctactactactaaattcgcggccgcgtcgacggtgactttgcacactgaaaccaataatttatttaaatttttaaaaattgggaccgtgcgtggtggttcacgcctatattcccagcactttgggaggccgaggcaggtggatcacaaggtcaagaatttgaggccaacctggccaacatggtggaacccctgtctctactaaaaatacaaaaattagttgggtgcagtggcaggtacctgtaatcccagctactcgagaggctgaggcaggagaatcacttgaagccagaaggcggaggttgcggtgaactgagttcgcgccactgcactccagcctgggtgacagaacaagactccatctcag

SEQ ID NO: 230544 - DNA, 159 bp, Homo sapiens
aaataacacgaatacatgacaatagttatactatcaagcctggcctactctaaatggaacaatccagatgcttcctggactaggtcttgctctgtcacccaggctggagtacagtggcgcggtcatggctcactgtagccttgacctcctgggcttaag

SEQ ID NO: 230545 - DNA, 403 bp, Homo sapiens
cagtttatcttgaaatggtttctcagaaaatatgcaaaaatagtataaagaatttctgtataatcttcatccagattcctcaaagcttaatgtattaggctatttgcttttcattctctcttcttctctctctatatgcaattgacctttgaacagtgtaggggttgtgggggagccgactcctgtgcagttgaaaacctgtgtataactcttttctttttttctgagacatagtttcactcctgttgcccaatctggagtgcagtggcatgatcttggcccactgcaacctctgcctcccaggagaatggcgtgaacccgggaagcggagcttgcagtgagccgagattgcgcccctgcagtccccagtccggcctgggcgacagagcaagactccgtctca

SEQ ID NO: 230546 - DNA, 170 bp, Homo sapiens
acatagcaggactgatcaggctgcaaccatccagacggcaaaagaataaaaagacaaatgctaaagaaatgtaagacggtgaccctccacataactcacttctgggagtcatttgttgcctctttatttgtatgtttcccccaataaaagttttaattaaaaaatatcca

SEQ ID NO: 230547 - DNA, 122 bp, Homo sapiens
gggcgggaggaagaggggcgggactggggcctgactagtcgtcgccgtcttcgcggctgctatgaccagcgggcgaggcgcccttcgcagctccgcgcaacgctagtcgcggccgtgcgccc

SEQ ID NO: 230548 - DNA, 529 bp, Homo sapiens
ccacaagctcttgtattttggggagagagctgctgcttctgtttcatttcagtcttattttcttagaatctgagtttaagaaaatatattaacttgaagcttgagtgtttttactgctgagatgctgcaatctttgtaactatagatgtcaatcattctcaattcaggttttttaagtgccccttttgactcttttctttggtttgttaacaagataaaagatgtttatgtttataaaaatggcttactcagaatttaggcaaactcatcagaggacataaatctagtgataaggctgctggctttttaataatggccttatgtcttttgcaaccatatatcattgaaaagtcactttagaaagtgttctgagtattatgaattttgatgccaatctgtgactagtaaaatgaccagtcaagcaaattagcagattgcagtatcttgctctgttttgtatggttgttttgacattgctttttaccagaataaaaagcattttagtagaatatactccatatatgacttc

SEQ ID NO: 230549 - DNA, 450 bp, Homo sapiens
ttgttcagattcagtctttactttaaacgtatcgtatccataaagcatatgacttatgggaaatgatctgtgcggtatggtaccctggagttgatcctgagcagaaaaagtggaaaaagtgaggaaatccaaataaaatctgtagtttagcttattgtttcaatgttaccatttaatttttgatggatgctttatagttatataaaagaaacatatcataaatgtaatatgttaactttagaagatgttatgttatataacatgttaactttagaaaatgttatgcaatatgttaactttagaagatggacaaatatattattgttaggttgttaagaaagatggatgaatggtataaagaaactatgttttattgttaaacttttctgtaaatctaaaatcactcccccaaaatgtgtattttataaaataaattacacttgggcctca

SEQ ID NO: 230550 - DNA, 435 bp, Homo sapiens
ccttttcccctgaagactgagcatggaagactatgaaatggagaagttactaaaataccaaagtaattaatcttggctaagttacttaactgatttcctcatccaaacagttgggactagggtttcccttttgtgtaatttattgtatattcgtaacggttagatgtaattgtacatgcaaaagttcttcaaaaagtggatgttttcttttttgctttgtttacggggttatctggataacctgtaagagatgccaaggattttattagggggaatacttaggagagaaaaagggatgggtgctggggaaggctatcagcccttggtgaaggtataacctaaatggagaggtaggaacaacaggtaggaaagttgggcgcaagagtcttcaatctgggacggtttggcaagaggtcacaaccctgaaccaaagtc

SEQ ID NO: 230551 - DNA, 441 bp, Homo sapiens
tatattacagaattggctatcacatatataatatttttctatatagaggcataatgtgtaattttgaagtgactgattcctaagtgaaatgatctaaataaatttgtcagaatttataatgtctaaggcaaccatcacaaaatggtattttggaaagattattattatgaagagaatatattttcctccattatctctttgtttttatctttttaaaggtaatcatagcctcctggtgtcgcacatccatgggaataatgaatttatttggactagaaactaagacctgctggaatgtcaccagaatagaacctcttaatgaagttcaaagctgtgaaggcatgtttcttccaaaaatgctgtcatttgtaaacattcataaacatttaataatattatgattcacttttaagaattattgtaaaatactgttgttgattt

SEQ ID NO: 230552 - DNA, 321 bp, Homo sapiens
ctttatgttggacacacagttcttgctcttcctccagtactatgctttcttatctcaggaacttccattttatagattttctttctctagaacaggagtcagtaaaattttttaggagagggccagatagtttgccaattcctgatctaatcccactgcttaccgattcaaatgtcatgttctcattgaagcttttcttaatcaatgttaagtgccctgctggggacagtggctcacacacctgtaatcccagagatttggaaggccgaggcgggaggatggtttgaggcgaggaattcaagaccagactggacaacatag

SEQ ID NO: 230553 - DNA, 391 bp, Homo sapiens
tagtacaagcttgttatgtaacatatttgcttgaagttattttacttctaatatatgctttggttgttaagtaaaggagtttcttgaaatgcaaaaatttcactatttatacttaaatgaggaaacagccatttaaaactagagtgctgatggatggtagttttttaagttggagaaaacaaatctgcatttagtgatccagtgaaacaagacagttcatggggatcaatactcagctgagaccaggtgcggtggcgtatgcctgtaatcccagcaatctgagaggccaaggcaggaggattgcttttgcctgggatatcgaggctgcagtgagctgtgatagcaccactgcactccagcctgggtgacagagtgagagcctgtctccaaa

SEQ ID NO: 230554 - DNA, 187 bp, Homo sapiens
agcaagactgctgtattctgctttgaatttccctcttggcaatggtgtctagaacatgtctctaggcagaaagccagggtggtcataggccttatctagtttgttttcttgtttcagggaacacagatctacactaattgttgttcactatctggaaactgtcatgtattttgtctggttttgcagt

SEQ ID NO: 230555 - DNA, 304 bp, Homo sapiens
ggtgaaaatgacatgagttaatatttgtaaagtatatagagctatgcctgggatgcatgaagggctgtgccagtgtttgttcaatgaataaagcagacaagagagtgaggcaaagggagagacaggcaatgagagggggaggtggagggactcaagacagagagaaagagacagcagtcagatggcacagatagggaggccaccaggtgcacagaccgacaggaacagacaagcaggaaggagggggcaaaagcaaaagcctttaaaaattagagaaagagacccagtgaaaaagaaaagggga

SEQ ID NO: 230556 - DNA, 1119 bp, Homo sapiens
ggggtctccctatgtcacccaggctggagtgcagagatgcaatcacggttcactgcagcctcaaattcctgagcttaagtggtcctccctcctcagcctcccaagttgttgggattacaagcatgactaattatgcccagcaatggtaggtttttgttgttgttgtttacaaagttaaatgtcatcattttttatactgaaatatcttttaatacttttttttgaaatattactgattatttagaacccaaagtctggaccattgaacaagttcattccaatagtctctttcactgttaatattctctgatcctatgatttattcttctcttgactttctacatcctaatggaaatatgaaaatcaaagagcttaaggaaatgttgtggctgtatcaatcaggacagaataggttattctgcagtaataaaagaaactaaaatttttcagtggcttacaataaccaagtttctcatgttcaactaggatcaacaaaggcactcttattagtccctttgtaatgtcacaaaaacttcattttgacacatgctttagcaatcgggaactccccaaagtaaaacaatctttctgctcacatttcacagccaaaacaaatcacatggacattcccaaattcaacaggatgggagtatttcatttgcagggcggatcactaatatttatgaacaatagtatattgcatatatgagatcagaaataaaaactaacaggaaaaataaaagaattttcattggagtgaacatttgaaaaataagaaatgcgagtttaaatatataaagaaaaatacaatatatagagcttctcacctccatcctttccttcgatagcaagacattcaatttcttccaagtttgtatgatcatttctatgcatgtttttatgacttacttcatctaatgttcccataaataacatataatggaattttatgtagttacctttttctaagctttgaaaagtttcataaaactgctcactcttcttaaattttgaatattcaaagatcacggtatacaaataccatattaagtgctattttataatttacaaaaaattaaaatttcttatgtaaaatactttttttttttttaatctaac

SEQ ID NO: 230557 - DNA, 350 bp, Homo sapiens
gccaccgcgcccggcctagttagatgtcattttaaaattcaggtgatattttatgttattctattggttatgttcattgaaagcatccaaagaaaaacatgaggcaattaaaattaatgaatttcaataagtaaaatttaaaataatataaatatgaaaggagattgtaaaatattaagcattttataaaaacccagaattttgagttaggagagctggccttggctgggcaaggtggttcacacctataatcccagcactttgggaagccaaggcaggaggatcacttgagcccagaagtttgtgccactgtactccagcctgagtgagagagcaagaccctgtctctt

SEQ ID NO: 230558 - DNA, 432 bp, Homo sapiens
agtgaaagagtatacaaacactacaagcccatatcagtcaacatgagaaaattatgttttccaattaagttattgaaaaaactgtgtgtatgtatacaggtacatttccatttataaagaatatctaggtttgatttcagtcctttttcctgttctcccaataaaagtggcccctggccattcattttaaggtcagaaactcctgctgccccagggcagctcatatgcttctgttaatcatcttgattcaaatggaggagggagttaaacaaaccagcttaggacccggggcccaaacatctcgaatgcagccagctctgttttctctgtcagctttgtcctaacagcgaatgaccacttaatgcattgaaagcaaaacatcattgaaagggggaatctgcttttgaggacagggaaagaaaatgaaaatat

SEQ ID NO: 230559 - DNA, 245 bp, Homo sapiens
accaataaatcaataaatcctcattgtaatgtgtaaactcccatctctgtgaagtagttaaaagcaaactgtgaatgaacacatgaatccaaaaaaagtatgttgtgattatattgactctgaaaacgtttgaatttcatagaatacatcatttatcgtgtagtataaattgtttgtactattgctcataattttttgaataatgaatccagtgaatagtaaaataataaaaatgtttgcatcct

SEQ ID NO: 230560 - DNA, 620 bp, Homo sapiens
aagtcactggtgacagtgtttcttatgtgagaatggtgttatggataggtacgaaaacgtactttttagaatatgcttctgaaacatttagcagggatgtgctgtgatatctgcaaatcgctttcaaatggcatagcaaaaattgtgtgtgagtatacacagagagggagaggagggaaacgtggcacatgttcatgattgatcagtctacatgaaggatatatagaggatcattctttcagtttttctgtagatttggaattttttgaaataaataaaacatttgaggcaaaaatgtcactggtacatggtaccaatggctcatttttagtcaccttactcttaaatgtgcttcgctctcccagttttctgagaatttatttcaaaaggctagaaattgtgcattatttcagtttttactcgtttcctctttcttcccttcaaagtattttaggattaaattgtgtagactgggcacagtggctcacacctgtagtttcagcagttttggaggctgaggcgggaagactgcttgagcccagagctttgagaccagctgggcaacacagggagaccccatctgtacaaataattagccgaatgtggtggcacatgcttgt

SEQ ID NO: 230561 - DNA, 401 bp, Homo sapiens
ttctagttcttacagaggcagagagcatgctgttcaggcgcagatgctggcgttggacacacccagatgtcagtgtgaaaagaaaataaaattccgggaccccaaactcaatacaccaaagggaaaaggaaagcttggaagctgagtcacacaaaaaatcggtcttttgtttctaaatagacagctacaagataaaaggacacatgtctctccaggtggcctccctcaccttgacagtgtgaattaacagcttatcttcatggacatgggacaagaggagactggaaatcatctcccacaccaccctctccaagacaaattcatatttaacttctacttctgctctgttgactttatcctatgtaaagtacagatttactgagcacgagacaaatgcataa

SEQ ID NO: 230562 - DNA, 356 bp, Homo sapiens
cagcctgattggaggaaatggaatatggagggagtagtatcaaagaaggttaaatataggccaagtgcagtggctcatgcttgtaaacccagcattttgggaggccgagataggtggatcacttgaggtcaggagttcgagaccagcctggcgaatatggtgaaacctcatctccaacaaaactacaaaaaattagccaggcatggtggcatgtgcctataatcccagctactcaggtggctgaagcaggagaatcacttgaacctgggaggtggaggttgcagtgagccgagagctgagatggcaccactgctctccagcctgggtgacaaagcaaggctctgtctcaaaaaaaa

SEQ ID NO: 230563 - DNA, 389 bp, Homo sapiens
ttgaacaagggaaccccttcagcttcgaatgaccattaccgttgatgatcccagaagttccctttccaagcagtgacccatggacttgtgtccctcgtgtgataacctgcactacacacatatcctacaagtgtccatagtggttataagctgccacagccatacagatctgagagccagaggccttcaaaccagctaaggctctgaaacacttcaactccacttaagaaaacaaatcggagcacatccgtgatcccacaaatgctaatttgcttgtcacacatcagaaacccaggaaggcacagaatagatgctctcttactggcttataggttgggtactttaaagttggagacgtttaaatcagagataaacctattgtaacaata

SEQ ID NO: 230564 - DNA, 178 bp, Homo sapiens
ggaccccaggaacaatccattttctgctgttgtaggtcttttctggagctgacttgaagaaaagagtacatctctttaccctgctgtttgtccaagagtgatacatttatttggggtaaacttaaaattaatttattgccatttaaatttctaacgatggaatattagggagccaaac

SEQ ID NO: 230565 - DNA, 397 bp, Homo sapiens
actttcagtctctgcttatccacccaaactttcttaagatcagttttgctccaaatgatgtggcaaagcctttgatcagttgtaacttgaacagccttttcaaaaaatctgatattggctgggcatggtggctcatgcctgtaatcccagcactttgggaggccaaggtgggcagatcacaaggtcaggagttcgagaccagcctggccaacatagtgaaacctcgtctctactaaaaatacaaaaattagctgggtgtggtggcagggacctgtaatcccagctacttgggaggctgaggcaggagaatcacttgaacccaagaggtggatgttacagtaagccgaaatcgtgccattgcactccagcctgggtgacaagagagagacttcgtctc

SEQ ID NO: 230566 - DNA, 379 bp, Homo sapiens
gctaagttcattaatcccaaaatggcaaattaggaagtaggctcttttagcaacgaattacaattaatcaatgttccctgtggcaaaataaccttactttattttataattcagttaaactaaaaattttaatctttacctgatcaatcatctttatgaaaagtcaactattgaaactgtatgtcctgaatttggttttttacttctgaagatttaaaacaatatcaatgacctctacagcaaatattttcttcacatctcagggattttcctatatttaaattgctccttcatttactaacttctaattcttttttgcaattacctttgttactcaaattctcagtttcaatgagacaatttttagatgcttcaaata

SEQ ID NO: 230567 - DNA, 385 bp, Homo sapiens
cacccctttacgcaggcatccctttacgtggcatgtctcacttaagcctcctaaccggaggacgattacgtagggacgattatcttccccttattacaggcaagaaatgacggttccgaggcggtaatccgcaggagccggcactgacggagaccgtccacgccctgcagccccgccccccgcccccagccccccgcccccagcctcccgcttgcatcccagtgtcttcagtgccagtccgccggccccatcccccgcggggttcctgcgcctcccggccctgccagagcccggggtcggagggcaagaagggccgggaggcccgggggtgcggagtgggatgggggtccgggccctcggtgccagcctgagctcgaggcggccg

SEQ ID NO: 230568 - DNA, 198 bp, Homo sapiens
agagccacccttttattccttctgtttcaaacactaaatcctaacttgacctgacaagtacctacttatccttcaggtctcagattttatcccttttgggaagtcttccaggaccattccaccattcccctaacactcacatatacacctccttcctgtgaactcccatgacatgctatacttcctctatcatagaac

SEQ ID NO: 230569 - DNA, 266 bp, Homo sapiens
gctgaatgatattccattctataaatacacctcagtttctttatccatttacttattgaaggacggttgctttcaagttttggcagttatgaataaacctactacatatttgtatagtttttctgtggagatgttttcaactcatttggatatgtgccaaggagtgcaattttctctgtcatatagcatgtttagtcttgtaagaaactgccaagctgtcttccaaagcggctgcaccatttattttatttatatatattttttga

SEQ ID NO: 230570 - DNA, 206 bp, Homo sapiens
ttcccccatctccaactactcccccgcccccgctcgccaccaaagcaccagctcagacacagacatcacagagctttggagctgggcacggtggcttgcacccctctcatcccagctatttgctagaccgaggtggcaggatcgctggagcccaggagtttgagaccagcctgggcaatatagcaagaccccatctcttaaaaaaa

SEQ ID NO: 230571 - DNA, 567 bp, Homo sapiens
tttgcatccccagggcctagcacagggctcggtacacaggaggtgcctggtagaagttatgggaccaaaatggcagagatggggctccaagcctgtgcttgagccatcaggtatgtacgtttcagctcatctgttttgagccaagcccctaggctgcactttactatagactccacctgaagttcacccaagtctgtgctaccgaaaaagtcagagcccggagggggagaattctccattattctcagagtgctgaccccatgtgcttcccaatggctcatcccatagatggggctccataccccaggctctcttcccttaggaaacctttcaaggaaggccgtttgattgtgtttctttctcccctaataattctccccagctctgccccagctgccactgccactgccacagctgccgtagaggtgggagctgtgccttcagcatcctccaagtggctgctccaggcctcattcagagcaggtgtccctgtgtcctctgcctccagctgtgggtttccaccaagcaaagtcacaggctttacacaccccttcctcccacagccca

SEQ ID NO: 230572 - DNA, 460 bp, Homo sapiens
tgctggattttgtcaaatgcattttctgtgtctattaatatgattatataattttgctttataaaatattttaatatgatatatatattcattttttgaattgatttaatgtttaaagcatgtgtttaatgagtctcttatcatgatagcttaagaggtcatgaaaagatctaactctactgtgacatctctgatgttactaatggattgtgatttgtgtttccaaaattaatgctaaaattggttctgtaaactcatacctttgatacaaatgaataatttaatctgtgaatatttttacccacattttaaaaataccacaattggcattttcaaagatagatgagatgcttttaaaaaacttttctttcaagttttcaatgtcagtctatgtccacacttattagattaatatatttttttctaacaatatattaaacaatatttatattaaacaata

SEQ ID NO: 230573 - DNA, 153 bp, Homo sapiens
atccccctgtccagacagcagccaccactgctctctagctctttatgctgctttgtatttcatcagcgctcttggcactatgtgatgcattaaatacccatatttgtgttgtgtatctgacatgtatcttcctattaaaatatcagcaccaca

SEQ ID NO: 230574 - DNA, 463 bp, Homo sapiens
aatatcaatattagaaaaacaacaaacatgaaactcgtcccctgatacttatcaggagagtttgcctcaatattattcctctccatgatctagtgttcaaaaaagaagtactggttgtttttatatttgtttactttgcaacgcaatgcatttgttcaaatccaagcagaatctacattttctcttttgtttcagtggctaaccagccaggtaaactaattgttctctgctattaaatcaaaattagagttaggaataaaagccaaagtagcatagttaacaaaaacccaccgacgtttacagtcattacatggcacagaagaacctatggtttattaggaaatgtcacctgccagaagctaacatttagaccaagtcttatatcactgtcctggccaaactataacaaagcgaagaaattgcttaagcaaaaacaaggacaataaaacaaaggttttctaaa

SEQ ID NO: 230575 - DNA, 611 bp, Homo sapiens
agttatttatagcaatgcaagcaaggactaatacaaatgtcaagaatattaacctctttcaatcaagtagaaaatcctattaattaatagatgtgtctgctgttatttaagatgttgctttttaacttatttttagttcctatattttcttgttaatcactaaggacattgtcaaaaccatggcaggtcttggttttggacctaacagaaaactggtaggtccatgacacaagttcatcttttccaaaagaatcaaattcaggtttcattgatttttctcaattgcatttcttactctattttatttatttccaccataatctttattatttccttccatctgctgtttggcatttagtttgctcttctttttccagttttgtaaagtggaaggctaggttattgatttgagacatttcttctgatttataaatttaatgctatcaatttccctcatctctttgctaaggcatttgaggctgtgaccttctcagaaagtcgtccttcagtgttgacagactctgtagactttgttgccatgaaaactgtacactttgtcaaagagctggtgtggtcttcctggagattaaagctgagattttagtcatgct

SEQ ID NO: 230576 - DNA, 397 bp, Homo sapiens
taggaaggggcagcctagccagtccaatcccttgctggttactcatggagtcagggtaccaaatggggataccagaatagatgatcaaaaaaatttcctgacatcaaagtctgcactattttgatgggttggatggaggagtagataataaaaaaacagtgagcctctgaatggaccaagaaaatatcaccacttaggaagggaaaggcaaagaaaagagcagcttaggaatgttgaagccaagtgagtgatgaacaatccttttctatttggtaagaagaaaagagagtagaagaacactggaagcttaaaggaagaaaaagaatgaaggaagaagggaagaaagggagggagagaggaaggaagacagaaggaaaagaaaacgaaaaagaaaaag

SEQ ID NO: 230577 - DNA, 186 bp, Homo sapiens
tgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatac

SEQ ID NO: 230578 - DNA, 1634 bp, Homo sapiens
ccaaaacaacggagttaaaagttgtgaggaaaaaatgttattaaatttaaaaatgaaaaagcatgaaccaagagcaacgtttagagaaggaagaggaggcggcgaggccggggatttgagggggcgccgggaggccccgctcccgccggaggcaacagaaccgtagcgagccaacggagggagaagtggagttagtgtgaggaggaagccccggatcccacccctaaccccccttcgcctcctctgaggatccaataaatcaaaaggcgaaatgaaacaaaataaagagaagaaaaacgctaataatcagcacgagaacgccgaggactaggaaagactagggccagtgcctccccgggggcagggagcggagggtgggggggcgaataacgtgaaagttaccagaaacattatttagcagcggattccctgcgtccttgtcaatttcagagacaaaacaagcagcccaggctagtagtctaggcggcggcgcagcggctgcggcagcgcggccccagcggcggccccggcggcggctcctacgcagcccgtgcccgccccgagccgcgcgagccacggcggcagcggcgcagcagcggcagcaggagaaccgggggaatcgcgctgctggggtaaaagctggagcgaggcgaaagcgtgtaacgattgcacacgcacacacacacaccactcacacgcactcgccgcccgcccgctcgcacagcgctggaacacgcgcgcccagacacgcacacacgcacgcacacacactcgcacacacgcagaggcacgggagggaaagaagccgatgaataattttgctattttttaaaatactggccgccatcatcaagcagcgagcagcagcagaagcgttgaagggagaggaggcatcgggacaggcccctcttaggagaggatttatatctagttggaaaaaaaaagaaagaaaagaaaaagaagaaaaagaagaaaaaaattgtcaagcccccgaactgaaggttacgagcggcccgtcagcagcccacatgtaaccgaactgtcgtgtttcatggctttttgccactccagctgtcaatcaaagcccggaatgtcaaggtagtgaatgaatgatggttgatgatgatgaagaggaggaatctttcagacccgtttttttcttccagtaaaactccgcgaggggtttctgcttcttgaattttttcctcccccctccccccttttttagctttgcccccgcggtatctataatacgatcctctctctttaaagtattgttcaaagaaagcagtgagaaaaatcaagaaaaaaaaatgaatagtttgcaaaaattggacttcctccccccctttcctggtaggtattttgtctctccctctctctctttctcgctcgctcgctcgctctcactcgcgctcgctctctcgcgctcgctctctctcgctctctttctctctctgggagatgagtgagtgtcagtaggtgttggcaggttggctgctgcctggcttattgaagagcctcagtttggcggcgcgggtcggcggcgggagaacgaaatgacggaacccggaagtcgtggtggccatagcccgtcgtacggcggagacacatcccgggagtggggagcggga

SEQ ID NO: 230579 - DNA, 570 bp, Homo sapiens
aatcattctcattaaaagatactaatcttccttcccttcagtgtgttagctcttttagtttgttagttcacgtgtgaaattccatggaaatctataaaattggatggaatggctctgttaggaatagagagaatttgttccacgcataatagagcccgtgtgtcagaagtcctttaactttgtgacccgtcctaggtgtaactcaaagggacacagcaggctatgtcacctgggtgcgttttgtgccgtgacaaaaagctaatcaccttcagttataaacagtagctacctcagcatcagtcccctgttttgtgagcagtgggagatattgtcctacaggagcttacagagattggcaactcaaggatccatcactcaaaacagatttcgattgaaaacattgacggaaggatatattttttctatctgcccaggaaagtggctttctggaagggtgcacattgcaggagaggccaggtagattatatcagtaggctcctttccctagcagaccacacaaaatatggggaacaaatttgtttatctgcatatgcatacccgaaaagcaaa

SEQ ID NO: 230580 - DNA, 406 bp, Homo sapiens
agcccctttgatgtcaagttcctctaactcttttgaggccagaattgtgagaacaggaagcccagagtctatgagtggttttgggggggtaatggtatgtatggccactcttgctaccacccctagtatctcgaatgcaagtattctaatcacagcactttgggagtctgaggcgggcagatcacaaggtcaggagtttgagaccagcctgaccaacatggtcaaaccccgtctctactaaaaatacaaaaattagccaggcatggtggtgcgcaattgtaatcccagctactcaggaggctaagacaagagaattgcttgaacgcgggaggtggagattgcagtgagccgagattgcaccactgcactccaacctggtcaacagaacgagactctatctcaaaaa

SEQ ID NO: 230581 - DNA, 402 bp, Homo sapiens
tggaaacccagctttttggtcagccgtcttgtgatttggctgggcctggtttgtgggggtcgctctctgaggttgggtagctctttggagaagattatctgggaactcccatccttatcccaaacatacaccaaacctgcccccatccaccattatggaatttagtaccagagcatccttgcagattagttctcattttctctctttgtgagcacacacacatcaggtagaggttccagaaacccagctttaggacactgttcacatatcacaggaggagcaaggacatgaatacaagagagctctttcctgaccagcagtgggaggtggttgtactatctatttatttgtttatttatttatttattttttgagatggagtctccttctgtcacccaggct

SEQ ID NO: 230582 - DNA, 425 bp, Homo sapiens
tgataactttgtgtgagcatgaaaatcgaatggggaagggagagctccgtcttgtgatttggctgggcctggtttgtgggggtcgctctctgaggttgggtagctctttggagaagattatctgggaactcccatccttatcccaaacatacaccaaacctgcccccatccaccattatggaatttagtaccagagcatccttgcagattagttctcattttctctctttgtgagcacacacacatcaggtagaggttccagaaacccagctttaggacactgttcacatatcacaggaggagcaaggacatgaatacaagagagctctttcctgaccagcagtgggaggtggttgtactatctatttatttgtttatttatttatttattttttgagatggagtctccttctgtcacccaggct

SEQ ID NO: 230583 - DNA, 662 bp, Homo sapiens
aattaaatgaagacaaaggttgtgattattacagtaaatgaaaataggtttttatctttaaaatgtagactcaaactgcaaagctaatgatatgctatctgcaaaatattcctattttgtaaataaataaaaccatagatttaaagaagaaagggcacagatgtactggggagacaaaaataactgatccgttgggtgtataccatgtgccaagcaattttcatatactcatttaacatgacatatctataattatatgaggcagatattattaacctcagtctatagatgagaagactaaagctcagagggattgctaaaaactagtaaataaattatggaaccatgatttgaatttagatttaagtctgactgaggcatgttcaaagacactacactgcctctccagaaatcaggagtagcaatattaacactggacaaagaatttaaagcaagtaaaaaaaaattaagagaatttcatattaataacaagtataatgcacaataaaactgtaccaaatgacataaaaatgcataatgaaatttattagaaattaaaaattaaagggcatagttacaattattgaggaattctcatagctctgccttatagatcatgtaaacaaacaaggtcatagaggacttaaatagcaaagcagaaa

SEQ ID NO: 230584 - DNA, 477 bp, Homo sapiens
cttttgccccatgtccctaggactggcccacaattcagactggttaccaagtacctagtgtataaaatagtaccctttactctccctgtgagctgccttgcctgatctcggccacatctgaagaatcaacatacatataacctttaggttggcttacatttgccgtcatttaacccccaggtccctcaccccaagcttgtgagctgggtggggtccatactacaagcaaatattatctaaataaacagaacttggccaggctcagtggctcatgcctgtaagtaatcccaacactttgggaggctgaggcaggaggatcacttgaggccaggagttcaaggctagcctgggcaacatagtgagatcctatctctaccccccccaaaaaaacaggaaataataataaataagaaatttacaaaattaaaaaattagctgggcgtggtagtgtgcacctgagtcttagctactggggag

SEQ ID NO: 230585 - DNA, 154 bp, Homo sapiens
gatgatgggaccccaaggcttctgaacagatgctgcctaagctccaaacctcattttctagtctctgcttacctatatttctaagcttttatttatccctctttcttctattcctgatttcctggttcctaaaacccttggctttgggatcatg
